United States Patent 12,371,699 (NUCLEIC ACIDS ENCODING CRISPR-ASSOCIATED PROTEINS AND USES THEREOF) - sequence listing, part 5

SEQ ID NO: 3639 - RNA, 4577 nt, synthetic construct
  misc_feature 1..4577: note = Cas9 variant mRNA product
  source 1..4577: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3640 - RNA, 3659 nt, synthetic construct
  misc_feature 1..3659: note = Cas9 variant mRNA product
  source 1..3659: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3641 - RNA, 4415 nt, synthetic construct
  misc_feature 1..4415: note = Cas9 variant mRNA product
  source 1..4415: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3642 - RNA, 4448 nt, synthetic construct
  misc_feature 1..4448: note = Cas9 variant mRNA product
  source 1..4448: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3643 - RNA, 3581 nt, synthetic construct
  misc_feature 1..3581: note = Cas9 variant mRNA product
  source 1..3581: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3644 - RNA, 3659 nt, synthetic construct
  misc_feature 1..3659: note = Cas9 variant mRNA product
  source 1..3659: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3645 - RNA, 3665 nt, synthetic construct
  misc_feature 1..3665: note = Cas9 variant mRNA product
  source 1..3665: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3646 - RNA, 3365 nt, synthetic construct
  misc_feature 1..3365: note = Cas9 variant mRNA product
  source 1..3365: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3647 - RNA, 3776 nt, synthetic construct
  misc_feature 1..3776: note = Cas9 variant mRNA product
  source 1..3776: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3648 - RNA, 4334 nt, synthetic construct
  misc_feature 1..4334: note = Cpf1 variant mRNA product
  source 1..4334: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3649 - RNA, 4313 nt, synthetic construct
  misc_feature 1..4313: note = Cpf1 variant mRNA product
  source 1..4313: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3650 - RNA, 4466 nt, synthetic construct
  misc_feature 1..4466: note = Cas9 variant mRNA product
  source 1..4466: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3651 - RNA, 5249 nt, synthetic construct
  misc_feature 1..5249: note = Cas9 variant mRNA product
  source 1..5249: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3652 - RNA, 3521 nt, synthetic construct
  misc_feature 1..3521: note = Cas9 variant mRNA product
  source 1..3521: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3653 - RNA, 4589 nt, synthetic construct
  misc_feature 1..4589: note = Cas9 variant mRNA product
  source 1..4589: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3654 - RNA, 3665 nt, synthetic construct
  misc_feature 1..3665: note = Cas9 variant mRNA product
  source 1..3665: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3655 - RNA, 4526 nt, synthetic construct
  misc_feature 1..4526: note = Cas9 variant mRNA product
  source 1..4526: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3656 - RNA, 3608 nt, synthetic construct
  misc_feature 1..3608: note = Cas9 variant mRNA product
  source 1..3608: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3657 - RNA, 4364 nt, synthetic construct
  misc_feature 1..4364: note = Cas9 variant mRNA product
  source 1..4364: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3658 - RNA, 4397 nt, synthetic construct
  misc_feature 1..4397: note = Cas9 variant mRNA product
  source 1..4397: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3659 - RNA, 3530 nt, synthetic construct
  misc_feature 1..3530: note = Cas9 variant mRNA product
  source 1..3530: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3660 - RNA, 3608 nt, synthetic construct
  misc_feature 1..3608: note = Cas9 variant mRNA product
  source 1..3608: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3661 - RNA, 3614 nt, synthetic construct
  misc_feature 1..3614: note = Cas9 variant mRNA product
  source 1..3614: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3662 - RNA, 3314 nt, synthetic construct
  misc_feature 1..3314: note = Cas9 variant mRNA product
  source 1..3314: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3663 - RNA, 3725 nt, synthetic construct
  misc_feature 1..3725: note = Cas9 variant mRNA product
  source 1..3725: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3664 - RNA, 4283 nt, synthetic construct
  misc_feature 1..4283: note = Cpf1 variant mRNA product
  source 1..4283: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3665 - RNA, 4262 nt, synthetic construct
  misc_feature 1..4262: note = Cpf1 variant mRNA product
  source 1..4262: mol_type = other RNA
gggagactcctgtcgggcggaagtaggaggagtagagtttaaaaacagtactctttttccggttcgggacgtagttgaagcaacgacaagccggataaccgctcttgagacaggaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 3666 - RNA, 4452 nt, synthetic construct
  misc_feature 1..4452: note = Cas9 variant mRNA product
  source 1..4452: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3667 - RNA, 5235 nt, synthetic construct
  misc_feature 1..5235: note = Cas9 variant mRNA product
  source 1..5235: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3668 - RNA, 3507 nt, synthetic construct
  misc_feature 1..3507: note = Cas9 variant mRNA product
  source 1..3507: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3669 - RNA, 4575 nt, synthetic construct
  misc_feature 1..4575: note = Cas9 variant mRNA product
  source 1..4575: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3670 - RNA, 3651 nt, synthetic construct
  misc_feature 1..3651: note = Cas9 variant mRNA product
  source 1..3651: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3671 - RNA, 4512 nt, synthetic construct
  misc_feature 1..4512: note = Cas9 variant mRNA product
  source 1..4512: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3672 - RNA, 3594 nt, synthetic construct
  misc_feature 1..3594: note = Cas9 variant mRNA product
  source 1..3594: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3673 - RNA, 4350 nt, synthetic construct
  misc_feature 1..4350: note = Cas9 variant mRNA product
  source 1..4350: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3674 - RNA, 4383 nt, synthetic construct
  misc_feature 1..4383: note = Cas9 variant mRNA product
  source 1..4383: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3675 - RNA, 3516 nt, synthetic construct
  misc_feature 1..3516: note = Cas9 variant mRNA product
  source 1..3516: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3676 - RNA, 3594 nt, synthetic construct
  misc_feature 1..3594: note = Cas9 variant mRNA product
  source 1..3594: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3677 - RNA, 3600 nt, synthetic construct
  misc_feature 1..3600: note = Cas9 variant mRNA product
  source 1..3600: mol_type = other RNA
gggagagtccgctcagccaggttgcagaagcggcttagcgtgtgtcctaatcttctctctgcgtgtaggtaggcctgtgccgcaaacaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3678 - RNA, 3300 nt, synthetic construct
  misc_feature 1..3300: note = Cas9 variant mRNA product
  source 1..3300: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3679 - RNA, 3711 nt, synthetic construct
  misc_feature 1..3711: note = Cas9 variant mRNA product
  source 1..3711: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3680 - RNA, 4269 nt, synthetic construct
  misc_feature 1..4269: note = Cpf1 variant mRNA product
  source 1..4269: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3681 - RNA, 4248 nt, synthetic construct
  misc_feature 1..4248: note = Cpf1 variant mRNA product
  source 1..4248: mol_type = other RNA
gggagagtccgctcagccaggttgcagaagcggcttagcgtgtgtcctaatcttctctctgcgtgtaggtaggcctgtgccgcaaacaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3682 - RNA, 4433 nt, synthetic construct
  misc_feature 1..4433: note = Cas9 variant mRNA product
  source 1..4433: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagacaagaaatacagcattggactggatataggtacaaactccgttggctgggccgtgatcacagacgagtataaggtaccatctaagaaattcaaggtgctcgggaatactgataggcattcaattaaaaagaaccttatcggagcgctgttgtttgacagtggcgaaacggctgaggccacccggttaaaacgcacagcacgacgtagatacactaggcggaagaatcgcatttgctatctgcaggaaatcttcagcaacgagatggccaaggtcgatgactcctttttccacagactagaagagtcttttctcgtggaggaagataaaaagcatgagaggcacccgatattcggtaatatcgttgacgaagtggcttaccatgagaaatatcccaccatttaccatctgcggaagaaacttgtcgattcgacagacaaggcagatctgcgcttgatctatctcgccctggctcacatgattaaatttcgagggcacttcctgatcgagggagacctcaaccctgataattcagacgtggacaagttatttatacaactggtacagacctacaaccagcttttcgaagagaatccaattaacgccagcggcgttgatgcgaaggcaatcttgagtgccagactgtccaaatctaggcggctagaaaatctcattgctcagctgcccggcgagaagaaaaacgggctttttggaaatctgatcgccttgagcctcggtctgactcctaacttcaagtccaattttgacttagcagaagatgctaaactgcaactctcaaaggacacatacgatgacgatcttgacaacctgttggcccagatcggcgatcagtatgcggacctattcctggccgcaaagaacctcagtgatgctattctgcttagcgacatactgcgtgtgaataccgagatcacgaaagccccattgtctgcttccatgattaagcgctacgacgagcaccatcaggatctcactctgttaaaagccctggtcagacaacagctacccgaaaagtataaagagatcttctttgaccagtcaaagaacgggtacgcaggatatatagatggcggtgccagccaggaagagttctacaagtttattaaacctatcctcgaaaagatggacgggaccgaggagctgcttgtgaaattgaatagggaagatctgctccggaagcaacgaacattcgacaacggaagtatcccacaccagattcacctgggcgagcttcatgctatcctgcgcagacaggaagatttttatccgttcttgaaagacaatagggagaagattgaaaagatactcacttttcggatcccctactacgtgggccctctggcgcgcgggaactctagattcgcatggatgaccaggaaatccgaggagacaattaccccatggaattttgaagaggtcgttgataagggagccagcgctcaatcgttcatcgaacgtatgacgaactttgacaaaaatttacccaacgagaaggtgctgcctaaacactctctactctatgagtacttcactgtatataatgaactgacaaaggtgaaatacgtcaccgagggtatgcggaagccagcctttctttccggcgaacagaagaaagcaatcgtggatttgctgttcaagactaaccgaaaagttacagtgaagcagctcaaagaggactatttcaagaagattgaatgttttgattcagtcgagataagtggggtggaggacagattcaatgccagcctgggaacctaccatgacttactgaaaatcattaaggataaagactttcttgataacgaagagaatgaagacatcttggaggatattgtactcacgctgaccctattcgaagacagggagatgatcgaggaacgcctgaagacatatgctcacctctttgatgacaaagttatgaagcagctgaagcggagaaggtacactggctggggtcgcctttcccgaaaattgataaacgggatccgggataagcaatctggcaaaaccattctggacttcttaaagagcgatggatttgccaaccgtaatttcatgcagctcatccatgacgattcactgacatttaaagaggacattcagaaggcacaggtgagtggccaaggggactcccttcacgaacacatcgcgaacctggctggaagccccgccataaagaaaggtattttgcagactgtcaaggtggtcgatgagctcgtgaaagttatgggcagacataagccggaaaatatcgtgattgagatggcaagggagaaccagaccacacagaaagggcaaaagaactctcgcgaacggatgaaaagaatcgaggaaggaataaaggagctgggctcacagatcctaaaggagcaccctgtagaaaatacccagctgcagaatgagaaactctacctgtattaccttcaaaacggtagggacatgtatgtcgatcaggaattggacattaatcgactgagtgattacgacgtggatcatatcgttccccagagcttcttaaaggacgattccattgacaacaaagtgctcactcgctctgataagaatcgggggaaatcggacaacgtcccaagcgaggaagtggtaaagaagatgaaaaattattggagacaactgcttaacgccaagctgatcacgcagaggaaatttgacaatctaacaaaggctgagcgtggcggactctccgagctggataaagccggcttcataaagcgccagttggtggaaacccggcagattactaagcacgttgcacaaatcctggactcaagaatgaacaccaaatacgatgagaacgacaagttaatcagggaagtcaaagtgattacactcaagagtaaactggtgtctgattttcgaaaggacttccagttctataaggtccgggagatcaataactaccaccatgctcacgatgcctaccttaatgcggttgtggggaccgccctgattaaaaagtatcctaaattggaaagcgagtttgtgtacggagactataaggtatacgatgtccgcaaaatgatagctaagtccgagcaggaaatcggtaaggcaactgccaaatatttcttttactcaaacattatgaatttctttaagacagagatcacgctcgctaacggcgaaattagaaaaaggcccctgatcgagaccaatggggaaactggagagatagtgtgggacaagggccgggatttcgccacagttcgaaaagtgctaagcatgccacaggtcaacatcgtgaagaaaaccgaggttcaaacaggtgggttttctaaggaatccattctgcccaagagaaatagtgacaaacttatcgcacgcaagaaagattgggaccctaagaaatatggcggattcgacagcccaactgtggcgtactctgtactcgtcgtggccaaggtggagaagggcaaatccaagaaactgaagtcagtcaaagaattgctggggattaccatcatggagaggagtagctttgagaagaacccgatagatttcttagaagctaagggatacaaagaggttaagaaagacctcattatcaagctgcccaaatattcgctttttgaactggagaatggccgtaagcggatgttggcctccgctggtgaactccagaaggggaacgagctggcactaccttctaaatacgtgaatttcctgtatcttgccagccattacgagaagctcaaaggatcaccagaagataacgagcagaagcagctgttcgtagaacaacacaaacattatttggacgagatcattgaacagataagtgagttttccaagagagtgatcttagcagatgccaatctggacaaagtcctctctgcttacaacaagcacagggataagcccattcgcgagcaggcggaaaacatcattcacctgttcacgcttaccaatctgggcgcccctgcagcttttaaatatttcgacacaactatcgatcgaaagagatacaccagcacaaaagaggtgttggacgccactctaatacatcaatccatcaccggtctgtacgaaacgcggattgatctctcacagctgggcggggacaagaggccagccgctaccaaaaaggcaggacaggccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3683 - RNA, 5216 nt, synthetic construct
  misc_feature 1..5216: note = Cas9 variant mRNA product
  source 1..5216: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaacttcaagattctgccaatagccatcgacctcggagttaaaaataccggtgtgtttagcgcgttctaccagaagggcacatcccttgagaggctggataacaagaatgggaaagtatatgaattgtctaaggactcatacactttactgatgaacaatcggacggctcgccgacatcaacgtagaggaattgataggaaacagctagtgaagcggctctttaaactgatctggaccgagcagcttaacctggaatgggacaaggatacacagcaagccattagtttcttgtttaatcgcagaggcttcagctttatcactgacggttattccccggagtacctcaacatagtccccgaacaggtgaaggcaatcctgatggatattttcgacgattataatggggaggacgatctggactcttacctcaaattagccaccgagcaggaatcgaagatctcagagatttataacaaactgatgcagaagatccttgaatttaaattgatgaagctgtgcacagatataaaagacgacaaggttagcaccaagactctaaaagagattacaagttacgagttcgaactcctggctgattaccttgcaaattattccgagtctctgaagacccaaaaatttagctacacggacaagcagggaaacttgaaagaactctcctattaccaccatgataagtataatatccaggagttcctgaagaggcacgccactattaacgaccggatcttagataccctgctcacagacgatcttgacatctggaattttaacttcgaaaaattcgattttgacaagaacgaggagaaactgcagaatcaagaagataaggaccatattcaggctcacttgcaccatttcgtgtttgccgtcaacaaaataaagtcagagatggcgagtggcggccgccaccgaagccagtacttccaagaaatcactaatgtgctagacgagaacaatcatcaggaagggtatctgaagaacttttgtgagaatctccacaacaaaaagtactctaatctgtccgttaaaaaccttgtaaatctgattggaaacttgtcaaatctcgagctgaagcctttaagaaaatacttcaacgataagatccacgcaaaggccgaccattgggatgaacagaaatttaccgagacatattgccactggatactgggtgaatggagggtgggcgtcaaggaccaggataaaaaggacggggctaaatacagctataaggatctatgtaatgagctcaaacaaaaggtgaccaaggccggactggtggacttccttttggaactggatccatgccggacgattcccccttacctcgacaacaacaatcgtaaaccacccaagtgtcagagtctgatccttaaccctaaatttctggataatcagtatccaaactggcagcaatacttgcaggagctcaagaaactgcagtctatccagaattatttagactccttcgagactgatctgaaggtcctaaagagctcgaaagaccaaccgtactttgttgaatacaagtcttccaaccagcagattgcatcaggccagcgcgactataaagatctcgacgctagaatcctgcaattcatttttgatagggtgaaggccagtgacgagcttttgctgaatgaaatatacttccaggcgaaaaagctcaagcagaaagccagctccgagctggagaagttagaatctagcaaaaagctggatgaggtaatcgcaaactcacaacttagtcagattttgaaatcccagcatacaaatggtatcttcgaacaggggacctttctccacctggtgtgcaagtattacaagcaacggcagcgagctcgcgacagcagactatatatcatgcccgagtacaggtatgataaaaagctgcataaatacaacaatactggacggttcgacgatgacaaccagctcctgacatactgtaatcacaagcctcgccagaaaagatatcaacttttgaacgatctggccggcgtcttacaggtgtctccaaattttctcaaggacaaaattggctcagatgacgacctgttcataagtaagtggcttgttgaacacatcagggggtttaagaaagcatgcgaggatagcctgaagattcagaaagacaaccgtggattgctcaaccataagatcaatattgcccggaacaccaaaggtaagtgtgagaaggaaatcttcaatctgatatgcaaaatcgagggctccgaagataagaaagggaactacaagcacggactagcatatgagctgggcgtgctcctgtttggtgaacccaatgaggcctctaaacctgagttcgaccgaaagattaagaaatttaactcgatctacagcttcgctcagattcaacagatcgcgtttgcagaaagaaaggggaatgccaacacgtgtgctgtctgctccgccgataatgcacataggatgcagcaaataaaaattaccgagccagtggaagacaacaaggataaaatcattctttcagccaaggctcagcgcttgcccgccatcccgacacggatagtagacggcgcagttaagaaaatggcgactatcctggctaagaatattgtggatgacaactggcagaatatcaaacaggtcttaagtgccaagcaccaactccacattcctatcataaccgagtctaacgcattcgaatttgagcccgccctggctgatgtgaaaggaaagagccttaaggacagaaggaaaaaggccctggagcgcatttccccagaaaatatcttcaaagacaagaacaaccgaatcaaagagttcgcaaagggcatttcagcttatagcggggccaatctaacagatggagactttgatggtgcgaaagaagaactcgaccatatcattcctcggtctcacaagaagtacggcactctgaacgatgaggccaatttgatatgcgtcacccgtggggacaacaaaaataagggaaacagaatcttctgtctgagggatttagctgacaattataaactcaagcagtttgaaacaaccgatgacctggagattgagaaaaagatcgcagatactatttgggacgccaacaagaaagatttcaagtttggcaattaccgctccttcatcaaccttacgccccaggagcagaaggcttttcggcatgccctgttcttggcagacgaaaatccaataaaacaagcggtgatcagagccattaacaataggaaccgaacatttgttaatggtacccagcgctacttcgctgaggtgctcgccaacaatatctatctgcgggctaaaaaggagaacctaaacactgacaagattagttttgattacttcgggatccccaccataggcaatggaagaggcattgctgaaatcaggcagctgtatgagaaagtagacagcgatatccaggcctacgcaaagggggacaaacctcaagcctcttattcccaccttattgatgctatgctcgcgttctgcatagccgcagacgaacatcgtaacgatggatcaatcggtctggagattgacaagaattacagtttgtatccactggataaaaacacaggcgaagtctttaccaaggacatcttcagccagattaagatcactgataatgagttttcggacaaaaagttagtgcgcaaaaaggctatagaggggttcaacacacaccggcagatgacgagagatggaatctacgccgaaaattacctcccgattctgatccacaaagagcttaacgaagttaggaagggctatacctggaaaaattccgaggaaattaagatctttaagggtaaaaagtacgacatacagcaactgaacaatttggtgtattgtctcaaattcgtcgacaagcccatttctatcgatatccagattagcactctggaggagctacgaaacatcctgacaaccaataacatagccgctacagcagaatactattacattaatcttaaaactcagaagctccatgagtattacatcgaaaactacaacaccgccctggggtataagaaatactcaaaggagatggagtttttgcggagtttagcgtatcgctccgaaagagtgaaaattaagtctatcgacgatgtaaaacaagtgctggacaaggatagcaatttcataattggcaagatcacgctcccttttaaaaaggagtggcagaggctgtaccgggaatggcagaacaccacaatcaaagacgattatgagttccttaagtcctttttcaatgttaaatcaattactaagctgcacaagaaagtccgaaaggactttagcttgccaatcagtaccaacgaaggaaaattcctagtgaagagaaaaacatgggataataacttcatttaccagatactgaatgactctgattcccgcgctgacggcactaagccctttatccctgccttcgacattagcaaaaacgagatcgtggaggcaatcattgattcgtttacctcaaagaatatattctggctcccaaagaacatcgaactgcaaaaagtcgacaataagaacatttttgccatcgatacgtctaaatggttcgaggttgaaacacccagtgaccttagggatattgggatcgctaccatacagtataagatcgacaataactcccgtccgaaagtgcgggtgaagttagattacgtaattgacgatgacagcaagatcaattactttatgaaccattctctgctcaaaagcagatatcctgataaggtcttggagattctgaaacagtccactatcatagagttcgaatcaagtggatttaacaagacaattaaagagatgctcggcatgaagctggcaggtatctacaatgaaaccagcaacaataagaggccagccgcgactaaaaaggctgggcaggccaaaaagaaaaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3684 - RNA, 3488 nt, synthetic construct
  misc_feature 1..3488: note = Cas9 variant mRNA product
  source 1..3488: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaagaggaactacattctgggactcgacataggtatcacatcagttggctatgggattatcgattacgagacacgggacgtgattgatgccggagtacgccttttcaaagaagcgaatgtggagaacaatgaaggccgacgttccaagagaggtgctaggcggctgaagcgcagaaggcggcatcgcatccagcgagtcaaaaagttgttatttgactataacctgctaactgatcactctgagctctcagggataaatccatacgaagccagagtgaaaggactgagtcaaaaacttagcgaggaggagttctccgcagccctgttgcatctcgctaaaaggcggggcgttcacaacgtgaatgaagtcgaagaggacacgggcaacgagctgtctaccaaggaacagatctcgcgtaattcaaaggcactggaggaaaaatatgtggccgagctccagttagaacgcctgaagaaagatggggaggtaagaggaagcattaacaggtttaagacaagtgactacgttaaagaggctaagcagcttttgaaagtgcaaaaggcctatcatcagctggatcagtccttcatcgacacttacattgatctactcgaaacccggcgaacatactatgagggtccgggcgaagggtctccctttggatggaaggacatcaaagagtggtacgaaatgctgatgggccactgcacctatttccctgaggagcttcgcagcgtcaagtacgcgtataatgcagatctgtacaacgccttgaatgacctcaacaatctggtgataactagagacgaaaacgagaaattagaatattacgagaagtttcagattatcgaaaacgtgttcaaacaaaagaagaaaccaacactgaagcagattgctaaagagatcctcgtcaatgaggaagatatcaagggttacagggttacctccacggggaaacccgagtttactaaccttaaggtgtatcacgacattaaggatataaccgcccggaaagaaatcattgagaatgcagagctgttggaccagatcgctaagatactaacaatttaccagtcaagtgaagatatccaagaggaactgactaacctcaatagcgagctgacccaggaagagatcgagcagatttctaaccttaaaggatatacaggcacccataatctgtccttgaaggccatcaacctcattctggacgaattatggcacacgaatgataaccaaatagcgatcttcaatcgcctgaaacttgtacctaagaaggtggacctctcacagcagaaagagattccaactacactggtcgatgactttatccttagccccgtggttaagagaagtttcatccagtctattaaagtgataaacgccatcattaagaaatacggcttgcctaatgatatcattatcgaactggcaagggagaagaactccaaagacgctcaaaagatgataaatgaaatgcagaagcgtaaccggcagaccaacgagcgaatcgaggaaattatcagaactacagggaaagagaatgccaagtatctcattgaaaagatcaagctgcatgacatgcaggagggaaaatgtctttacagcctggaagctataccattggaggatctcctgaacaatccgtttaactatgaggtcgaccacattatccccaggtcggtgtctttcgataattccttcaacaataaggtattagttaagcaagaagagaactcaaagaagggtaatcgcaccccttttcagtacctgagtagctccgactctaaaattagctacgaaacgttcaagaaacacatcctaaacctcgccaagggcaaggggcggatatcaaaaaccaagaaagagtatctgcttgaggaaagagatatcaataggtttagtgtgcagaaggacttcattaaccgcaatttggtcgatacacgatacgcaactcggggactgatgaacctcctgcgttcctattttagagtgaataacttagacgtcaaagtgaaaagcatcaacggcggtttcacctcttttctgaggcgcaagtggaaattcaagaaagagcggaataaggggtacaaacatcacgccgaagatgctcttattatcgcgaacgcagactttatattcaaggagtggaaaaagttggataaggccaaaaaggttatggaaaatcagatgtttgaggagaaacaagctgaatcaatgccagagattgaaacagagcaggaatataaggagatcttcatcactccccatcagattaaacacatcaaggactttaaggattacaaatatagtcatagagtggacaagaaacctaacagggagctcattaatgacaccctgtacagcacacgaaaggatgacaaaggcaacaccctaatagtaaataacctgaatggactctacgataaggacaacgataagctgaaaaagctaatcaataaatccccagaaaagttgctgatgtatcaccacgacccccagacttaccaaaaattaaagctcattatggagcagtatggcgatgaaaagaacccgctgtacaaatattacgaggaaacggggaattatcttacaaagtactctaaaaaggacaacggacctgtcatcaaaaagattaagtactatggtaataaactgaacgcccatttggatatcaccgacgattaccccaactcgcgcaataaggtggttaaactcagcctgaagccatatcggttcgacgtgtacctagataacggcgtctataaattcgtgactgtaaagaatctggacgtgatcaaaaaggagaactactatgaggttaattccaagtgctacgaagaggccaaaaagctcaaaaagatatcaaaccaggcagaatttattgctagtttctacaataacgacctgatcaaaattaatggggagctttatagagtcatcggagtgaacaatgatttgctgaacaggatagaggtgaatatgattgacatcacctaccgtgaatatttagagaacatgaatgataagcgccctccccggatcattaagacaatagcctctaaaacccaaagcatcaagaaatactccactgacattctcggcaacctgtatgaagtcaagagcaaaaagcacccacagatcattaagaaaggtaagagacccgcagcgaccaaaaaggctgggcaggccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3685 - RNA, 4556 nt, synthetic construct
  misc_feature 1..4556: note = Cas9 variant mRNA product
  source 1..4556: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcactgttcaacaagtgcattataatcagcattaatctcgacttttccaacaaagagaagtgtatgaccaagccatactctatcggacttgatattggtacaaattcagttggctgggccgtgatcactgacaactataaagtaccgagtaagaaaatgaaggtgctggggaatacgagcaaaaagtacataaagaaaaacttgttaggagtcctgctattcgattccggcatcaccgcggaaggtaggcggctcaagcgcacagctcgacgtagatatactaggcggcgcaataggattctgtaccttcaggagatcttttctaccgaaatggccacactggacgatgcattctttcaaagattggacgattcgttcctcgtgcccgacgataaacgggactcaaagtatcctatttttgggaacctggttgaggaaaaagtgtaccatgatgagttcccaaccatctatcatctgcgcaagtacctcgccgacagcactaaaaaggctgatttacgactggtctaccttgcattggcccacatgataaagtatagaggacactttctgattgagggcgagttcaatagtaaaaacaatgacatccagaagaactttcaggacttcctagatacatacaatgctatttttgagtccgacctctctctggaaaacagcaaacagcttgaggagatcgtgaaggataaaatctccaagctggaaaagaaagacaggattttgaaactcttccccggcgagaaaaattcagggatattcagtgaatttctgaagttaatcgtaggaaaccaagccgatttccggaaatgctttaacctggacgagaaggcgagcctccatttctctaaggaatcctatgatgaggaccttgagaccctgttgggttacattggcgatgactattcagatgtttttctaaaagcaaagaaactgtacgacgccatcctcctgagcgggttccttacggtgactgacaatgaaaccgaggctcctctgagttctgccatgataaagcgttataacgaacacaaagaggatttggcactcctgaaggaatacattcgcaatatctccttaaagacatacaacgaggtctttaaagacgatactaagaatggatatgctggctacatcgacggtaaaaccaaccaggaggatttctatgtgtacctgaagaatctactcgccgaatttgagggggcggactatttcctggaaaagattgatagagaggactttcttaggaagcagcggacattcgataacggaagcatcccataccagattcacttgcaagaaatgcgagccatactggacaaacaggcaaagttttatcccttcctcgctaagaataaagagcgcatcgagaagattctgaccttcagaatcccttactacgtgggcccacttgccaggggcaactcggattttgcttggtctatccggaaacgcaatgaaaagattacgccgtggaacttcgaggacgtcatagataaagaatcctcagccgaggcatttatcaatagaatgacaagtttcgacctgtatttgcccgaggaaaaggttctccctaagcatagcctgttatacgagacttttaacgtgtataatgaactgaccaaagtaaggttcattgccgagtccatgcgtgactaccagtttctagattctaagcagaaaaaggacatcgtgcggctctatttcaaagataagcgaaaggtcactgacaaagatattatcgaatacctgcacgctatatatgggtacgacggaatcgagcttaagggtattgagaaacaatttaacagctcattgagtacataccatgatctgctcaacatcattaatgacaaggagttcctggatgactccagcaacgaagcgatcatagaagagattatccacaccttaacgatttttgaagatagagagatgatcaaacagaggctgtctaagttcgagaatatatttgacaagtcagtgcttaaaaagttgagtcgccggcactataccggctgggggaaactcagcgcaaagctgatcaacggaattagagatgaaaaatccggcaatacaatcctagactacctgattgacgatggtatctctaacaggaatttcatgcagctcatacatgacgatgccctgtcgttcaagaaaaagattcaaaaggctcagatcatcggggacgaggataaaggcaacattaaggaagttgtgaaaagccttccaggatcccccgccatcaagaaaggcattttgcagtcaataaagatcgtcgacgagctggtgaaggtaatgggagggcgcaaacctgaaagtattgttgtggagatggcacgagagaatcagtatactaaccaaggtaagtctaatagccagcagcggttaaaacgtctcgaaaagtccctgaaagagcttggctcaaagatcctgaaggaaaacattccagccaaattgagcaagatcgataataacgctctccagaatgacagactgtacctatattacctgcaaaacgggaaagatatgtataccggagacgatctcgacatagacaggctgtctaactacgatatcgaccacattatcccccaggcctttcttaaggataattccattgacaacaaagtcttggtgagtagcgcatctaatcgcggcaagtccgatgacttcccgtcactggaggtcgtgaagaaacggaagacattttggtaccagttactcaaaagtaagctgatcagccagagaaaattcgataaccttactaaggcggagaggggtgggctgctacctgaagacaaggctggctttatacaacgacagctcgttgagacccgccagattacaaaacatgtggcccggctgttggatgaaaagttcaataacaaaaaggacgagaataacagagcagtaaggaccgtcaaaatcatcactctgaagtcgacgttagtgtcccagtttcgtaaagatttcgaactctataaggttcgcgagattaatgactttcaccatgcccacgatgcttacctgaacgccgtgatagcatctgcccttctgaagaaatatcccaagttggagccagagttcgtctacggagactatcctaaatacaatagctttcgggaaagaaagtcagctacagaaaaagtgtatttctacagtaacatcatgaatattttcaagaagtccatctctctcgcggacggcagggtaattgagcgacccctgatcgaagtgaacgaggagaccggggaaagcgtttggaataaagagtccgatctagccactgtccggcgcgtgctgtcatacccacaagtgaacgtcgttaagaaagtggaagaacagaaccacggacttgacagaggtaagcccaaaggcctctttaatgctaacctgagcagtaagcctaagccaaattctaacgaaaatttggtgggggcaaaagagtatctggatccgaagaaatacggaggctatgccggtatatccaacagcttcgctgtattagtcaaggggaccatcgagaaaggcgccaagaagaaaattacaaatgtgctcgaatttcagggaatctcgattctggacaggatcaactaccggaaggataaacttaatttcctgttggagaagggctataaagacatagaactcattatcgagctgcccaagtactcactatttgagctgtctgatgggagtcgaagaatgcttgcatccatcctcagcaccaacaataaacgcggagaaattcataagggcaaccaaatcttcctgtctcagaagtttgttaaattgttatatcacgcgaagaggataagcaatactattaacgagaatcatcgtaaatacgtggaaaaccacaagaaagagttcgaggaactgttttactatatcctcgagttcaatgaaaactacgtcggtgccaagaagaacgggaaactgcttaattccgcttttcagtcatggcagaaccacagtattgacgagctgtgtagctctttcatcggacctacaggctccgaacggaagggtttgtttgagctaacgtcaagaggcagtgccgcagatttcgagttcctgggggtgaaaataccaaggtatcgcgactacacccccagctccctcctgaaggatgctactcttattcatcaatctgttacaggattatatgaaacccgaatcgacctggccaaactcggcgaggggaagagacctgcagccacaaagaaagctggacaggcgaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3686 - RNA, 3632 nt, synthetic construct
  misc_feature 1..3632: note = Cas9 variant mRNA product
  source 1..3632: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcatggtacgccagcctgatgtccgcgcatcacctcagggttggaattgacgtgggtacccattctgtaggccttgctacactgcgggtggatgaccacgggactccaatagagttgttatcagccctgagtcatatccacgatagcggagtcggcaaggaaggtaaaaaggaccacgatacgcgcaagaaactatccgggattgcacgacgtgccagaaggctcctgcatcaccggcgcacccagcttcaacagctggacgaggtgttgagagatctcggattcccgatccccacacctggcgaatttctggacctgaacgagcagactgatccatatagggtttggcgggtgcgcgctcgactcgtcgaagagaagttacccgaggaactgagaggccctgcaatttctatggccgtgaggcatatcgctcggcaccgtgggtggcgcaatccatactcgaaagtagagtcacttttgagccccgccgaagagagtcctttcatgaaggcgctgagagagaggatactagcaaccacaggagaagttctcgacgatggtatcaccccaggccaggccatggctcaagtggccctgactcacaacatttccatgcgggggccggagggaatccttggcaaactgcatcagtctgacaatgcaaacgaaattcgaaagatctgcgctcgccagggtgtcagccccgatgtgtgtaagcagttgctcagagccgtgtttaaagcggactcccctagggggtcagccgtcagtcgggttgcaccagaccccctgcctggacaaggcagcttccgcagagctccaaagtgcgatcccgagtttcagaggttccgtataatttctatcgtggccaatttacggatttccgaaacaaaaggcgagaaccgaccgctgaccgctgacgagagaaggcacgtagtgacgtttctcactgaagattcacaggccgaccttacctgggtcgatgtggcagagaagctgggggttcatcgccgggacttgagaggaacagccgtgcacactgatgacggtgaaaggagcgctgcgcgccctcccatcgatgcaaccgaccgaatcatgcggcagacaaaaattagttctctaaagacctggtgggaggaagccgattccgagcaacgtggcgctatgataagatatctgtacgaggacccaacggacagcgaatgtgccgagatcattgcagaactccctgaggaagatcaggccaaactggactcgcttcatctgcccgctgggagggccgcatattctcgcgagtccttgactgcgctctcagatcacatgctggctacaaccgacgatttacacgaggcccggaagagactgttcggagtcgacgatagttgggcaccacccgccgaagctatcaatgcccctgtgggcaacccaagcgtagacaggactctaaagatagttggtcgatacctctccgcagtggagtctatgtgggggacaccggaagtcattcatgtggagcacgtccgcgatggctttaccagcgagcggatggctgacgaaagagataaagccaataggcgtcgctataacgacaatcaggaggcgatgaagaaaatccaacgggattacggaaaggaaggctacatctcaagaggggacattgtgaggctggacgcccttgagttgcagggatgcgcttgtctgtattgcggtacgaccatcggctaccatacatgtcagctcgatcacattgttccccaggcagggcctggaagtaacaatcgacggggcaacctggtggccgtatgcgaacgctgtaatagatccaaaagcaacactccattcgctgtctgggcccaaaagtgcggtataccccacgtgggggttaaggaggcaatcggcagggtgcggggatggcgaaaacagacccctaacacatcttcagaggaccttactagactgaagaaagaagtcattgcgcgcttgaggcgtacccaggaggatccagaaatcgacgagcggagtatggaaagcgtggcctggatggctaatgagctccatcacagaatcgccgcagcttatcccgagacaaccgtaatggtgtacaggggctccattactgccgcagcccgcaaggctgcggggatagattctcgaatcaacctgattggagaaaaaggtagaaaggaccggatcgataggcgccatcacgccgttgacgcatcggtcgtggctttaatggaggccagcgtggccaagacgctggctgaacgttcctcactaagaggcgagcagcggctcacagggaaagaacaaacctggaagcagtatactggaagtaccgtcggcgcaagggagcattttgagatgtggcgcggtcacatgctgcaccttacagaattgttcaatgagcgactggccgaagataaagtttacgtgacccagaacattagactccggctgtctgacgggaatgcgcatactgtgaacccgagcaagttagtatcccacaggctgggcgatggacttacagtccagcaaatcgaccgcgcttgtacgcctgccttgtggtgcgcactcaccagagagaaagattttgacgagaagaatggcctgccagccagggaagaccgggctatacgtgtgcatgggcacgagatcaagtcaagcgattatattcaggttttctctaaacgcaagaaaactgactccgatcgagacgaaacacccttcggagcaatcgccgtgagaggcggttttgtcgagattgggcctagtatccatcacgcgaggatataccgggtggaaggaaagaaacccgtttacgctatgctacgcgtgttcacccacgatctgctcagccagagacatggcgacctgttttctgccgtaattccacctcagtccatctcaatgaggtgcgcagagcccaaacttcggaaagccattacaactggtaacgctacctatttgggctgggtcgtggtgggggatgagctggaaatcaatgtcgacagtttcacgaagtacgccataggacgatttttagaggatttcccaaacaccacaagatggcgcatctgtggctatgacactaatagcaagctcaccctgaaaccgattgttcttgcagctgaagggctggagaacccttcgtccgccgtgaatgaaatcgtagagttgaagggatggagggtggcgattaacgtcctcacaaaagtgcaccccactgttgtgcggcgtgatgccctgggcagaccaaggtactctagccgctcaaatctacccaccagttggacgatcgagaagcggcctgcagctacaaagaaggccggtcaagctaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3687 - RNA, 4493 nt, synthetic construct
  misc_feature 1..4493: note = Cas9 variant mRNA product
  source 1..4493: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaccaagccatacagcattggactggacataggtacaaactccgttggctgggccgtgactacggataattataaagtaccgtctaagaagatgaaagtgctcgggaacacctcaaagaaatacatcaagaaaaatcttctgggagtcttgttattcgacagtggcattacagcggagggtaggcggctgaagcgcactgctcgacgtagatataccaggcggcgcaacagaatcctatacctccaggaaatttttagcacagagatggccaccctggatgacgcattctttcaaaggcttgatgactccttcctggtgcccgatgacaagcgggattctaaatatcctatctttgggaatttggttgaagagaaggcctaccatgacgagttcccaactatatatcacctccgcaaatacctggctgattcgacaaagaaagcagacctgcgactcgtgtacttagccctggctcatatgatcaagtatagaggacactttcttattgagggcgagttcaactcaaagaataacgatatccagaagaattttcaggacttcttggacacctacaacgccatttttgaaagcgatctgagtctagaaaattccaagcagctcgaagagatcgtcaaagacaagatatctaaactggagaagaaagataggattcttaagctgttccccggcgaaaagaacagcgggatcttttccgagttcttgaaactcattgtgggaaatcaagcggacttccggaagtgctttaacctggatgaaaaagcatcattacatttcagtaaggagagctatgacgaagatctggagacgctccttggttacatcggcgacgattattctgacgtatttctgaaagccaagaagttgtacgatgctatcctactgtccgggttcctcactgttaccgacaatgagacagaagcccctctgtcaagcgcaatgattaaacgttataacgagcacaaggaagaccttgctctgttgaaagagtacatacgcaacatcagtctcaagacttacaatgaagtgtttaaagatgacaccaagaacggatatgccggctacattgatggtaagacaaatcaggaggacttctatgtctacctgaaaaagttactggcggagtttgaaggggccgattatttcctagagaaaatcgacagagaagattttctcaggaagcagcggaccttcgacaacggatctataccataccagattcaccttcaagagatgcgagcaatccttgataaacaggctaagttttatcccttcttggccaaaaataaggaacgcatcgagaagattctgacgtttagaatcccttactacgtgggcccactcgctaggggcaactccgacttcgcctggagcattcggaaacgcaatgagaagataactccgtggaacttcgaagatgtgatcgacaaagagtcgtctgcagaagcctttattaatagaatgacatccttcgatctgtatcttcccgaggagaaggtcctgcctaaacattcattgctctacgaaacctttaacgtttataatgagctgactaaggtgaggttcatcgctgaaagtatgcgtgactaccagtttttagacagcaagcagaaaaaggatatcgtacggctgtatttcaaagacaagcgaaaagtgacagataaggacattatagagtacctacacgcgatctatgggtacgatggaattgaactcaagggtatcgagaaacaatttaactcctctctgagcacctaccatgaccttttgaatattatcaacgataaggagttcctggacgattcaagtaatgaagcaataatcgaggaaattatccacacgctcaccatttttgaggacagagaaatgatcaaacagaggctgtccaagttcgagaacatatttgataaaagcgtcttaaagaagctgtctcgccggcactatacaggctgggggaaactttcagccaagttgattaacggaatcagagacgagaaaagtggcaatactattctcgattacctgatcgacgacggtataagcaacaggaatttcatgcagctaatccatgatgacgctctgtcctttaagaaaaagattcaaaaagcccagatcattggggatgaagacaagggcaacatcaaggaggtggttaaatctctcccaggatcgcccgcaataaagaaaggcattctgcagagcatcaagatcgtggatgaacttgtcaaagtgatgggagggcgcaagcctgagtccattgtagttgaaatggcccgagagaatcagtataccaaccaaggtaagtcaaatagtcagcagcggttgaaacgtctggagaagtctttaaaagaactcggcagcaagatcctgaaagagaacattccagctaagctgtccaagatagacaataacgccctgcagaatgatagattgtacctctattacctgcaaaacgggaaagacatgtatacaggagatgacctagatatcgacaggctgtcaaattacgacattgatcacatcattccccaggcattcctcaaggacaacagcatcgataataaagtgctggtctcttccgcgagtaaccgcggcaagagcgacgatgtgccgtctcttgaagtcgtgaaaaagcggaagactttctggtaccagttgctgaaatccaagttaatatcacagagaaaatttgacaacctcaccaaggctgagaggggtgggctgagtcctgaggataaagccggcttcatccaacgacagcttgttgaaacacgccagattaccaagcatgtggcacggctgctagacgagaagtttaataacaaaaaggatgaaaataacagagccgtaaggactgtcaaaatcattacgctcaagagcacactggtgtcgcagttccgtaaagactttgagttgtataaggttcgcgaaatcaatgatttccaccatgctcacgacgcctacctgaacgcagtggtcgcttccgccttactcaaaaagtatcccaagctggagccagagtttgtgtacggagattatcctaaatacaattctttccgggaaagaaagagcgcgaccgagaaagtatatttttactcaaacataatgaatattttcaagaaaagtatctcccttgccgacggcagggtgatcgaacgacccctgattgaggttaacgaagagactggggagtctgtctggaataaggaaagcgacttggctaccgtgcggcgcgtgctctcctacccacaagtcaacgttgtgaagaaagtggaggaacagaatcacggactggatagaggtaagcccaaaggcctatttaacgcaaatctgtcaagcaagcctaaaccaaacagtaacgagaatcttgtaggggccaaggaatatctcgacccgaagaaatacggaggctatgctggtatatctaactccttcacagtcctggtgaaggggaccatcgagaaaggcgccaagaaaaagattactaatgttttggagttccagggaatcagcattctggataggatcaactaccggaaggacaaattaaattttctcctggaaaagggctataaagatatagagcttatcattgaactgcccaagtactcgttgttcgagctctcagacgggtctcgaagaatgctggcaagtatcctatccacaaacaataaacgcggagagattcataagggcaaccaaatctttctgagccagaaattcgtgaaacttctctatcacgcgaagaggatatctaatacgattaacgaaaatcatcgtaaatacgtcgagaaccacaagaaagaatttgaggaactgttctactatatcttggagtttaatgagaactacgtgggtgccaagaaaaatgggaagttactgaacagcgctttccagtcctggcagaatcactcaatcgatgaactctgtagtagctttattggacctaccggctctgagcggaagggtctgttcgaacttacttccagaggctcagccgcagactttgagttcctgggggttaaaatcccaaggtatcgcgattacacacccagtagcttgctaaaggacgctaccctgatacatcaatccgtgacaggactctatgaaactcgaattgatctggccaaacttggcgaggggaagagacctgcagccaccaaaaaggctggacaggcgaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3688 - RNA, 3575 nt, synthetic construct
  misc_feature 1..3575: note = Cas9 variant mRNA product
  source 1..3575: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagccgcgttcaagccaaacagcattaattacatactgggactcgacatcggtattgcttccgttggctgggccatggtggagatcgatgaagaggaaaacccgattaggcttatcgacctgggggtacgggtgtttgagcgcgcagaagtccccaaaaccggagattctttggccatggctcgacgtttagcaagatcagtgaggcggctgacacgcagaagggcccatcggctactccgcactcgaagactgcttaagagggagggcgttctgcaggctgccaatttcgacgagaacggtttgataaagagtctccctaatacgccatggcaactgcgggcggcagccctggatcgtaaactcacccccttagaatggagcgctgtgctgcttcacttgatcaagcatcgcgggtatctgtcccagaggaaaaacgagggagaaacagccgacaaggagctaggcgcactcctgaaaggcgtcgctgggaatgcccacgcgcttcagactggagattttaggacccctgccgagctggcattgaacaagttcgaaaaggagtctggtcatattcggaatcagcgatcggactactcacacacatttagccgcaaagatctccaagctgaactgatcttactgttcgagaagcagaaagaatttggcaacccacacgtgagtgggggactcaaggagggcattgagacccttctgatgactcagagacccgccttgtccggtgacgctgtacagaaaatgctagggcattgcacattcgaacctgccgagccaaaggcagccaaaaatacctatacggctgaaaggtttatctggctgactaagctcaacaatctgcggatacttgagcaaggatctgaacgcccgctgaccgatacagagagagcgactttgatggacgagccctacagaaagagcaaactcacctatgcacaggcccgtaagctgttaggcctggaagatacagctttctttaaaggcctacggtacgggaaggacaacgccgaggcatccaccctcatggaaatgaaagcctatcacgctatttcacgagccctggagaaggaaggacttaaggacaaaaagagtcctttgaatctgagcccagagctccaggatgagatcggtacggcattctctctgtttaaaactgacgaagatattacaggcagacttaaggacaggatccagcccgagatcctggaagcgttgctcaaacatatttccttcgataagttcgttcaaatatcactgaaggctttacgccggatcgtgcctctgatggagcaggggaaaagatacgacgaggcctgtgcagaaatttacggagatcactatggcaagaaaaacaccgaggaaaagatctacctaccacccataccggccgacgagattaggaaccctgtcgtgctccgcgctctgagccaggcccgaaaagtgatcaatggtgtcgttcggcgttatgggagtcccgcaagaatccacattgaaactgctagggaggtgggcaagtcttttaaggatcgcaaagagatcgaaaagcggcaagaggaaaacagaaaagacagggagaaggccgcggccaaattccgagaatactttccaaatttcgtaggagagcctaagtccaaagatattcttaagttgcgcctgtatgagcagcagcatggcaagtgcctctacagcgggaaagaaataaacctgggacggttaaatgagaagggttatgtggaaatcgaccacgctctgcccttttcgagaacatgggacgattctttcaacaataaagtccttgtgttgggctccgagaaccagaataaggggaaccaaaccccatacgaatactttaatggaaaagacaactcaagggagtggcaggagttcaaggcacgtgttgaaacgagtcgctttccccggagcaagaaacagaggattctcctgcagaagttcgatgaggacggctttaaagaaagaaatctaaacgatacccgatatgtgaatcggttcctgtgtcaatttgtcgccgaccgcatgagactcacaggtaaggggaaaaagagggtgttcgcttccaacggccagatcactaacctgcttcggggattctggggcttgcgaaaggtaagagccgagaatgatcgccatcacgcactggacgcggttgtggtcgcctgctctaccgtggctatgcagcagaaaatcacaaggtttgtccgttacaaggagatgaacgccttcgatgggaaaactattgacaaggaaaccggagaggtgttacatcagaaaacacactttcctcagccatgggagttctttgcacaggaagttatgatacgggtgttcggtaagccggatggcaagcccgaatttgaggaggctgacaccctcgaaaaactgagaactcttctggccgagaagttgagctcaaggcctgaagcagtacacgagtatgtcacgccactcttcgtgagtcgcgcccccaatcgaaaaatgtccgggcagggacatatggaaacagttaagagcgctaaaagactggatgagggcgtgtctgtcctacgggtgcctctgacccaactcaagctgaaagaccttgagaagatggtaaacagggaacgcgagccaaagttgtacgaagcgctgaaagcccgtttagaggcacacaaggacgatcccgctaaagcctttgccgaaccgttctataagtacgacaaagctggtaatagaactcaacaggtgaaggcagttcgggtcgagcaagtgcagaagaccggggtgtgggtcaggaaccataatggcatcgccgataacgcgacaatggttcgcgtggacgtgtttgagaaaggagataagtattacctcgtacctatttactcatggcaggtcgctaaaggcatcctgccagaccgagccgtggttcaggggaaggatgaagaggactggcaacttattgatgacagtttcaattttaaattcagcctgcaccccaacgatctagtggaagtcatcaccaagaaggcaagaatgttcggatattttgcctcctgtcaccggggcactggtaatataaacatcaggattcatgacctcgatcacaaaatcgggaagaatggcattctggagggaatcggtgtgaaaacagctttgtctttccagaagtaccagatagacgagctgggcaaagaaattcgcccttgcagattaaagaagaggcccccagttcggaaacgtcctgcagccacgaagaaagcggggcaggctaagaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3689 - RNA, 4331 nt, synthetic construct
  misc_feature 1..4331: note = Cas9 variant mRNA product
  source 1..4331: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaagaaaccatacaccattggactggacataggtacaaacagcgttggctgggccgtgctcactgatcagtatgaccttgtaaagaggaagatgaaaatcgcgggggattccgagaagaaacaaattaagaaaaatttctggggagtgcggctgtttgacgaaggccagacggctgccgatcgccgaatggcacgtaccgccagaaggcggatcgagcgcagaaggaaccggatttcttacttgcagggtatcttcgctgaagagatgtcaaagacagacgcaaactttttctgccgcttaagtgatagcttttatgtcgacaatgaaaagcgaaattccagacatccgttctttgccactatagaggaggaagtggagtaccacaaaaactatcccaccatctaccatctgagggaggagctagttaattcttcggaaaaggctgatctccggctggtgtatcttgccctggcgcacattatcaaataccgtgggaacttcttgattgaaggagcactcgacacacagaatacctcagtcgatggcatctacaagcaatttatacagacttataaccaggtgttcgccagcggcattgaggacgggagtctgaaaaagctggaagataataaagacgtagctaagatcctcgttgagaaggtgacacgcaaagaaaagttagagaggattctgaaactttaccctggagagaagtccgccggtatgtttgcacagttcatctctttgatcgtcggcagcaaagggaactttcaaaagccattcgacctgattgaaaagtccgatatagagtgtgctaaagactcatatgaagaggatctagaaagtctcctggcccttatcggagacgagtacgcggagctgttcgtggccgcaaagaatgcttatagcgccgtggtcttgtcttccattatcaccgttgctgaaacggagactaacgccaaactctcagcaagcatgatagaaaggtttgatacccatgaggaagacctgggcgagttaaaggccttcattaaactgcacctccccaagcactacgaggaaatctttagtaatacagagaagcatggttatgctgggtacatcgatggaaaaactaagcaggcggacttctacaaatatatgaagatgacccttgaaaacattgagggcgcagattactttatcgccaaaattgagaaggaaaacttcctgcggaagcagcgaacatttgacaatggcgctatacctcaccagttgcatctagaggaactggaggccatcctccaccaacaggcaaaatattacccattcctgaaggaaaactatgataaaattaagtctcttgtgacctttcgcatcccctacttcgtagggcctctggccaatggacagtccgagtttgcttggttgacgagaaaagccgacggtgagatcaggccatggaacattgaagagaaggtggacttcggcaaaagcgcagtcgattttatagaaaagatgactaataaggacacatatctcccgaaagagaacgtgctgcccaagcactcgttatgctaccaaaaatacctggtttataatgaactaaccaaggtgcggtacatcaacgatcaggggaaaacttcttatttctccggacaggagaaggagcagattttcaatgacctctttaagcaaaaacgcaaggtcaaaaagaaagatctggaacttttcttgagaaacatgtcacatgtggagagtcctacaatcgaaggcctggaggacagctttaattcctcttacagcacctatcacgatctcctgaaggtaggtattaagcaggaaatccttgacaacccagttaatacggagatgctggagaacatagtgaaaatcttgaccgtcttcgaagataagaggatgattaaagagcagctccagcaattttcagacgtgctggatggggtcgtgttaaagaaactggaacgtcggcattacacaggctggggacgactaagtgcgaagctcctgatgggcatcagagacaagcagtcccaccttactattttggattatctgatgaatgacgacgggctcaacaggaacctgatgcagttaatcaatgatagcaacctgtctttcaaatcaataattgagaaggagcaggttaccacagctgacaaagatatccaaagtattgtggccgaccttgcaggaagccccgccatcaagaaaggtatattgcagtccctcaagatcgtagatgaactggtctctgtgatgggctaccctccacagactattgttgtggagatggctcgcgaaaatcagaccacagggaaaggaaagaacaattcgcggcccagatacaagagcctagagaaagccatcaaggaatttggctcccaaattctgaaagagcatccgaccgacaaccaggagctcaggaataaccgcctgtatctttactatttgcagaatggtaaggatatgtacactgggcaagacctggatatccacaacttatcaaattatgacatagatcacattgtccctcagagtttcatcacggacaactctatcgataatctcgtgctgacaagctccgcaggcaaccgagaaaaaggagacgacgtacccccacttgagattgtgcggaagcgtaaggtcttttgggaaaaactgtaccagggcaatttgatgtcaaagagaaaattcgattatctcaccaaggctgagagagggggactgactgaagccgacaaagcgcgctttatccatcggcagctagttgagaccagacaaattacaaagaacgtggccaacatactgcaccagaggttcaattacgagaaggatgaccatggtaacaccatgaaacaggtgcgaatcgtcactctcaagagcgctctggtttctcagtttcgcaaacaattccagctttacaaggtgcgggatgtgaatgactatcaccacgcacatgatgcctacttgaacggcgtagtcgctaatacactgttaaaagtgtatcctcagctcgaacccgagttcgtttacggggactatcaccagtttgattggttcaaggccaacaaggcaacggcgaaaaagcaattttacaccaatattatgctgttctttgcccagaaagacagaatcattgatgaaaacggagagatcctttgggacaagaaatatctggacactgtgaagaaggtcatgtcctacaggcagatgaatatagtgaaaaagacagaaatccaaaaaggcgagttcagtaaggctaccattaaaccaaagggtaacagctctaaactaatcccccgtaagacaaattgggatcctatgaagtacgggggcctcgactccccaaacatggcctatgcagttgtgattgagtacgctaaaggaaagaataaactggtatttgaaaagaaaatcatacgcgtcactattatggagcggaaggccttcgaaaaggatgagaaagcatttttggaggaacagggctatagacagccgaaggtgctggccaaattacccaagtacaccctctatgagtgtgaagaggggaggcgacggatgctggcttcagcgaacgaagcccagaaaggaaatcaacaggtgcttcctaaccatctggtcacgttgctccaccatgcagctaactgcgaggttagtgacggcaagagcctggattacatcgagtcgaatcgcgaaatgttcgccgagctactggcccacgtgtccgaatttgctaagagatatacccttgcagaggccaacctcaataaaatcaaccagctgttcgaacagaataaggagggtgacattaaagcgatagctcaatctttcgtagatttgatggcctttaacgcaatgggggccccagctagcttcaagtttttcgagacaactatcgaaaggaaacggtacaataacctgaaggagttactcaattcaaccattatctaccagagtattacaggactgtatgaatcccgaaagagacttgacgataaacgccccgcagccactaagaaagcgggccaggctaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3690 - RNA, 4364 nt, synthetic construct
  misc_feature 1..4364: note = Cas9 variant mRNA product
  source 1..4364: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaaagaaaccatacagcattggactggacataggtaccaactccgttggctgggccgtggtaacagatgactataaggtgccggcgaagaaaatgaaggtcctcgggaatactgataaatctcatatcgagaagaaccttctgggagctttgttattcgactcaggcaatacggccgaagataggcggctgaaacgcaccgcacgacgtagatacacaaggcggcgcaaccggattctatatctccaggagatctttagtgaagagatgggtaaggtggacgatagcttctttcacaggctggaagactccttccttgttactgaggataagagaggggagcgccatcccatttttggaaatctggaagaggaagtgaaataccacgagaacttccctaccatctatcatttgcgacaatacctcgccgacaatccagagaaggtcgatctgagactggtgtatctcgctttagcacacataatcaaatttaggggccacttcctgattgaaggcaagtttgacacacggaacaatgatgtacagcgtcttttccaggagtttttggccgtttacgacaacaccttcgaaaattcttcgctgcaggagcaaaacgtgcaggtcgaagagatcctaactgacaaaatttcaaagagcgctaaaaaggatcgcgtgctcaagctgtttcccaatgagaaaagtaacgggagattcgccgagttccttaagctgatcgtgggaaatcaggcggactttaaaaagcatttcgagttggaagagaaagcacctctccagttttccaaggatacatacgaagaggagctggaagtcttactggcccaaataggtgacaactatgctgaactcttcctttctgccaagaaactgtacgatagcattttgctatccggcatcctgaccgttacggacgtggggactaaggcaccactctcagctagtatgattcagaggtataacgaacaccagatggatctggcccagcttaaacaatttatccggcagaagctgagcgacaaatacaatgaggtattctctgatgtgtccaaggacggatatgcgggctacatcgatggtaagaccaaccaggaagccttttataaatacttgaaggggctcctgaataaaattgagggatcaggctacttcttagacaagatagagcgagaagactttctgcgcaaacaaagaacattcgataacggcagcatcccccatcagattcacctacaggagatgagggcaatcatacggcgccaggctgaattttatcctttcctcgccgacaatcaagatagaattgagaagctgcttacttttaggatcccatactatgtcgggccgttggctcgtggaaagagtgacttcgcctggctgtctcggaaatccgcagataagatcaccccctggaacttcgacgagattgtggataaagaaagctcggccgaggcttttatcaatcgaatgacaaactacgacctctatctgcctaatcagaaggttcttccaaaacactctctgttgtacgaaaagttcaccgtgtataacgagctcacgaaagtcaagtacaagactgaacagggtaaaacagcgtttttcgatgcaaatatgaagcaggagatttttgacggcgtgttcaaagtatacagaaaggttaccaaagataagctgatggactttttagagaaggagttcgatgaatttaggatagtggacctgactgggctagacaaagaaaacaaggtcttcaatgcctcctatggaacataccatgatctctgcaaaatcctggacaaggattttcttgacaacagtaaaaatgagaagattttggaagatatcgtgctgaccctcacgctgttcgaggaccgcgagatgatccggaagagattagaaaactattcagatctgcttaccaaagagcaagtcaagaaattggaaaggcgccactacacaggctggggtcgactcagcgctgagctgattcatgggatacggaacaaggaatcccgtaaaactatcctagactatctgattgatgacggcaattctaacagaaattttatgcagctcatcaacgatgacgccctgagcttcaaggaggagattgcaaaggcccaggtgatcggagaaaccgataatcttaaccaggttgtgtcagacatagctggcagtcccgccatcaaaaaggggattttgcaatccctgaaaatcgtagacgagttagtcaagattatgggacaccagcctgaaaatatcgtggttgagatggcaagggagaaccagttcacaaatcagggtcgccggaacagccaacagagactcaaaggcctgactgattctataaaggaatttgggtcacagattcttaaagagcatccagtggaaaatagtcaactgcagaacgacaggttgttcctctactatctgcagaatggacgagatatgtacaccggcgaggaactagacatcgattacctgagccagtatgacattgatcacatcataccccaagcgtttatcaaggacaactccattgataatcgcgtcctcacatcttcgaaggagaaccggggtaaaagcgacgatgtgccgtccaaggacgtagtgagaaaaatgaagtcatactggagtaaactgctttctgctaagttgatcacccagaggaagttcgacaacctgactaaagccgagcgtgggggcttaacggatgacgataaggcaggatttattaaacgccagctcgttgaaacacggcagatcaccaagcacgtcgccagaatactggacgagaggttcaatactgaaaccgatgagaacaataaaaagattcgacaagtgaagatcgtgacacttaaaagcaacctggtctccaattttcggaaggagttcgaactatataaagttcgcgagatcaacgactaccatcacgctcatgatgcctatctcaatgcagtgattggcaaggctctgttgggggtgtaccctcagctggaacccgagtttgtatatggagactacccacacttccacggtcataaagaaaacaaggccaccgcgaagaaatttttctactcaaatatcatgaacttctttaagaaagatgacgtcagaactgataagaatggcgagattatatggaaaaaggacgaacacatcagcaacattaagaaagtgttatcttatcctcaggttaatatcgtgaagaaagtcgaggagcagacagggggattctccaaggaaagtattctccccaaaggcaacagcgataagctgatcccaaggaaaacgaagaagttttactgggacaccaaaaagtatggtgggttcgactctcccatagtggcctactccatccttgttattgctgatatcgagaaaggcaagagtaaaaagctgaagactgtgaaagcattggtaggagtcacaattatggaaaagatgacctttgagcgggaccctgtggccttcctcgagcgaaaaggctatagaaatgtgcaagaagagaacatcataaagctgccaaaatactcactatttaagctggaaaacgggcgcaagaggcttctcgctagcgcccgtgagctgcagaaaggaaatgaaattgtcttgccgaaccatctgggcacattactctatcacgcaaagaatatccataaagttgatgagcccaagcacctggactacgtggataaacacaaggacgagttcaaggaacttctggatgtagtgtcgaacttttccaaaaagtacactttggcggagggtaatctcgagaaaatcaaggaactgtatgcccagaacaatggggaagacctaaaagagctggcttctagcttcattaaccttctcacctttacggccataggagctcctgcaaccttcaagtttttcgataaaaatatcgaccggaagagatacacatcaactaccgagattctgaacgccacattgatccatcaaagtattactggcttatatgaaaccaggatcgatctgaataagctcggtggcgacaaacgcccagcagccacgaagaaagctgggcaggcgaagaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3691 - RNA, 3497 nt, synthetic construct
  misc_feature 1..3497: note = Cas9 variant mRNA product
  source 1..3497: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcacagacaacaaacctgagctacattctcggacttgacctgggtatagcctccgttggctgggcggtggtagagatcaatgaaaacgaggatccaattgggttgatcgacgtgggagtcaggattttcgaacgggctgaggtgccgaagactggcgaatctttagccctgtcacgccgactagcacgtagtacgagaaggctcatccggcgcagagcccataggctgcttctggctaaacggtttttgaagcgcgagggtatactcagcaccatcgatctggagaaggggctgcccaatcaagcatgggaactccgagttgccggattagagagaaggctgtccgctattgaatggggcgccgtgcttttgcacctgatcaaacatcggggctatctatctaagcgtaaaaacgagtcgcagacaaataacaaggagctcggggcgctgctttcaggagtcgcacagaatcaccagctgttgcaaagcgacgattaccgcactcctgccgaactcgctctgaaaaagttcgccaaggaggaaggtcatattagaaaccagaggggcgcatatacccacacatttaatcggttagacctgctcgctgagcttaacctgttgttcgcccagcagcaccaatttgggaatccacattgcaaagaacacatccagcagtacatgaccgagctactgatgtggcagaagcccgcgctcagtggagaggccatactgaaaatgcttggcaagtgtactcatgagaaaaacgagttcaaggcagctaaacacacatattccgccgaacgatttgtgtggctgaccaagttgaataacctccgcattctggaggatggtgctgaaagagccttaaatgaggaggaaaggcaactgctaatcaaccacccttacgagaagtctaaactcacgtatgcacaggtacggaagctgcttgggttgagcgaacaggccattttcaaacatctgcgctactccaaggagaacgctgaatcagcgacttttatggagctcaaagcatggcacgccatcagaaaggctctggagaatcaaggacttaaggacacctggcaggatctggccaaaaagccagacttgctcgatgaaatcggcacagcattcagtctgtacaaaactgacgaggatattcagcagtatttaaccaacaaggttcccaatagcgtgataaacgccctgctagtctctctcaattttgacaaattcatcgaactgtcccttaagtcattgaggaagattctgcctctcatggagcaaggcaaacgttacgaccaggcttgccgggagatctatgggcatcactacggagaagccaaccagaagacaagccagctgttaccagcaataccggcgcaagagattcgaaatcccgtggtgctgagaacccttagtcaggctaggaaagtcatcaacgccatcattcgccagtatggttctcctgcacgggttcatatcgaaacgggcagagagttggggaagtcctttaaagaaaggcgcgagattcagaagcaacaggaggataatcgaactaagcgggaaagcgccgtgcagaaattcaaggaactcttctcggacttttcttccgaaccaaaatcaaaggatatactgaaattccgtctatacgagcagcaacacggaaagtgtctgtatagtggcaaagaaatcaacattcacagactcaatgagaagggttacgtagagatcgaccatgctctgccctttagcaggacatgggatgactccttcaacaataaggtgcttgtcttggcctctgaaaaccagaataaagggaaccagaccccttacgagtggctgcaaggcaagatcaacagcgaacgctggaaaaattttgtggcattagttctcggatcacagtgcagtgctgccaagaaacagcggctgcttactcaggtgattgatgacaacaagttcatagatagaaatctgaacgacacaaggtatatcgcgcgatttttgtccaattacattcaagagaacctcctgctagtcggcaagaataaaaagaacgtgttcaccccaaatgggcagatcacggccctgctccgcagccggtggggactgattaaagctagagaaaacaataacaggcaccatgcacttgatgccatcgtagttgcttgtgccaccccctctatgcagcagaagataacacgttttatccgcttcaaagaggtgcacccgtataagattgagaatcggtacgaaatggtcgaccaagagtcaggtgaaatcattagtcctcactttcccgagccatgggcatatttcagacaggaggtgaacatcagggtctttgacaatcatcctgatactgtgttgaaggaaatgctgcccgaccgaccacaggcgaaccaccagttcgttcaacccttattcgtgagccgggcccctacccgcaaaatgtccggccaggggcatatggagacaataaagtctgctaaaagactcgccgaaggaatttcggtactgaggatcccacttactcagctgaagccgaacctactcgagaatatggtcaacaaagaacgggagcccgcactgtacgctggcttgaaggcccgactggcagagtttaatcaagatcctgccaaggctttcgcgaccccattttataaacagggtgggcaacaggtgaaggccattagagttgaacaggtgcagaaaagcggcgtcttagtgcgcgagaacaatggagtagcagacaacgcttccatcgtgaggacagatgttttcataaagaataacaaatttttcctcgtccccatctacacctggcaagtggccaagggcattctgcctaataaagccatcgtggctcacaagaacgaagacgagtgggaagagatggatgagggggcaaagtttaaattctcactttttccaaatgacctggtcgaattgaagactaaaaaggagtacttctttggatattacattggtctcgatcgtgccacgggcaacatcagtctgaaagaacatgacggggagatatctaagggaaaggatggcgtttatcgggtgggtgtgaaactagcgctgagcttcgaaaagtaccaggtagacgagcttgggaaaaatagacagatttgcaggccccagcagcgccagccggtccgaaagagacctgctgccaccaaaaaggcaggccaagccaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3692 - RNA, 3575 nt, synthetic construct
  misc_feature 1..3575: note = Cas9 variant mRNA product
  source 1..3575: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagccgcgttcaagccaaacccgattaattacatactgggactcgacatcggtattgctagcgttggctgggccatggtggagatcgatgaagacgagaaccccatttgccttatcgatctgggggtaagggtgtttgaacgggcagaggtccctaaaaccggagactccttggccatggctcgccgattagcacgttctgtgagaaggctgacacggcgcagagcccataggctactccgggctcgccgactgcttaagagagaaggcgttctgcaggccgcggatttcgacgagaatggtttgataaagtcactcccaaacactccctggcaactgagggcagccgctctggatcggaaactcacgcctttagagtggagtgccgtgctgcttcacttgatcaagcatcgtgggtatctgagccagcgcaaaaatgaaggagagaccgcagacaaggaactaggcgctctcctgaaaggcgtcgccgataacgcgcacgcccttcagacaggggactttagaactccagcagagctggctttgaataagttcgagaaggaatccggacatattaggaaccagcggggtgattactctcacaccttttcgcgaaaagacctccaagccgagctgatcttactgttcgaaaagcagaaagagtttggcaatccccacgtgtcagggggactcaaggaaggcattgagacacttctgatgacccagcgccctgctttgagcggtgatgccgtacagaaaatgctagggcattgtactttcgagccagcagaaccgaaggccgctaaaaacacatataccgcggagagatttatctggctgacgaagctcaataacctgaggatacttgaacaaggaagtgagcggcccctgactgacaccgaacgcgcaacattgatggacgagccttacagaaagtccaaactcacttatgcccaggctaggaagctgttaggcctggaggataccgccttctttaaaggcctacgttacgggaaggacaatgcagaagcctctacactcatggagatgaaggcttatcacgccattagccgggcactggaaaaggagggacttaaggataaaaagtccccattgaacctgtcacccgaactccaggacgagatcggtaccgcgttcagtctgtttaaaacggatgaggacattactggccgacttaaggatagaatccagcctgaaatcctggaggctttgctcaaacatattagcttcgacaagttcgttcaaatatctctgaaggccttaaggcgcatcgtgccactgatggaacaggggaaacggtacgatgaggcatgcgccgagatttacggagaccactatggcaagaaaaatacagaagagaagatctacctacccccgatacctgctgatgaaattagaaaccccgtcgtgctcagggccctgtcccaggcacgcaaagtgatcaacggtgtcgttcgacggtatgggtcaccagctcgtatccacattgagaccgccagagaagtgggcaagagctttaaggacaggaaagagatcgagaagcgccaagaagagaatcggaaagacagagaaaaggcggccgctaaattcagggagtactttcctaacttcgtaggagaacccaagagtaaagatattcttaagttgcgactgtatgagcagcagcatggcaagtgtctctactctgggaaagagataaatctgggacgcttaaacgaaaagggttatgtggagatcgaccacgcactgccattttcccggacttgggatgacagcttcaataacaaagtccttgtgttgggctcggaaaatcagaacaaggggaatcaaacaccctacgagtactttaacggaaaagataattctagagaatggcaggagttcaaggccagggttgagacctcccgttttcctcgctcaaagaaacagcggattctcctgcagaagttcgacgaagatggctttaaagagagaaacctaaatgacacgaggtatgtgaaccgattcctgtgccaatttgtcgctgatcggatgcgcctcaccggtaaggggaaaaagagagtgttcgccagtaatggccagatcacaaacctgcttaggggattctggggcttgcggaaggtacgagcagaaaacgacagacatcacgcgctggatgccgttgtggtcgcttgtagcactgtggccatgcagcagaaaatcacccgctttgtcaggtacaaggagatgaatgcattcgacgggaaaacaattgataaggagactggagaagtgttacatcagaaaacccactttccacagccgtgggagttctttgctcaggaagttatgatacgtgtgttcggtaagcccgacggcaagcctgagtttgaagaggccgacacaccagagaaactccggaccctgcttgcagaaaagctgtcctctagacccgaggccgtacacgaatatgtcactcctttgttcgtgagcagggctccaaaccgcaaaatgtcagggcagggacatatggagacggttaagagtgcgaaacgactcgatgaaggcgtgtccgtcctgagagtgcccctaacacaactgaagctcaaagacctggagaagatggtaaatcgggagagggaaccgaaactttacgaggccttgaaagcacgcctggaagctcacaaggatgaccctgccaaagcctttgctgagccattctataagtacgataaagcaggtaaccgtacccaacaggtgaaggccgttagagtcgaacaagtgcagaagactggggtgtgggtccggaatcataacggcatcgcggacaatgctaccatggttagggtggatgtgtttgagaaaggagacaagtattacttagtacccatttacagctggcaggtcgccaaaggcatcctccctgatcgcgcagtggttcaggggaaggacgaggaagattggcaactgattgacgattctttcaactttaaattctcacttcaccccaatgacctggtggaggtcatcacaaagaaggcccgaatgttcggatattttgctagttgccacagaggcaccggtaacataaatatccggattcatgacctagatcacaaaatcgggaagaacggcattctcgaaggaatcggtgtgaaaactgcactgagcttccagaagtaccagatagacgagttgggcaaagagattaggccatgtcgcctgaagaagagacctcccgttaggaaacggccagccgcgacaaagaaagctgggcaggccaagaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3693 - RNA, 3581 nt, synthetic construct
  misc_feature 1..3581: note = Cas9 variant mRNA product
  source 1..3581: mol_type = other RNA
gggagagtcccgcagtcggcgtccagcggctctgcttgttcgtgtgtgtgtcgttgcaggccttattcaagcttaccatggcacccaagaaaaagagaaaagtgggcatccacggggtccctgctgcaaagtaccacgttggaattgacgtgggtaccttcagcgtaggcctggccgcgatagaggtggatgacgctgggatgccaatcaaaacactctcccttgtctctcacattcatgattcaggactggacccggatgaaatcaagagtgccgtgactaggttggcaagctccggcattgcccggcgcacgcgacgtttatatagaaggaagcggcgcagactgcagcaactagacaaatttatccagaggcagggttggcccgttatagagctcgaagattactctgaccctctgtatccatggaaggtgcgggctgagcttgcagcctcgtacatcgctgatgaaaaagagcgcggggagaagctgtcagtcgccttgcgacacattgcgagacataggggatggcggaacccctatgcaaaagtgagcagtctctacctgcctgacggcccatccgatgccttcaaggctatccgtgaagagattaagcgcgcctctggccagcccgtacctgaaaccgcaacagttgggcaaatggtgactctgtgcgagctcggaaccttaaaactgagaggtgagggcggggtccttagcgctaggttgcagcagtccgactatgcccgggaaatccaggagatatgtcgaatgcaagaaattggacaggagctgtaccgcaagatcattgatgtggtgtttgcggccgaatcaccaaaaggcagtgcaagctctagagtcggtaaggacccgctacagcccgggaaaaatagggctctcaaggcctccgacgctttccagcggtaccgcatcgccgcactgatcggaaaccttagagttagggtggatggcgagaaacgtattctgtcagtagaggaaaagaatttggtgtttgaccacctcgtcaacctgacacctaagaaagagccagaatgggtgaccatagccgagatcttaggcattgatcgggggcaactgatcggaactgctacaatgaccgacgatggtgaacgagcgggcgcaagaccccctacgcacgacactaataggagcatagttaacagtcgcattgccccactcgtggattggtggaagaccgcttctgcccttgagcagcatgcaatggtcaaagccctgtccaatgctgaggtggacgatttcgacagccccgaaggggccaaggtacaggcatttttcgcggatttggacgacgatgttcacgctaaactagactcgctgcatctcccggtgggacgggccgcatattctgaggatacactggtcagacttactaggcgcatgctgtccgacggcgtggatttgtacaccgcccgactccaagaatttggtatcgagccttcatggacacccccaacccctcggatcggggaacccgtcggcaacccagctgtggaccgtgttctgaagacggtgagtagatggttagagagcgccactaagacatggggagcacccgagagggtaattatcgaacacgtccgcgagggcttcgtgaccgaaaaacgggctagagagatggatggggacatgaggcgacgcgccgcgcggaatgccaagctgtttcaggagatgcaggaaaaactaaacgttcagggaaagccttccagagctgatctctggaggtatcaatctgtgcagcgtcagaattgccagtgtgcatactgcggtagcccaattactttctcaaacagtgagatggaccacatagtcccgcgcgccggccaagggtccacaaatacccgggaaaacctggtggctgtatgtcatagatgcaatcagagcaaaggaaacacgccctttgccatctgggcaaagaacacctctattgagggcgtgtcagttaaggaagcggtcgagaggacacgacactgggtgactgataccggtatgcggagtacagacttcaaaaagttcactaaagccgtggtcgagcgctttcagagagctaccatggatgaagagatcgacgccaggagcatggaatccgttgcatggatggctaatgagcttcggtctcgagtggcccagcatttcgcatcgcacgggacaaccgtgagagtatatcgcggcagcttgactgccgaagctaggcgtgcgtccggaatctcaggcaagctgaaatttttcgacggggtcggaaagagtcggctcgatagaaggcatcacgccattgacgcagctgtgatagcctttacgtctgattacgttgccgagacactggctgtgcgcagcaaccttaagcaatcccaggcacaccgacaggaggcccctcagtggagagagttcaccggtaaagacgcggaacatcgggctgcctggagggtctggtgtcaaaagatggaaaaactgtcagcattgctcactgaggatctgcgcgacgatcgtgtggttgtgatgagcaatgtaagattacggctgggcaacgggtctgcccacaaggaaaccatcggaaaactatccaaggtcaaactcagtagccagctgtctgtgtccgacattgataaggcttcaagtgaggcactttggtgcgccttgacaagggagccaggctttgaccccaaggaaggtctgcctgcgaatccagagcgccatatccgagtgaacgggacccacgtctatgctggcgataatattggactcttccccgttagcgccggctcgatcgcactgagagggggatacgccgaattaggctcctcttttcaccatgctcgggtgtacaaaataactagcggtaagaaaccggccttcgcaatgctgagggtatatacaatcgaccttttgccttaccgcaaccaggatctcttttcagtggagctgaagccacaaacgatgagtatgagacaggctgagaaaaagctaagggacgccctggcgaccgggaatgccgaatatctcggatggctggtcgtggacgatgagcttgttgtggacacttccaagattgcaacagatcaggtcaaagctgtggaagccgagttgggcaccatccggcgttggcgcgttgacggtttcttttctcccagcaagctgcgattaagacctctccagatgtccaaagaaggcattaagaaagagtcagctcccgagctgagcaagatcatagataggccagggtggcttcctgcagtgaacaagctgttcagtgacggaaatgtcacagtagtgcggcgcgattctttgggcagagttaggctcgaatccactgcccatctgcccgtgacctggaaagtccaaaagcggccagccgctacgaaaaaggcggggcaggccaaaaagaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3694 - RNA, 3281 nt, synthetic construct
  misc_feature 1..3281: note = Cas9 variant mRNA product
  source 1..3281: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcagccaggattctggcgttcgacataggaatcagctccattggttgggctttttctgagaacgatgaactcaaggactgcggcgttcggatcttcaccaaagtggagaatccaaagacaggggaatcacttgccctgccgcgccgattggcacgtagtgccagaaagaggttagctcggcgcaaagcaagactgaaccatctaaagcacctcattgccaatgagtttaaactgaactacgaagattatcagagcttcgacgagtcccttgctaaggcctacaaaggatctctgatctcgccctatgagttgaggtttcgggcgctcaatgaactgctgtcaaagcaagatttcgcacgcgtaatactccatatcgccaagcgaagaggctacgacgatattaaaaacagcgacgataaggagaaaggtgctatcttaaaggccattaaacagaatgaagagaagctggcaaactatcagagtgtgggggagtacctttataaagaatactttcagaagttcaaggaaaattccaaagaatttactaacgtcaggaataagaaagagtcttacgaacggtgtatcgctcagagcttcttgaaggacgagctgaaactaatatttaagaagcaacgtgagttcggattttccttctctaaaaagttcgaagaggaagtgctcagtgttgccttttataaacgcgcgctgaaggatttcagccaccttgtgggcaactgctcatttttcacggacgagaaaagagcccctaaaaattccccactggcatttatgttcgtcgctttgaccaggattatcaacctcctgaataacttaaagaacacagaaggcattctgtacactaaagatgacctcaatgcccttctgaacgaggtgttgaagaatgggaccctaacatataaacagaccaagaaactgctcggactgtcagacgattacgagtttaagggtgaaaagggcacttatttcatcgagtttaaaaagtacaaagagttcatcaaggctcttggggagcataacctgagccaggacgatttgaatgaaattgccaaagacataacactcatcaaggatgagattaaactgaagaaggcattagccaaatatgacctgaaccaaaatcagatcgatagtctatctaagctcgagtttaaagaccacctgaacatatccttcaaggctcttaaattggtaactcccctgatgctcgaaggaaagaagtacgatgaggcgtgtaatgaactgaaccttaaagttgcaattaatgaggacaagaaagattttctgcctgccttcaacgagacgtactataaggacgaagtgactaatccagtcgtgttgcgggctatcaaagagtaccgaaaggtgctcaacgccctgttaaagaaatatggcaaggtccacaaaatcaatattgaactggcacgcgaggttggtaagaaccatagccagagagccaaaatcgaaaaggagcagaacgagaattacaaggctaaaaaggacgccgaactagagtgcgaaaaactcgggctgaagattaactcgaaaaatatacttaagttgaggctgttcaaagagcaaaaggaattttgtgcatattctggagagaagatcaaaatttccgatctccaggacgagaagatgctggaaatcgatcacatctacccctattcacggagtttcgacgatagctacatgaacaaagtgttagtatttaccaagcagaatcaagagaaactgaaccagacacctttcgaagcgtttggcaatgactccgctaagtggcagaagattgaggtgcttgccaaaaacttgccaactaagaaacagaagcgcatactcgataaaaattacaaggacaaggaacaaaagaacttcaaggatagaaatctgaacgacaccaggtatatcgcacgtctagtcctgaattacacaaaagattatctcgactttctgccgctttctgatgacgagaacaccaagttgaatgacacgcagaaaggcagcaaggtgcatgttgaggccaagtcagggatgctgaccagtgctttacggcacacatggggattctccgccaaagatcgaaacaaccacctccatcacgcaattgacgctgtgatcattgcctacgcgaataacagcatcgtcaaggccttttctgatttcaaaaaggaacaggagtcaaatagtgctgaactgtatgccaaaaagataagcgagcttgactacaagaacaaaagaaagtttttcgagcccttttccggtttcaggcagaaagtgctggataagatcgacgaaattttcgtatctaaacctgagcgcaagaaaccatcgggcgcattgcatgaagagacctttcggaaggaagaggagttctatcaaagctacgggggaaaggaaggcgttctcaaagctctggagctaggtaagatcagaaaagtgaatgggaagattgtcaaaaacggcgatatgtttagggtggacatcttcaagcacaagaaaactaataagttttacgccgtccccatatatacaatggatttcgcactgaaagtgctccctaacaaggcggttgcccgctccaaaaagggagaaattaaggactggatcctgatggatgagaattacgaattttgcttctcactttataaagacagtttgattctgatccagaccaaggatatgcaggagccagagtttgtgtactataacgctttcacgtctagcaccgtatccttaatagtctcaaaacatgacaataagtttgaaacactcagcaaaaaccagaagatcctgttcaagaatgccaacgagaaagaagtgattgcaaagtctatcggcattcaaaatcttaaagttttcgagaagtacatcgtgtccgctctgggggaagtcactaaagccgagtttcgacagcgggaggacttcaagaaaaagcgtcccgcagccaccaagaaagctggacaggcgaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3695 - RNA, 3692 nt, synthetic construct
  misc_feature 1..3692: note = Cas9 variant mRNA product
  source 1..3692: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaagcgacctggttctcggacttgatattggtataggctccgtgggggtaggaatcctgaacaaggtgaccggcgagattatccataaaaattctaggattttcccagccgcgcaggctgaaaacaatttggtccggcgcacaaaccgacaaggtcgtagattagccaggcggaagaagcaccgcagagtgaggctgaatcggctatttgaggaatcagggctcatcactgacttcacgaaaataagtatcaacctgaatccgtaccagcttcgcgttaagggactgaccgatgagttgagcaacgaagaactctttattgcactgaaaaatatggtgaagcatcgaggcatctcctatctggacgatgcctctgacgatggcaactcgtcagtcggggactacgctcagattgtgaaagagaatagcaagcagctcgaaacaaagactcccggacaaatccagttagagagatatcagacctacggtcagctgaggggcgatttcacagtagaaaaagacgggaagaaacaccggcttataaacgtttttcctaccagtgcatatcgttccgaggccttgcgcattctgcaaactcagcaggagttcaatccacagatcacagatgaatttattaacagatacctagagatcctcaccggaaagaggaaatattaccatggccccggtaatgaaaagtctcggacggactacgggcgatatcgcactagcggagagaccctggataacatcttcggcattcttataggcaaatgcacattttaccctgacgagttcagagctgccaaggcgtcctatactgcacaagagtttaacctgttgaatgacctcaacaatctgaccgtgccaacagagaccaagaaattatcaaaggaacagaaaaaccagatcattaattacgtcaagaacgagaaagccatggggcccgctaagctgttcaagtatatcgccaaactccttagttgtgatgtggcagacataaagggatacaggattgataaaagcggtaaggctgaaatccacacgtttgaggcctatcggaaaatgaagactctggaaacattggacatcgagcaaatggatcgcgagaccctagacaagctggcgtacgtgctcactctgaatacagaaagagagggcattcaggaagcccttgagcacgagttcgcagatgggtctttctcccagaaacaggtcgacgagctggttcaatttaggaaggctaactcaagcatcttcggaaaaggctggcataattttagtgtgaagttgatgatggagctcattcctgaactgtacgagacctctgaagaacagatgacgatattaacccgtctgggtaaacagaagacaacttccagctcgaacaagaccaaatatatcgatgagaagctactcacagaagagatttacaatccagtagtggccaaatctgtccggcaggctatcaagatcgtgaacgccgcaattaaagaatatggggacttcgataatatagttatcgagatggcccgagaaactaacgaggacgacgagaagaaagctattcaaaagatccagaaggcgaataaagatgaaaaggacgcagccatgctgaaagctgccaaccagtacaacggcaaggcagagcttccgcactccgtgtttcatggacacaaacagttggccaccaagattagactgtggcaccaacagggcgaaaggtgcctctatacagggaagaccatctcaatacatgatctgatcaataacagtaatcagttcgaggtcgaccacattcttcccctgagcatcacttttgatgactccttggctaacaaagtgctcgtatacgccacggcaaatcaggaaaagggacaacgcacaccttatcaggcgctggattctatggacgatgcttggagcttccgggagttaaaagcctttgttagagagtcaaagaccctgagtaacaaaaagaaggaatacctactcactgaggaagacatttccaaattcgatgtgaggaagaaatttatcgagcgcaatctggtcgacacccgatacgcaagccgggtggtccttaacgccttgcaggaacatttccgtgctcacaagatagatacaaaagtgtctgttgtgagaggtcaatttacctcacagctgaggcgccattggggcattgagaagactcgggacacatatcaccaccatgccgtagacgcactcatcattgctgccagtagccagctgaatttatggaagaaacagaagaacacgctggtctcctactctgaggatcaacttttggacatcgaaaccggggagctcatatcggatgacgaatataaagagagcgtgttcaaggcgccataccagcacttcgttgatactctgaaatccaaggagtttgaagactcaatcctattcagttatcaggtggattctaaatttaatagaaagattagcgacgccacaatctacgctaccaggcaggcaaaggtcggaaaagataaggccgacgagacatatgtgctgggcaaaattaaggatatctacactcaagacggttacgatgctttcatgaaaatatataagaaggacaaatccaagtttctcatgtaccgacatgacccccagaccttcgaaaaagtaattgagcctatcctggaaaactatccaaataagcagatcaacgagaaagggaaggaggtgccctgtaatccgtttcttaagtacaaagaggaacacggctatattcgcaagtacagcaaaaagggaaacggccctgaaatcaaatcattgaagtattacgattctaagctggggaaccacattgacataacgcccaaagattccaataacaaggttgtcttacagagtgtgagcccatggcgggccgacgtgtacttcaataaaaccacaggaaagtatgagatcctcggtctgaaatacgcagatcttcaatttgaaaagggcactgggacctataagatttctcaggagaaatacaacgacatcaagaaaaaggagggagtcgattccgactcagagttcaaatttacactgtataagaatgatttgctcctggttaaagacactgaaaccaaggaacagcaactattcagatttctgagtaggacgatgcctaagcagaaacattacgtggagctcaagccctatgataaacagaagttcgaaggcggtgaggcgctgattaaagtgcttgggaacgtagccaatagcggccagtgcaagaagggattgggcaaatcgaacatctccatatacaaggtccgtacagacgtgctggggaatcaacacatcattaaaaacgagggagacaagccaaaattagatttcaagcgccccgctgccaccaagaaagcaggccaggctaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3696 - RNA, 4250 nt, synthetic construct
  misc_feature 1..4250: note = Cpf1 variant mRNA product
  source 1..4250: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaacccagttcgagggatttacaaacctgtaccaagttagcaagactctcaggttcgaacttattccacagggtaaaacgctgaagcatatacaggagcagggctttatcgaagaggacaaggcccggaatgatcactataaagaattgaagccgattatcgaccgcatttacaaaacctatgcggatcaatgcttacagctggtgcagctagactgggagaacctctccgctgccatcgattcttaccgaaaggagaaaacagaagagactcgtaatgcactgatagaggaacaggccacctatagaaacgctatccatgactacttcattgggaggacagataatcttaccgacgcaatcaacaagcggcacgccgagatttataagggactgtttaaagctgaattgttcaatggcaaggtactcaaacaactgggtactgtgacaaccacggagcatgaaaacgccctgctccgctcatttgataagttcactacctactttagtgggttctacgagaataggaaaaacgtctttagcgcggaagacatctccacagcaataccccacagaattgtgcaggataatttccctaagtttaaagagaactgtcacatcttcactcggttaattaccgccgttccatctctgcgcgagcatttcgaaaatgtgaagaaggctatcggaatctttgtctcgacatcaattgaggaagtgttcagctttcccttctataaccagcttttgacccagacgcaaatagacctgtacaatcagctactcggcggcatcagtcgagaggccgggactgagaaaattaagggactgaacgaagtacttaacctggcaatccagaaaaatgatgagacagctcacataattgcctccttgcctcatagatttatcccactcttcaagcaaatcctgtctgacaggaacacccttagctttattctggaagagttcaaatccgacgaagaggttatccagtcattttgcaagtataagactctccttcggaatgaaaacgtgctggagacagcggaggccttgttcaatgaactaaacagtattgatctgacccacatatttatcagccacaaaaagctcgagacgatttcttccgcactgtgtgaccattgggatacccttcgtaatgctctgtacgaacgcagaatctcagagttgacaggtaaaatcactaagagcgccaaagagaaggtccagaggagtctcaagcacgaagacattaacctgcaggagataatctctgctgccggcaaagaattatccgaggcattcaagcagaaaaccagcgaaattctgtcgcatgcccacgctgcgctagatcaacccctccctacaactctgaagaaacaggaggagaaggaaatccttaagtctcagttggactccctgctcgggctgtatcatcttctggattggtttgcagtggacgagtcaaatgaagtggatccagagttcagtgcccggttgaccggaattaaactcgaaatggagccgagcctgtccttctacaacaaggctcgaaattatgccactaaaaagccctactctgtcgagaaatttaagttaaacttccaaatgcctaccctggcaagcggctgggacgttaataaagaaaagaacaatggtgccatcctatttgtgaagaacgggctctactatctgggaataatgccaaaacagaagggccgctacaaagctctttcattcgagcccactgaaaagacgagtgagggctttgataaaatgtattacgactatttccctgacgccgcaaagatgatcccaaagtgctccacacagttgaaagcggtaaccgctcactttcagactcacaccacacccattctgctcagcaacaatttcatcgaaccgctggagattaccaaggagatctacgatttaaacaatcctgaaaaagagcccaagaaatttcaaactgcctatgcaaagaagacaggggaccagaaaggatacagagaagccctgtgtaagtggatagatttcacgagggactttctttctaaatacaccaagactacatcaattgatttgagtagcctccggccatcctctcagtataaagacctgggtgagtactatgctgagctaaaccctctgctctaccatatctcgttccagcgcattgccgaaaaggagatcatggatgcagtggaaaccggcaagctgtatctttttcaaatatacaataaagacttcgctaaggggcaccatggaaaacccaacttgcacacactgtattggactggcttattcagcccagagaatctcgccaagacctccatcaaactgaacggtcaggcggaattattttacagacccaagtcaaggatgaaacgtatggcccaccggctgggggagaagatgttgaataagaaactcaaggatcagaaaacgcctattccagacaccctgtaccaagagctatatgattacgtcaaccatcgactgagtcacgacctctctgatgaagctagagcactgcttccgaatgtgatcacaaaggaggttagccatgaaattatcaaagacaggcgcttcacttccgacaagtttttctttcacgtgcccataaccttgaactatcaggccgctaattcacctagcaagttcaaccagcgggtcaatgcctacctgaaagagcatccagaaacacccattatcggcatcgatagaggagagaggaacttaatttatatcactgtgattgactctaccggcaagatactcgagcagcgctccctgaacacgatccaacagtttgattaccagaaaaagctggacaatcgagaaaaagagcgggtagcagcgcgtcaggcctggagtgttgtggggacaattaaggatcttaagcaaggatatctaagccaggtcatccacgaaattgtggacctcatgatccactaccaggctgtcgtggttctggagaacttgaatttcggttttaaatctaagagaaccggcatagccgaaaaagcagtgtaccagcaattcgagaagatgctgatcgataaattaaactgcctcgtactgaaggactatcctgctgagaaggtcgggggagtgcttaatccataccagctgactgatcagtttacatccttcgccaaaatgggcacccaatcaggtttcttgttttatgttcccgcaccgtacacaagtaagattgaccctctcaccgggttcgtggatccatttgtctggaaaacaatcaagaaccatgaaagcaggaaacacttcctggagggctttgacttcctacattatgatgtgaagacgggagactttattctgcacttcaagatgaatcgcaacctttcgtttcagcggggcctccccgggttcatgcctgcctgggacatcgtatttgagaaaaatgaaacccagttcgatgctaagggaactccctttatagcgggtaaaagaattgtgccagttatcgagaaccataggttcacaggccgataccgcgacctgtatcctgccaatgaattgatcgcactgttagaggaaaaggggattgtcttccgggatggatccaacatactccccaaactgcttgagaatgacgattctcacgctatcgacaccatggtggccctgattagaagcgtgttgcagatgaggaactcaaatgccgctacaggcgaagattacatcaacagtccagtccgtgacctcaacggtgtttgttttgattcccgcttccaaaatccggagtggcctatggacgcagatgccaacggggcgtaccacattgctctgaagggccagctactgcttaatcatctcaaagagtctaaggacctgaagttgcagaacggaatcagcaatcaggactggttagcctatatacaagaactgcggaacaaaagacccgcagccactaagaaagctggccaggcaaagaaaaagaagtaaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3697 - RNA, 4229 nt, synthetic construct
  misc_feature 1..4229: note = Cpf1 variant mRNA product
  source 1..4229: mol_type = other RNA
gggagagtcccgcagtcggcgtccagcggctctgcttgttcgtgtgtgtgtcgttgcaggccttattcaagcttaccatggcccccaagaaaaagagaaaagtgggcatccacggggtccctgctgcaagcatttaccaggagttcgttaacaagtattccctgtctaaaaccctcaggtttgaacttataccacaaggaaagacactggagaatatcaaggcccggggtttgattttagacgatgaaaaacgcgcgaaggactacaaaaaggctaaacagatcattgataagtatcatcagttctttatcgaggaaatactgtcaagtgtgtgcatcagcgaggacctactccagaactactccgatgtatatttcaagctgaaaaagtctgacgatgacaatcttcaaaaagattttaagtcggccaaagacactattaagaaacagatctcagagtacattaaggatagcgaaaagttcaaaaacctgtttaatcagaacttgatcgacgcaaagaaaggccaggagagtgatctcatactgtggctgaagcaatccaaagacaatgggattgaactcttcaaggccaactctgacatcacggatattgacgaggctttagagatcatcaagagctttaaaggatggaccacatatttcaagggctttcacgaaaatcgtaaaaacgtgtactcctcaaatgatattccgacaagtataatctaccgaattgtcgacgataacctgcccaagttccttgagaataaagcaaagtatgagagcttgaaggacaaagcccctgaggctatcaactacgaacagataaagaaagatctggccgaggagctaacctttgacattgattataagacatctgaagtgaatcagagagttttctccctcgacgaggtgttcgaaatcgcgaactttaacaattacctgaaccagtcaggtatcaccaaattcaatactattatcgggggaaagtttgtcaacggcgagaatacaaagaggaaaggcattaacgaatatataaatctttacagccaacagatcaacgataagaccctgaaaaagtataaaatgagtgtgttgttcaagcagattctctctgacacggagtccaagagctttgtaatcgacaaactggaggatgactcggatgttgtgactaccatgcaatctttctacgaacagatcgcagcctttaagacagtcgaggaaaaatccattaaggagactttatcactcctgttcgacgatcttaaagctcagaagctggacttgagtaaaatatactttaagaatgataagagcctaaccgacctgtcccagcaagtgttcgatgactattctgtgatcgggacagccgtcctcgaatacattacccagcagatcgcacccaaaaacctggataatccaagcaagaaagagcaggagcttattgctaagaaaacggaaaaggccaagtatctgtcattggagactatcaaactcgcgctggaagagtttaacaagcatcgggacatagataaacaatgtcgcttcgaggaaatcttagccaattttgcagctattcctatgatcttcgacgagattgcccagaacaaggacaatctggctcagatcagtataaaataccagaaccaaggaaagaaggatctactccaggcctccgcagaagacgatgttaaagccattaaggacctgcttgatcagacaaacaatttgctgcacaaactcaagatcttccatattagccagtctgaggacaaagctaacatcctggataaggacgaacacttttatcttgtgttcgaggagtgctactttgaactggcgaatatagtaccattgtataacaaaatcagaaattacattacccaaaagccctactcagatgagaagttcaaactcaactttgaaaatagtactctggcaaacggttgggacaagaataaagagcctgataacacagccatcttattcattaaggacgataaatattacctgggcgtgatgaataagaagaacaataaaatctttgacgacaaggctataaaagaaaacaagggggagggatataaaaagattgtctacaagctactcccaggcgccaataaaatgctgccgaaggtgttctttagcgcaaaatccatcaagttctataacccctctgaggatatccttaggattcggaaccactcgacccatacgaaaaatggtagccctcagaaggggtacgaaaagtttgagttcaacatcgaagactgtcgcaaatttattgatttctataagcagtccatatcaaaacacccagagtggaaggacttcggatttcgattcagtgatacccaaagatacaattctatcgacgaattttacagggaggttgagaaccagggctataaattgacattcgaaaatattagcgagtcctacatcgattcagtggtcaaccagggcaagctgtatctctttcagatttacaataaggacttcagcgcctattctaaagggcggcccaacctgcatactttatactggaaggctctgtttgatgaacgtaatcttcaagacgtggtatataaattgaacggagaggccgaactcttctaccgcaagcagtccatccctaaaaagataacccacccagcaaaagaagcgatcgctaataagaacaaggataatcccaaaaaggagagtgtttttgaatacgacctgattaaagacaagagattcacagaggataaatttttcttccactgcccgatcactattaactttaagagctctggtgccaataagttcaacgacgaaatcaacctactgctcaaagagaaggcaaatgatgtgcatatactgtccattgacaggggcgagcggcaccttgcctattacaccttggtcgatgggaaaggaaacatcatcaagcaggacacatttaatattataggcaacgatcgaatgaaaaccaattatcatgacaagctggctgccatcgaaaaggatcgcgactcagcaagaaaagattggaagaaaattaacaatatcaaggagatgaaagaaggttacttaagtcaggtggtccacgagattgctaagctcgtgatcgaatataacgccatagttgtgttcgaggacctgaattttgggttcaagaggggccggtttaaagtagagaagcaagtctaccagaaacttgaaaagatgctgatcgagaaattgaactatctcgtgttcaaggataatgaatttgacaaaactggaggcgttctgcgcgcgtaccagctaacggcccctttcgagacatttaagaagatggggaaacagaccggaattatctactatgtgcccgctggtttcactagcaagatttgtccagtcaccggctttgtgaaccaactgtaccctaaatatgaatcggtatccaagtctcaggagttcttcagcaaatttgacaagatctgctacaatctcgataaggggtatttcgagttttcattcgactacaaaaactttggagataaggcagccaaaggcaagtggacaatagctagtttcggttccagactgattaattttaggaactctgacaaaaatcataactgggatacccgtgaagtgtatcccactaaggagcttgaaaagttgctgaaagactacagcatcgagtacgggcacggcgagtgtatcaaggccgcaatttgcggagaatccgataaaaagttctttgcgaaattaacatcagttctcaacacgatcctgcagatgcggaatagcaagaccggcactgagcttgactatctgataagtccagtcgccgatgtgaacgggaatttctttgactctcgacaagctcccaagaacatgcctcaggatgccgacgcaaatggagcttaccacattggtctaaaaggcctcatgctgttggggagaatcaagaacaatcaggaaggcaaaaagctgaacttagtgattaaaaatgaggaatatttcgagtttgtccagaacaggaataacaagcgcccagccgcaactaaaaaggccggacaagctaagaaaaagaaataaggactagtgtccacctgtccctcctgggctgctggattgtctcgttttcctgccaaataaacaggatcagcgctttacagatctaaaaaaaaaaaaaaaaaaaaaaaaaaaaaaaaaaaaaaaaaaaaaaaaaaaaaaaaaaaaaaaagaatt

SEQ ID NO: 3698 - RNA, 51 nt, synthetic construct
  misc_feature 1..51: note = NLS2 variant
  source 1..51: mol_type = other RNA
atggcccccaagaaaaagagaaaagtgggcatccacggggtccctgctgcc

SEQ ID NO: 3699 - RNA, 48 nt, synthetic construct
  misc_feature 1..48: note = NLS4 variant
  source 1..48: mol_type = other RNA
aagagacccgccgctaccaaaaaggccggccaggcgaaaaagaaaaag

SEQ ID NO: 3700 - RNA, 4107 nt, synthetic construct
  misc_feature 1..4107: note = Cas9 variant
  source 1..4107: mol_type = other RNA
atggacaagaaatacagcatcggcctggatattgggaccaactccgtgggatgggccgtcatcacagacgagtataaggttccctctaaaaagttcaaagtgctgggcaatacggatagacacagcattaagaagaacctgatcggggcccttctgtttgactccggagaaaccgccgaggcgacacggctcaaacgcaccgctagacggcgctacacaagacggaagaatcgcatttgctatctgcaggaaatcttctctaacgagatggccaaagtggatgacagctttttccatagacttgaagagtcctttctggtcgaggaagataagaaacacgagcggcatcctatcttcggcaatattgtggacgaagttgcctaccacgagaagtatccgaccatctaccatctccgcaagaaactggtggattctacagacaaggctgatctgagactcatttatctggcccttgctcacatgatcaaatttcgggggcacttcctgattgagggagacctcaaccccgataatagcgacgtcgacaagctgtttatccaacttgtgcagacctacaaccagctgttcgaagagaatcctattaacgcctccggcgttgatgcgaaagccatcctcagcgctcgcctgtctaagtccagacggctggaaaatctcatcgcccagctgcccggcgagaaaaagaacgggctttttggaaatctgattgctctcagcctgggccttacgcctaacttcaagtctaattttgacctggccgaagatgcgaaactccaactgtccaaggacacctacgatgacgatctggacaacctcctggcccagatcggggatcagtatgctgaccttttcctggccgctaaaaacctcagcgatgccattctgctttctgacatcctgcgcgtgaatacagagattaccaaggctcccctctccgctagcatgatcaaaagatacgacgagcatcaccaggatctgacactgctcaaggcgctggtccggcaacagcttcctgaaaagtataaagagatcttctttgaccagtccaagaacggatacgccggctatattgatgggggagcttctcaggaagagttctacaaatttatcaagccgattctggaaaagatggacggcaccgaggagctcctggtgaagctgaatagagaagatcttctccgcaagcaacggacgttcgacaacggcagcatcccccatcagattcacctgggggagctgcacgccatcctcagacgccaggaagatttttatcctttcctgaaagacaatcgggagaagatcgaaaagattcttacatttagaatcccctactacgtgggacctctggcccgcggcaactcccggttcgcttggatgaccagaaagagcgaggagacaattaccccctggaattttgaagaggtcgttgataaaggggcctctgcgcaatccttcatcgaacgcatgaccaactttgacaagaatctcccgaacgagaaggtgctgcctaaacatagcctgctttatgagtacttcacagtgtataatgaactcacgaaggtcaaatacgtgaccgagggaatgcggaagcccgcttttctgtctggcgaacagaaaaaggccattgttgatctgctgttcaaaacaaacagaaaggtgaccgtcaagcagctgaaagaggactatttcaagaaaatcgaatgttttgatagcgtggagatttccggggttgaggaccgcttcaatgcctctcttggaacataccacgacctgctcaagatcatcaaagataaggactttctggataacgaagagaatgaagacattctggaggatatcgtgcttaccctcacgctgttcgaagaccgggagatgattgaggaaagactgaagacatatgctcatctctttgatgacaaagtcatgaagcagctgaaacggcgcagatacaccggctggggccggcttagcagaaagctgatcaacgggattcgcgataaacaatccggaaagaccatcctcgacttcctcaagagcgatggctttgccaaccggaatttcatgcagctgatccacgacgattctcttacatttaaagaggacattcagaaggctcaggtgtccgggcaaggagacagcctccatgaacacatcgccaacctggcgggctctcctgccattaaaaaggggatcctgcagaccgtcaaagtggttgatgagctcgtgaaggtcatgggcagacacaagcccgaaaatattgtgatcgagatggctcgcgagaaccagacaacgcagaaaggacaaaagaactccagagaacggatgaaacgcatcgaggaaggcattaaggagctggggagccagatccttaaagagcatcccgttgaaaatacccagctgcagaatgagaagctctacctgtattacctgcaaaacggaagagacatgtatgtggatcaggaacttgacattaatcggctgtccgattacgacgtcgatcacatcgtgcctcagtctttcctcaaagacgatagcattgacaacaaggtgctgacacgctccgataagaatagaggcaaatctgacaacgttccgagcgaggaagtcgtgaagaaaatgaagaattattggcggcaactcctgaacgccaaacttatcacccagcgcaagtttgacaatctgacaaaggctgagagagggggactctccgagctggataaagccggcttcatcaagcggcagctggtggaaacccgccagattacgaaacatgtcgcgcaaatccttgacagcagaatgaacaccaagtacgatgagaacgacaaactgattcgggaagtgaaggttatcacactcaagtctaaactggtgtccgattttagaaaggacttccagttctataaagtccgcgagattaataactaccaccacgcccatgatgcttacctcaatgccgtggttgggaccgctctgatcaagaaatatcccaaacttgaaagcgagtttgtgtacggcgactataaggtctacgatgtgcggaaaatgattgccaagtctgagcaggaaatcggaaaagccacagctaagtatttcttttactccaacatcatgaatttctttaaaaccgagattacgctggcgaacggcgaaatcagaaagcgccctctcattgagacaaatggggaaaccggagagatcgtttgggacaagggccgggatttcgccacagtgagaaaagtcctgagcatgccccaggtgaacattgtgaagaaaaccgaggtccaaaccgggggattttctaaggaaagcatcctgcctaaacgcaattccgacaaacttatcgctcggaaaaaggattgggaccccaagaaatatggcgggttcgacagcccgacagttgcctactctgtgctggtggtcgccaaggtggagaaaggcaagtccaaaaagctcaagagcgttaaagaactgctcggaattacgatcatggagagatcctcttttgagaagaaccctattgatttcctggaagctaaaggctacaaggaggtgaaaaaggaccttatcattaagctgcccaaatatagcctgtttgaactcgagaatgggcgcaagcggatgctggcctccgcgggagaacttcagaaaggcaacgagctggctctcccttctaagtacgtcaatttcctgtatctcgccagccactacgagaaactgaaggggtcccccgaagataacgagcagaagcagcttttcgtggaacaacataaacactatctggacgagatcatcgaacagatttctgagtttagcaagagagttatcctggccgatgctaatctcgacaaagtgctgtccgcctacaacaagcatcgggataaacctattcgcgagcaggcggaaaacatcattcaccttttcaccctgacaaatctcggagctcccgccgcctttaagtatttcgacaccacaatcgatagaaaacggtacaccagcacgaaggaggtcctggacgctacactcattcaccaatctatcaccggcctgtacgaaacccgcatcgatctttcccagctcgggggcgactga

SEQ ID NO: 3701 - RNA, 4890 nt, synthetic construct
  misc_feature 1..4890: note = Cas9 variant
  source 1..4890: mol_type = other RNA
atgaacttcaagatcctgcccattgccatcgacctcggcgtgaaaaataccggggtctttagcgctttctaccagaagggaacatccctggagagacttgataacaaaaatggcaaggtttatgaactgtctaaagacagctacacgctcctgatgaacaatcggaccgcccgcagacaccaacggcgcgggattgatagaaagcagcttgtgaagcggctgtttaaactcatctggacagagcagctgaacctggaatgggacaaggatacccagcaagcgatttccttcctctttaatcgcagaggattctcttttatcacagacggctatagccctgagtacctgaacatcgtgccggaacaggtcaaagctattcttatggatatcttcgacgattataatggggaggacgatctggactcctacctcaagctggccaccgagcaggaatctaaaattagcgagatctataacaaacttatgcagaagattctggaatttaaactcatgaagctgtgcacagatatcaaagacgacaaggtgtccaccaaaacgctgaaggagattaccagctacgagttcgaactcctggccgattaccttgctaattattctgagtccctgaaaacacaaaagtttagctacaccgacaagcagggaaacctcaaagaactgtcttattaccatcacgataagtataatatccaggagttccttaaacggcatgccacaatcaacgaccgcattctggataccctcctgacggacgatctggacatctggaattttaacttcgaaaagttcgattttgacaaaaacgaggagaagctccagaatcaagaagataaggaccacattcaggctcatctgcaccacttcgtttttgccgtgaacaaaatcaagtccgagatggcgagcggcggcagacatcggtctcagtacttccaagaaattacaaatgtccttgacgagaacaatcaccaggaagggtatctgaaaaacttttgtgagaatctccataacaagaaatactccaatctgagcgtgaagaaccttgttaatctgatcggaaacctctccaatctggagctgaagcccctccgcaaatacttcaacgataagatccacgccaaagctgaccactgggatgaacagaagtttaccgagacatattgccattggattctgggcgaatggagagtgggggtcaaagaccaggataagaaggacggagccaaatactcttataaggatctttgtaatgagctgaaacaaaaggtgaccaaagctggcctcgtggacttcctgctggaacttgatccttgccggaccattcccccttacctcgacaacaacaatcgcaagccccctaaatgtcagagcctgatcctgaacccgaagtttctcgataatcagtatcccaactggcagcaatacctgcaggagcttaagaaactgcagtccatccagaattatctcgacagcttcgagacagatctgaaggtcctgaaatcttccaaggaccaaccttactttgttgaatacaaaagctctaaccagcagattgccagcgggcagagagactataaggatcttgacgcgcggatcctccaattcatctttgatagagtgaaggcctccgacgagctgctgctcaatgaaatttacttccaggctaaaaagctgaaacagaaggcctctagcgagcttgagaaactggaatccagcaagaagctcgatgaggtgatcgctaactctcaactgtcccagattctgaaaagccagcacacgaatggaatcttcgaacagggcacctttcttcatctcgtctgcaagtattacaaacaacgccagcgggccagagactctcgcctgtatattatgcccgagtaccggtatgataagaaactgcacaagtacaacaatacaggcagattcgacgatgacaaccagctcctgacctactgtaatcataagcctcgccagaaacggtatcaacttctgaacgatctcgccggggtgctgcaggtttcccccaattttctgaaggacaaaatcggaagcgatgacgaccttttcatttccaagtggctcgtggaacacatcagaggctttaaaaaggcttgcgaggattctctgaaaatccagaaggacaaccgcgggctgctcaaccacaagattaatatcgcgcggaacacaaaaggaaagtgtgagaaagaaattttcaatctgatctgcaagattgagggcagcgaagataaaaaggggaactacaagcatggacttgcctatgagctgggcgtcctcctgtttggcgaaccgaatgaggcttccaaacctgagttcgacagaaagatcaaaaagtttaactctatctacagcttcgcccagattcaacagatcgcctttgctgaacgcaaagggaatgccaacacctgtgcggtgtgctccgctgataatgcccaccggatgcagcaaattaagatcacggagcccgttgaagacaacaaggataaaattatcctgagcgccaaggctcagagacttcctgccatccccacacggattgtggacggagctgtcaaaaagatggccaccatcctggcgaaaaatattgtggatgacaactggcagaatatcaagcaggtcctctctgccaagcatcaactgcacattcccatcatcaccgagtccaacgctttcgaatttgagcctgccctcgctgatgtgaaaggcaagagcctgaaagaccgcagaaagaaagcccttgagcggatttctccggaaaatatcttcaaggacaagaacaacagaattaaagagttcgcgaaggggatctccgcctatagcggagctaatctgacagatggcgactttgatggggccaaagaggaactcgaccacattatcccccgctctcataagaaatacggcaccctgaacgatgaggctaatctgatttgcgttacacggggagacaacaagaataaaggcaacagaatcttctgtcttcgcgatctggccgacaattataagctcaagcagtttgaaacgaccgatgacctggagatcgaaaagaagattgccgatacaatctgggacgctaacaaaaaggatttcaaatttgggaattacagatctttcattaacctcacccctcaggagcagaaggcgtttcggcacgccctgttccttgctgacgaaaatcccatcaagcaagccgtgattcgcgccatcaacaatagaaaccggacatttgtcaatggaacccagcgctacttcgctgaggtgctggccaacaatatctatctcagagcgaaaaaggagaacctgaacacggacaaaatttcctttgattacttcggcatccctaccattgggaatggacggggcatcgctgaaattcgccagctgtatgagaaggttgacagcgatatccaggcctacgccaaaggggacaagccccaagctagctattcccatcttatcgatgccatgctggcgttctgcattgctgccgacgaacacagaaacgatggcagcatcggactcgagattgacaagaattactccctgtatccgctcgataaaaacacaggcgaagtgtttaccaaggacatcttctctcagattaaaatcacagataatgagtttagcgacaagaaactggtccggaagaaggccattgaggggttcaacacccatcgccagatgacgagagatggaatctacgctgaaaattaccttcctatcctgattcacaaagagctgaacgaagtgcggaagggctatacatggaaaaattccgaggaaatcaagatttttaaagggaagaaatacgacatccagcaactcaacaatctggtgtattgtcttaagttcgttgacaagcccatttctatcgatatccagattagcaccctggaggagctcagaaacatcctgacaaccaataacattgccgctaccgccgaatactattacatcaatctcaaaacacagaagctgcacgagtattacattgaaaactacaacacggcgcttggatataaaaagtactccaaagagatggagtttctgcgctctctggcctatcggagcgaaagagtcaagatcaagtccatcgacgatgtgaaacaagtgctcgacaaggatagcaatttcattatcggcaaaattaccctgccttttaagaaagagtggcagcgcctttaccgggaatggcagaacacaaccatcaaggacgattatgagttcctgaagtcctttttcaatgtcaaatctattacaaagctccataaaaaggtgagaaaagactttagcctgcccatctctaccaacgaagggaagttcctcgttaagcgcaaaacgtgggataataacttcatttaccagatcctgaatgactccgatagccgggctgacggcacaaagccttttatccccgccttcgacatttctaaaaacgagatcgtggaggctattatcgattcctttaccagcaagaatattttctggcttccgaaaaacatcgaactgcaaaaggtcgacaataaaaacatctttgccattgatacctccaagtggttcgaggtggaaacacctagcgacctgagagatatcggaattgccaccatccagtataagattgacaataactctcgccccaaagttcgggtgaagctcgattacgtcatcgacgatgacagcaaaatcaattactttatgaaccactccctgcttaagtctagatatcccgataaagtgctggagattctcaagcagagcacaatcattgagttcgaatcctctggctttaacaagacgatcaaagagatgctggggatgaagctcgctggaatttacaatgaaaccagcaacaattga

SEQ ID NO: 3702 - RNA, 3162 nt, synthetic construct
  misc_feature 1..3162: note = Cas9 variant
  source 1..3162: mol_type = other RNA
atgaagagaaactacatcctgggcctcgacattgggatcaccagcgtgggatatggcattatcgattacgagacacgggacgtcattgatgccggggttcgcctgttcaaagaagctaatgtggagaacaatgaaggaagacggtccaagcgcggcgccagacggcttaaacgcagacggcgccacagaatccagcgggtgaagaaactgctctttgactataacctgcttacggatcattctgagctgagcgggatcaatccctacgaagcgcgcgtcaagggactctcccaaaagctgtctgaggaggagttcagcgctgccctgctccacctggccaaaagacggggcgtgcataacgttaatgaagtggaagaggacaccggcaacgagctttccacaaaggaacagatttctcgcaatagcaaagctctggaggaaaagtatgtcgccgagctccagctggaaagacttaaaaaggatggggaggtgcggggatccatcaacagatttaagaccagcgactacgttaaagaggctaagcagctgctcaaagtgcaaaaggcctatcaccagctggatcagtctttcattgacacatacatcgatctgctcgaaacccgccggacatactatgagggccctggggaaggatccccgtttggctggaaagacattaaggagtggtacgaaatgctgatggggcattgcacctatttccccgaggagcttagaagcgtcaaatacgcgtataatgccgatctgtacaacgctctcaatgacctgaacaatcttgtgatcacgcgcgacgaaaacgagaagctggaatattacgagaagtttcagattatcgaaaacgtgttcaaacaaaagaaaaagcctaccctcaaacagatcgccaaggagattctggtcaatgaggaagatatcaagggataccgggttacatctaccggcaaacccgagtttacaaacctgaaggtgtatcacgacattaaagatatcaccgctagaaaggaaattatcgagaatgccgagctcctggaccagatcgcgaaaattcttacgatctaccagtccagcgaagatattcaagaggaactgacaaacctcaattctgagctgacccaggaagagatcgagcagatttccaaccttaagggctatacagggacccacaatctgagcctcaaggccatcaacctgatcctggacgaactctggcataccaatgataaccaaattgctatcttcaatcgcctgaaacttgtgcctaagaaagtcgacctgtcccagcagaaggagattcccacaacgctcgtggatgactttatcctgtctcctgttgtgaaacggagcttcattcagtccatcaaggtcattaacgccatcatcaagaaatacggactgccgaatgatattatcattgaacttgctagagagaagaacagcaaagacgcccaaaagatgatcaatgaaatgcagaaacgcaaccggcagaccaacgagagaattgaggaaatcatccgcacaaccggcaaggagaatgccaaatatctcattgaaaagatcaagctgcacgacatgcaggaggggaaatgtctgtactctctcgaagctattcccctggaggatcttctgaacaatccttttaactatgaggtggaccatatcattccccggtccgttagcttcgataattctttcaacaataaggtgctcgtcaaacaagaagagaacagcaagaaaggaaatagaacaccttttcagtacctgtcctctagcgactccaagatcagctacgaaaccttcaagaaacacatcctgaaccttgcgaagggcaaagggcggatttctaagacgaaaaaggagtatctcctggaggaacgcgatatcaatagattttccgtgcagaaggacttcattaaccggaatctggtcgatacaagatacgccacccgcggactcatgaacctgcttcggagctattttagagtgaataacctggacgttaaagtgaagtctatcaacggcggcttcacctcctttctccgcagaaaatggaagttcaaaaaggagcggaataaggggtacaaacaccatgctgaagatgccctgattatcgccaacgctgactttatcttcaaggagtggaaaaagctggataaagccaagaaagtcatggaaaatcagatgtttgaggagaagcaagcggaaagcatgcccgagattgaaacagagcaggaatataaggagatcttcattaccccgcaccagatcaaacatattaaggactttaaagattacaagtattcccaccgcgtggacaaaaagcctaacagagagcttatcaatgacacactctactctacgcggaaggatgacaaaggaaacaccctgattgttaataacctgaatggcctctacgataaggacaacgataaactgaagaaacttatcaataagagccccgaaaagctgctcatgtatcatcacgaccctcagacataccaaaaactgaagctgatcatggagcagtatggggatgagaaaaaccccctttacaagtattacgaagaaaccggaaattatctcacaaaatactccaagaaggacaacggccccgtgattaaaaagatcaaatactatgggaataagctgaacgctcacctggatattaccgacgattaccctaactctcgcaataaagtcgtgaagctcagcctgaagccgtatagattcgacgtgtaccttgataacggcgtttataaattcgtcacggtgaagaatctggacgtgatcaaaaaggagaactactatgaggtcaattccaaatgctacgaagaggccaagaaactcaagaagattagcaaccaggccgaatttatcgcttctttctacaataacgacctgatcaaaattaatggagagctgtatcgggtgatcggcgttaacaatgatcttctgaaccgcattgaggtgaatatgatcgacattacctacagagaatatctcgagaacatgaatgataagcggccccctcgcatcatcaaaacaattgcctccaagacccaaagcatcaaaaagtactctacagacattctggggaacctctatgaagtcaagtccaaaaagcatccccagatcattaaaaagggatga

SEQ ID NO: 3703 - RNA, 4230 nt, synthetic construct
  misc_feature 1..4230: note = Cas9 variant
  source 1..4230: mol_type = other RNA
atgctgttcaacaagtgcatcattatcagcattaatctcgacttttccaacaaagagaagtgtatgaccaaaccctactctatcggcctggatattgggacaaatagcgtgggatgggccgtcatcacggacaactataaggttccttccaaaaagatgaaggtgcttggcaatacctctaaaaagtacatcaaaaagaacctgctcggggtgctgcttttcgatagcggaattacagctgaaggcagacggctgaaacgcaccgccagacggcgctatacaagacggcgcaatagaatcctctacctgcaggagatttttagcaccgaaatggcgacactggacgatgctttctttcaacggctcgacgattctttcctggtcccggacgataagcgcgacagcaagtatcccatctttgggaaccttgtggaggaaaaagtttaccacgatgagttccctaccatttatcatctgagaaagtacctcgccgactccacgaaaaaggccgatctgcggcttgtgtacctggctctcgcccacatgatcaaatatcgcggacattttctgattgagggcgagttcaatagcaagaacaatgacatccagaaaaactttcaggacttcctggatacctacaatgctatctttgaatctgacctctccctggaaaacagcaagcagcttgaggagattgtcaaggataaaatctctaagctggaaaagaaggaccggattctcaaactgttccccggcgagaaaaattccgggatcttcagcgaatttcttaagctgattgtgggaaaccaagccgatttcagaaaatgctttaacctcgacgagaaggcgtctctgcacttctccaaagaaagctatgatgaggacctggagacactcctgggctacatcggggatgactattccgatgtttttcttaaggccaaaaagctgtacgacgctatcctcctgtctggattccttaccgtgacagacaatgaaaccgaggcccctctgagctccgctatgattaagcgctataacgaacataaagaggatctcgccctgctgaaggaatacatcagaaatattagcctcaaaacgtacaacgaggtctttaaggacgatacaaagaatggctatgcggggtacatcgacggaaagaccaaccaggaggatttctatgtgtacctgaagaatcttctggccgaatttgagggcgctgactatttcctcgaaaagattgatcgggaggactttctgagaaagcagcgcacattcgataacggctctatcccctaccagatccatctgcaagaaatgcgggccattcttgacaaacaggctaagttttatcctttcctcgccaaaaataaggagagaatcgagaaaattctgaccttccgcatcccgtactacgtggggcccctggcccggggaaactccgattttgcttggagcattagaaagcgcaatgaaaagatcaccccttggaacttcgaggacgtcattgataaagaatctagcgcggaggcctttatcaatcggatgacatccttcgacctctatctgcccgaggaaaaggttcttcctaaacactctctgctctacgagacgtttaacgtgtataatgaactgaccaaggtgagattcatcgctgagagcatgcgcgactaccagtttctggattccaaacagaagaaggacattgtccggctttatttcaaagataagagaaaagtgacagacaaggatatcattgaatacctccacgccatctatggctacgacgggattgagctgaaaggaatcgagaagcaatttaacagctctctgtccacctaccacgatctcctgaacatcattaatgacaaggagttccttgatgacagctctaacgaagccatcattgaagagatcattcatacactgaccatctttgaagatcgcgagatgatcaaacagcggctctccaagttcgagaatatttttgacaaaagcgttctgaagaaactgtccagacggcactatacgggctgggggaaactttctgctaagctcatcaacggcattcgcgatgaaaaatccggaaatacaatcctggactacctgattgacgatggcatctccaacagaaatttcatgcagctcatccacgacgatgccctgtctttcaagaaaaagattcaaaaagcgcagatcattggggacgaggataagggaaacatcaaagaagtggtcaagagccttcccggctccccggctattaagaaagggatcctgcagagcattaagatcgtggacgagctcgttaaagtgatgggaggccggaagcctgaatctatcgtcgtggagatggccagagagaatcagtataccaaccaagggaaatccaatagccagcagcgcctgaagcggctggaaaagtctcttaaagagctcggctccaagattctgaaagaaaacatccccgccaagctgagcaaaattgataataacgctctccagaatgacagactgtacctttattacctgcaaaacggaaaggatatgtataccggcgacgatctcgacatcgaccgcctgtctaactacgatattgaccatatcatccctcaggcctttctgaaggataatagcattgacaacaaagtccttgtgtccagcgcttctaatagagggaagtccgatgacttccccagcctggaggttgtgaaaaagcggaaaacattttggtaccagctcctgaagtccaagctcatctctcagcgcaaattcgataacctgaccaaggccgagagaggaggccttctgcccgaagacaaagcggggtttattcaacggcagctcgtcgagacacgccagatcacgaagcacgtggccagactgctggatgaaaaattcaataacaagaaggacgagaataaccgggctgttcgcaccgtgaaaattatcacacttaagagcaccctggtctcccagtttagaaaagatttcgaactctataaggtgcgggagatcaatgactttcatcacgcccatgatgcttacctgaacgccgtgattgcgtctgccctcctgaaaaagtatcctaaacttgagccggagttcgtttacggagactatcccaagtacaatagctttcgcgaaagaaagtccgctacagaaaaagtctatttctactctaacatcatgaatattttcaagaaaagcatctccctggccgacggccgggtgattgagagacctctcatcgaagtgaacgaggagaccggggaaagcgtctggaataaggagtctgatctggctacggtgcgccgggttctgtcctacccccaagtgaacgtcgtgaaaaaggttgaggaacagaaccacggccttgacagaggaaagcctaaaggcctgtttaatgccaacctcagctctaagcccaaacctaattccaacgaaaatctggtgggggccaaggagtatctcgatccgaaaaagtacggaggctatgctgggattagcaactctttcgcggtcctggtgaagggaaccatcgagaaaggcgccaagaaaaagatcacaaatgttcttgaatttcaggggatttccatcctggaccgcattaactaccggaaagataagctgaatttcctcctggagaagggctataaagacatcgaacttattatcgagctgcccaagtacagcctctttgagctgtccgatggaagcagacgcatgctcgcttctatcctgagcaccaacaataaacggggcgaaattcacaaggggaaccaaatcttcctttcccagaaatttgtgaagctgctgtatcatgccaaaagaatttctaatacaatcaacgagaatcaccgcaagtacgtcgaaaaccataagaaagagttcgaggaactcttttactatattctggagttcaatgaaaactacgtgggagccaagaaaaacggcaaacttctgaatagcgcttttcagtcctggcagaaccactctatcgacgagctctgtagctccttcatcgggcctaccggatctgaacggaaaggcctgtttgagctcacgagcagagggtccgccgcggatttcgagttcctgggcgtgaagattccccggtatcgcgactacacacctagctctcttctgaaggatgctaccctgatccaccaatccgtcacaggactctatgaaaccagaattgacctggccaaacttggcgaggggtga

SEQ ID NO: 3704 - RNA, 3306 nt, synthetic construct
  misc_feature 1..3306: note = Cas9 variant
  source 1..3306: mol_type = other RNA
atgtggtacgccagcctgatgtccgctcaccatctcagagtgggcatcgacgtcgggacccactctgttggactggccacacttcgggtggatgaccatggcacgcccattgagctgctcagcgcgctgtcccacatccatgattctggggtgggaaaggaaggcaaaaaggaccacgatacccgcaaaaagctgagcgggattgctagacgggcccgcagactgctccaccatcggcgcacacagctgcaacagctggacgaggtcctcagagatctgggattccctatcccgacccccggcgaatttcttgacctgaacgagcagacagatccttatcgggtgtggcgcgttagagcccggctcgtggaagagaaactgcccgaggaacttcgcggccctgctatttccatggccgtcagacacatcgctcggcatcgcgggtggagaaatccctactctaaggtggagagcctgctctcccctgccgaagagagcccgttcatgaaggcgctgcgggagagaatcctggccaccacaggagaagttctcgacgatggcattacccccgggcaggctatggcccaagtggctctgacgcacaacatctctatgcgcggacctgagggcattcttgggaaactgcaccagtccgacaatgccaacgaaatccggaagatttgcgcgagacagggagtcagccccgatgtgtgtaaacagctcctgcgcgccgtgtttaaggctgactctcctcggggctccgccgtcagcagagttgctcccgacccgcttcctggccaagggtctttccgccgggcccccaaatgcgatcctgagtttcagagattccgcatcatttccatcgtggccaatctgcggatcagcgaaaccaagggagagaacagacccctcacagctgacgagcgccggcatgtggtcacctttctgacagaagattcccaggcggacctgacctgggtggatgttgccgagaagctcggcgtgcacagacgggacctgcgcgggacggctgtccatacagatgacggagaaagatctgccgcccggccccctattgatgctaccgacagaatcatgcgccagacaaaaattagctcccttaagacctggtgggaggaagccgatagcgagcaacggggcgcgatgatcagatatctgtacgaggacccgaccgactctgaatgtgctgagattatcgccgaactccccgaggaagatcaggccaaactggactcccttcaccttcctgctgggcgcgccgcttatagcagagagtctctcacagccctgagcgatcatatgctggcgacgaccgacgatctccacgaggcccggaagcgcctgttcggagtggacgattcctgggctccccctgccgaagctatcaatgcccccgttggcaacccgtctgtggacagaacacttaaaattgtcggccggtacctgagcgcggtggagtccatgtgggggacccctgaagtcatccacgtggagcatgttcgcgatggatttacaagcgagagaatggccgacgaacgggataaggctaatcgcagacggtataacgacaatcaggaggccatgaaaaagattcaacgcgattacggcaaggaagggtacatctctagaggagacattgtgcggctcgacgctctggagctgcagggctgcgcctgtctttattgcgggaccacgatcggctaccacacatgtcagctcgatcatatcgtcccccaggccggacctggctccaacaatagacgcgggaacctggtggctgtttgcgaacggtgtaatagaagcaaatctaacacccccttcgcggtgtgggcccaaaagtgcggaatccctcacgtcggcgtgaaagaggctatcgggcgcgtgcggggatggagaaagcagacccccaacacatccagcgaggacctgacccgcctcaaaaaggaagttattgcccggctgagacgcacacaggaggatccggaaatcgacgagcggtccatggaatctgtcgcctggatggctaatgagcttcaccatagaattgccgcggcttatcctgagacgaccgtgatggtgtaccggggcagcatcacagccgccgctcgcaaggccgcggggattgattccagaatcaacctgatcggcgaaaaaggacggaaggaccgcattgatagacggcaccatgctgtcgacgcctctgtggttgccctcatggaggctagcgtggccaaaaccctggctgaaagatccagcctgcgcggcgagcagcggcttacagggaaggaacaaacctggaaacagtatacgggatctaccgtcggcgccagagagcactttgagatgtggcgcgggcatatgctccacctgacagaactgttcaatgagcggctcgcggaagataaggtgtacgttacccagaacatcagactgcgcctttccgacggaaatgcccacacagtgaaccccagcaagctggtctctcatcggctcggcgatgggctgaccgtgcagcaaattgacagagcttgtacgcccgccctgtggtgcgctcttacacgcgagaaagattttgacgagaagaatggcctccctgccagagaagaccgggccatccgcgttcacggacatgagattaaatccagcgattatatccaggtgttctctaagagaaagaagaccgacagcgatcgggacgaaacaccgttcggcgctatcgcggtccgcgggggatttgtggagattggcccctccatccaccatgccagaatttaccgggtggaagggaagaaacctgtctacgctatgctgagagttttcacccacgatctgctcagccagcgccacggagacctgttttctgccgtgattccccctcagtccattagcatgcggtgcgccgagcccaaacttagaaaagctatcaccacaggcaacgccacgtatctggggtgggtggtcgtgggcgatgagctcgaaatcaatgttgactccttcaccaagtacgcgattggacgctttctggaggatttccctaacacaacccggtggagaatctgtggctatgacacaaattctaaactgacccttaagcccattgtgctcgctgccgaagggctggagaacccgagctccgccgtcaatgaaatcgtggagctgaaaggatggcgggttgctattaacgtgctcacgaaggtccatcctacagtggttcgcagagatgccctgggccggccccgctactctagcagatccaatcttcctacctcttggaccatcgagtga

SEQ ID NO: 3705 - RNA, 4167 nt, synthetic construct
  misc_feature 1..4167: note = Cas9 variant
  source 1..4167: mol_type = other RNA
atgaccaagccctacagcatcggcctggacattgggacaaactccgtgggatgggccgtcacgaccgataattataaagttccttctaagaaaatgaaggtgctcggcaacacaagcaaaaagtacatcaagaaaaatctgcttggggtgctcctgttcgactccggaattaccgctgagggcagacggctgaagcgcacagccagacggcgctataccagacggcgcaacagaatcctttacctgcaggaaattttctctacagagatggcgaccctcgatgacgctttctttcaacggctggatgacagcttcctggtcccggatgacaaacgcgattccaagtatcccatctttgggaatctcgtggaagagaaagcctaccacgacgaatttcctacgatctatcatctgagaaagtaccttgccgattctaccaagaaagctgacctgcggctcgtttacctggcccttgctcacatgattaagtatcgcggacattttctgatcgagggcgagttcaacagcaaaaataacgatattcagaagaattttcaggacttcctcgacacatacaacgccatctttgaatccgatctgagcctggaaaattctaaacagctcgaagagattgtgaaggacaaaatctccaagctggagaagaaagatcggattcttaagctgttccccggcgagaaaaacagcgggatcttttctgagttcctcaagctgatcgtcggaaatcaagcggacttcagaaaatgctttaaccttgatgaaaaggcctccctgcacttcagcaaggagtcttatgacgaagatctcgagaccctgctgggctacattggggacgattattccgacgtgtttctcaaagctaagaaactgtacgatgccatccttctgagcggattcctcacagttaccgacaatgagacggaagctcctctgtcctctgccatgattaagcgctataacgagcataaagaagaccttgcgctgctcaaggagtacatcagaaacattagcctgaagacatacaatgaagtgtttaaagatgacaccaagaacggctatgccgggtacatcgatggaaaaacaaatcaggaggacttctatgtctacctgaagaaactcctggctgagtttgaaggcgccgattatttccttgagaagatcgaccgggaagattttctgagaaagcagcgcaccttcgacaacggctccattccctaccagatccacctccaagagatgcgggctattctggataaacaggccaagttttatcctttcctggccaaaaataaggaaagaatcgagaaaattcttacctttcgcatcccgtactacgtggggcccctcgctcggggaaacagcgacttcgcgtggtctatcagaaagcgcaatgagaaaattacaccttggaacttcgaagatgtgatcgacaaggagtccagcgccgaggcttttattaatcggatgacgtctttcgatctgtatctgcccgaagagaaggtcctccctaaacacagcctgctttacgaaacctttaacgtttataatgagctgacaaaggtgagattcatcgccgaatccatgcgcgactaccagtttctcgactctaaacagaagaaagatattgtgcggctgtatttcaaggacaagagaaaagtcaccgataaggacatcattgagtacctgcatgccatctatggctacgatgggatcgaacttaaaggaattgagaagcaatttaacagctccctcagcacataccacgacctgctgaatatcattaacgataaagagttcctcgacgattcttccaatgaagctatcattgaggaaatcatccataccctgacgatttttgaggaccgcgaaatgatcaagcagcggcttagcaagttcgagaacatttttgataaatctgtgctgaagaaactctccagacggcactatacaggctgggggaagctgagcgccaaactgatcaacgggattcgcgacgagaagtccggcaataccatccttgattacctcatcgacgacggcatttctaacagaaatttcatgcagctgatccacgatgacgcgctgagctttaagaaaaagattcaaaaagctcagatcattggggatgaagacaagggaaacatcaaagaggttgtgaagtccctccccggctctccggccatcaaaaaggggattctgcagagcatcaagattgtcgatgaacttgtgaaagttatgggaggccggaagcctgagtccatcgtggtcgaaatggccagagagaatcagtataccaaccaagggaaaagcaattctcagcagcgcctgaagcggctcgagaaatccctgaaggaactgggcagcaagattcttaaagagaacatccccgctaagctctctaaaattgacaataacgccctgcagaatgatagactgtacctctattacctgcaaaacggaaaggacatgtatacaggcgatgaccttgatatcgaccgcctgtccaattacgacatcgatcatattatccctcaggctttcctcaaagacaacagcattgataataaggtgctggtctctagcgcctccaacagaggaaagagcgacgatgtgccctctctggaagttgtgaaaaagcggaaaaccttctggtaccagcttctgaagtccaaactcatcagccagcgcaagtttgacaacctgacaaaggcggagagaggaggcctctcccccgaggataaagccgggttcattcaacggcagctggtcgaaacgcgccagatcaccaagcacgtggctagacttctggacgagaaatttaataacaagaaagatgaaaataaccgggccgttcgcacagtgaagatcattaccctcaagtctacactggtcagccagttcagaaaagactttgagctgtataaggtgcgggaaatcaatgatttccatcacgctcatgacgcctaccttaacgcggtggttgcctccgctctgctcaaaaagtatcctaaactggagccggagtttgtctacggagattatcccaagtacaattctttccgcgaaagaaaaagcgccaccgagaaggtgtatttttactccaacattatgaatatcttcaagaaatctattagcctcgctgacggccgggtgatcgaaagacctctgatcgaggtcaacgaagagacgggggagtccgtgtggaataaggaaagcgaccttgccaccgttcgccgggtgctgtcttacccccaagtcaacgtggttaaaaaggtggaggaacagaatcacggcctcgatagaggaaaacctaagggcctgtttaacgccaatctgtccagcaagcccaaaccgaactctaacgagaatcttgtcggggctaaggaatatctggaccctaaaaagtacggaggctatgcggggatttccaacagcttcacagtgctcgttaaaggaaccatcgagaagggcgccaagaaaaagattacaaatgtgctggagttccaggggatctctattctcgatcgcatcaactaccggaaagacaagctgaattttcttctggaaaaaggctataaggatattgagctgatcatcgaactccccaagtactccctgttcgagcttagcgacggatccagacgcatgctggctagcattctctctaccaacaataaacggggcgagatccacaaggggaaccaaatttttctgagccagaaattcgtcaagctcctgtatcatgccaaaagaatctccaatacgattaacgaaaatcaccgcaagtacgtggagaaccataaaaaggaatttgaggaacttttctactatatcctggagtttaatgagaactacgtgggagccaagaaaaatggcaagctgctcaactctgctttccagagctggcagaatcactccatcgatgaactgtgttctagctttattgggcctacaggatccgagcggaaaggccttttcgaactgacctctagagggagcgccgcggactttgagttcctcggcgtcaagatcccccggtatcgcgattacacaccttccagcctgctcaaagacgctaccctgattcaccaatctgttaccggactttatgaaacaagaatcgatctggccaagctgggcgaggggtga

SEQ ID NO: 3706 - RNA, 3249 nt, synthetic construct
  misc_feature 1..3249: note = Cas9 variant
  source 1..3249: mol_type = other RNA
atggccgctttcaagcccaacagcatcaattacattctgggcctcgacatcgggattgcctccgtgggatgggcgatggtcgagatcgatgaagaggaaaaccctattagactgatcgaccttggcgttcgggtgtttgagcgcgctgaagtgccgaaaaccggggattctctggccatggccagacggctcgctcgcagcgtcagacggctgacacgcagacgggcccaccgccttctgagaacgcggcgcctcctgaagagagagggagtgctgcaggctgccaatttcgacgagaacggcctcatcaaatccctgcccaataccccttggcaacttcgggcggccgctctggatcgcaagctcacacccctggaatggtctgccgttcttctgcatctcattaaacacagagggtatctgagccagcggaagaacgagggagaaaccgctgacaaggagctgggcgccctcctgaaaggcgtggcggggaatgcccatgcccttcagacaggagattttagaacccctgctgagctggctctcaacaagttcgaaaaagagtccggccacatccgcaatcagcggtctgactacagccatacattttccagaaaggatctgcaagccgaacttattcttctcttcgagaaacagaaggaatttgggaacccccacgtcagcggaggcctgaaggaggggatcgagaccctgctcatgacgcagcgccctgccctgtctggagacgctgtgcagaaaatgcttggccactgcaccttcgaaccggcggagcccaaggccgctaaaaatacatataccgccgaacggtttatttggctgacaaagctcaacaatctgagaatccttgagcaaggctccgaacgccctctgaccgatacggagcgggccacactcatggacgagccctacagaaaaagcaagctgacctatgctcaggcccgcaaactgctcgggctggaagatacagcgttctttaagggacttcggtacggcaaggacaacgctgaggcctctaccctgatggaaatgaaagcctatcatgctatttccagagccctcgagaaggaagggctgaaagacaagaaaagccctctgaatctttctcccgagctccaggatgagatcggaaccgctttctccctgtttaagacagacgaagatatcacgggccgcctgaaggaccggattcagccggagatcctcgaagccctgcttaaacacattagcttcgataagttcgttcaaatctccctgaaagcgctcagacggattgtgcctctgatggagcaggggaagcgctacgacgaggcctgtgctgaaatctacggagatcattatggcaaaaagaacaccgaggaaaagatctacctgccccctattcccgccgacgagatcagaaaccccgtcgtgcttcgggctctctctcaggccagaaaagtgattaatggcgtcgttcgccggtatgggagccctgcgagaatccacattgaaacagcccgcgaggtgggaaagtcctttaaagatagaaaggagatcgaaaaacggcaagaggaaaaccgcaaggacagagagaaggctgccgctaaattccgggaatactttccgaatttcgtgggcgagcccaagagcaaagatatcctgaagctgcgcctctatgagcagcagcacgggaaatgcctgtactctggaaaggaaattaaccttggcagactgaatgagaaagggtatgtcgaaatcgaccatgccctccctttttcccggacctgggacgatagcttcaacaataaggtgctggttctgggctctgagaaccagaataagggaaaccaaacaccctacgaatactttaatggcaaagacaacagccgcgagtggcaggagttcaaggccagagtggaaacctcccggtttcctcgctctaaaaagcagcggattcttctccagaaattcgatgaggacgggtttaaggaaagaaatctgaacgatacgagatatgtcaatcgcttcctgtgtcaatttgtggctgaccggatgagactcacaggaaagggcaaaaagcgcgttttcgcgagcaacgggcagatcaccaacctgcttcggggattctggggcctgagaaaagtgcgcgccgagaatgatcggcaccatgctctcgacgccgtcgtggtcgcctgctccaccgtggctatgcagcagaagattacaagatttgttcgctacaaagagatgaacgccttcgatgggaagaccatcgacaaggaaacaggcgaggtgctgcaccagaaaacgcattttccccagccgtgggagttctttgcgcaggaagtcatgattcgggtgttcggaaagcctgatggcaaacccgaatttgaggaggctgacaccctggaaaagctgagaacactcctggccgagaaactgagctctcggcctgaagccgttcacgagtatgtgacacccctcttcgtctcccgcgctcctaatagaaagatgagcgggcagggacacatggaaaccgtgaagtctgccaaacggctggatgagggcgtgtccgttcttcgcgtccccctgacccaactcaagctgaaagacctggagaagatggtgaacagagaacgggagccgaaactttacgaagcgctgaaggctagactcgaggcccataaagacgatcctgccaaggcttttgccgaacccttctataagtacgacaaagctgggaatcgcacgcaacaggtgaaggccgtccgggtggagcaagttcagaaaaccggagtgtgggtcagaaaccacaatggcatcgcggataacgccacaatggtgcgcgttgacgtgtttgagaagggggataaatattacctggtccccatctacagctggcaagtggctaagggcattctccctgaccgggccgttgtgcagggaaaggatgaagaggactggcagctgatcgatgactccttcaattttaaattctctcttcatccgaacgatctggtcgaagtgattaccaagaaagctagaatgttcggctattttgccagctgtcaccgcgggacaggaaatatcaacattcggatccacgacctcgatcataagatcggcaaaaatgggattctggagggaatcggcgtgaagaccgccctgtccttccagaagtaccagattgacgagcttgggaaagaaatcagaccctgccgcctgaagaaaagacctcccgtccggtga

SEQ ID NO: 3707 - RNA, 4005 nt, synthetic construct
  misc_feature 1..4005: note = Cas9 variant
  source 1..4005: mol_type = other RNA
atgaagaaaccctacaccatcggcctggacattgggacaaacagcgtgggatgggccgtcctcacggatcagtatgacctggttaagagaaaaatgaagatcgctggcgattccgagaaaaagcaaattaagaaaaatttctggggagtgcggctttttgacgaagggcagaccgccgcggatcgcagaatggctcggacagcccgcagacggatcgagcgcagacggaaccgcatttcttacctgcagggcatcttcgccgaagagatgagcaagaccgacgctaatttcttctgcagactctccgattctttttatgtggacaacgaaaaacggaatagccgccaccctttctttgccacaatcgaggaggaagtcgagtaccataagaactatccgaccatttaccacctgagagaggaacttgttaattcctctgagaaagctgatctgcggctcgtgtatctggccctggcgcatatcattaagtaccgcgggaacttcctcatcgaaggagccctggacacacagaataccagcgtggatggcatttacaagcaatttatccagacgtataaccaggtcttcgcttccggcattgaggacgggagccttaaaaagctggaagataataaagacgtggccaagatcctcgttgagaaagtgaccagaaaggaaaaactggagcggatccttaagctgtaccccggagagaagtctgctggcatgtttgcccagttcatttccctcatcgtcgggagcaaaggaaactttcaaaagcctttcgacctgattgaaaaatctgatatcgagtgtgcgaaggactcctatgaagaggatctggaaagcctcctggcccttattggcgacgagtacgctgagctgttcgtggccgctaaaaatgcctattctgccgtggtcctctccagcatcatcacagttgctgaaaccgagacaaacgcgaagctgtccgcctctatgattgaaagatttgatacccacgaggaagaccttggggagctgaaggctttcatcaaactccatctgcccaagcactacgaggaaatttttagcaatacggagaaacacggatatgccggctacatcgatggcaagacaaaacaggccgacttctacaagtatatgaagatgaccctggaaaacattgagggggctgattactttatcgccaaaatcgagaaggaaaacttcctccgcaaacagcggacatttgacaatggagcgattcctcatcagctgcaccttgaggaactggaggctatcctccatcaacaggccaagtattaccccttcctgaaagaaaactatgataagattaagtcccttgtgacctttagaatcccttacttcgtgggcccgctggccaatgggcagagcgagtttgcttggctcacccgcaaagccgacggagagattcggccctggaacatcgaagagaaggtcgacttcggcaaatctgctgtggattttattgaaaagatgacaaataaagacacgtatctgcctaaggagaacgttctgcccaaacactccctctgctaccaaaagtacctggtgtataatgaacttaccaaggtcagatacatcaacgatcaggggaaaacaagctatttctctggacaggagaaggagcagatcttcaatgacctgtttaaacaaaagcgcaaagtgaagaagaaagatctcgaactgttcctgcggaacatgagccacgttgagtcccctaccattgaaggccttgaggactcttttaatagctcctacagcacatatcatgatctcctgaaggtgggcatcaaacaggaaattctggacaaccccgtcaataccgagatgctcgagaacatcgtgaagattctgacggtcttcgaagataaaagaatgatcaaggagcagcttcagcaattttctgacgtgctggatggggttgtgctcaagaaactggaacgccggcactacacaggatggggcagactgtccgccaagctcctcatggggatccgcgacaaacagagccatctgaccattctggattatctcatgaatgacgacggactgaaccggaaccttatgcagctgatcaatgattctaacctctccttcaagagcattatcgagaaagagcaggtcaccacagcggacaaggatattcaatccatcgtggccgacctggctggctctccggccatcaagaaagggattctgcagagccttaagatcgttgatgaactcgtgtccgtcatgggctaccctccccagaccattgtggtggagatggctagagaaaatcagacaacgggaaaaggcaagaacaattctcggcctcgctacaaaagcctggagaaggccatcaaagaatttgggtcccaaattctgaaggagcaccccaccgacaaccaggagctcagaaataaccggctgtatctttactatctgcagaatggaaaggatatgtacacaggccaagacctcgatatccataacctgagcaattatgacatcgatcacattgttccccagtctttcatcaccgacaactccattgataatctggtccttacaagctctgcggggaacagagaaaaaggagacgacgtgcctccgctcgagatcgtgcgcaagcggaaagtcttttgggaaaagctgtaccagggcaatctgatgtccaaaagaaagttcgattatctcaccaaggccgagcgcgggggcctgacggaagctgacaaagccagatttattcaccggcagcttgtggagacccgccaaatcacaaagaacgttgctaacattctgcatcagagattcaattacgagaaagatgaccacggaaacaccatgaaacaggtgcggatcgtcacactcaagagcgccctggtgtctcagtttcgcaagcaattccagctgtacaaggttagagatgtgaatgactatcatcacgcccacgatgcttaccttaacggcgtcgtggcgaataccctgctcaaagtttatccccagctggaacctgagttcgtgtacggggactatcatcagtttgattggttcaaggccaacaaagctacggccaagaaacaattttacacaaatatcatgcttttctttgcccagaaggaccggattatcgatgaaaacggagagattctgtgggacaagaaatatcttgacaccgtcaagaaagtgatgagctaccgccagatgaatatcgtgaagaaaacagaaattcaaaagggcgagttctccaaggctaccatcaaacccaaggggaacagctctaaactgatccctagaaagaccaattgggatcccatgaaatacggaggcctcgactccccgaacatggcctatgcggtcgttattgagtacgctaaggggaaaaataagctggtgtttgaaaagaaaatcattcgggtgacaatcatggagcgcaaggccttcgaaaaagatgagaaggcctttctggaggaacagggctatagacagcctaaagtccttgctaagctgcccaagtacacgctctatgagtgtgaagagggacggagacgcatgctggccagcgcgaacgaagctcagaaaggcaatcaacaggtgctccctaaccacctggttacccttctgcatcacgccgccaactgcgaggtgtccgacgggaagtctctcgattacattgagagcaatcgggaaatgttcgctgagctgctggcccatgtctccgaatttgctaaaagatatacacttgccgaggcgaacctgaataagatcaaccagctctttgaacagaataaagagggagacatcaaggccattgctcaatctttcgtggatctgatggcctttaacgctatgggcgcccccgccagcttcaagtttttcgagaccacaatcgaacgcaaacggtacaataacctcaaggagctgcttaattccaccattatctaccagtctattacggggctgtatgaaagcagaaaacgcctggacgattga

SEQ ID NO: 3708 - RNA, 4038 nt, synthetic construct
  misc_feature 1..4038: note = Cas9 variant
  source 1..4038: mol_type = other RNA
atgaagaaaccctacagcatcggcctggacattgggaccaactccgtgggatgggccgtcgttacagatgactataaggtgcctgctaaaaagatgaaagtgctcggcaatacggataagtctcacatcgagaagaacctgcttggggcccttctcttcgacagcggaaataccgcggaagatagacggctgaaacgcacagctagacggcgctacaccagacggcgcaaccggattctttatctgcaggagatcttttccgaagagatgggcaaggtcgacgattctttctttcatcggctcgaagacagcttcctggtgacagaggataaacgcggggagagacacccgatttttggaaatctggaagaggaagttaagtaccatgagaacttccccaccatctatcacctccggcaatacctggccgacaatcctgagaaagtggatcttcgcctggtctatctcgccctggctcatatcattaagtttagaggccacttccttatcgaaggcaagtttgacacacggaacaatgatgtgcagcgcctgttccaggagtttctcgccgtttacgacaacaccttcgaaaattcctctctgcaggagcaaaacgtgcaggtcgaagagattctgacggacaaaatcagcaagtccgctaaaaaggatagagtgctcaaactgtttcccaatgaaaagagcaacgggcggttcgccgagttccttaaactgattgtgggaaatcaggcggactttaagaagcacttcgagctcgaagagaaagcccctctgcagttttctaaggatacctacgaagaggagcttgaagtcctgctcgctcaaatcggcgacaactatgccgagctgttcctgtccgctaaaaagctctacgatagcattctgctttctgggatcctgacagttaccgacgtgggaacaaaagcgcccctctccgccagcatgatccagagatataacgaacatcagatggatctggcccagcttaagcaatttattcgccagaagctgtctgacaaatacaatgaggtgttctccgatgtcagcaaggacggctatgctgggtacatcgatggaaaaaccaaccaggaagccttttataagtacctcaaaggcctgctgaataagattgagggctccgggtacttcctcgacaagatcgagcgggaagactttctgagaaaacaacgcacgttcgataacggatctattcctcaccagatccatcttcaggagatgcgggctatcattagacgccaggccgaattttatccgttcctggccgacaatcaagatcggatcgagaagctcctgacatttcgcattccctactatgtgggccctctggctagagggaaaagcgacttcgcgtggctttccagaaagagcgccgataaaatcaccccctggaacttcgacgagattgttgataaggaatcttccgctgaggcctttatcaatagaatgacaaactacgacctctatctgcctaatcagaaggtgctgcccaaacacagcctcctgtacgaaaagttcaccgtctataacgagcttaccaaagtgaagtacaaaacagaacagggaaagacggcctttttcgatgctaatatgaaacaggagatctttgacggcgttttcaaggtgtaccgcaaggtcaccaaagataagctgatggactttctcgagaaagagttcgatgaatttcggattgtggacctgacagggctggacaaggaaaacaaagtcttcaatgcctcttatggaacctaccacgatctttgcaagatcctcgacaaggattttctggacaacagcaaaaatgagaagattctggaagatatcgtgctcacactgacccttttcgaggacagagagatgattcggaaacgcctggaaaactattccgatctcctgacgaaggagcaagttaaaaagctggaaagacggcattacacaggctggggcagactttctgcggagctcatccacgggattcgcaacaaggaaagccggaaaaccatcctggactatctgatcgatgacggaaattccaacagaaattttatgcagctcattaacgatgacgctctgagcttcaaggaggagatcgccaaagcccaggtgattggcgaaaccgataatcttaaccaggtcgtgtctgacatcgctgggtccccggccattaagaaaggaatcctgcaaagcctcaagatcgttgacgagctggtgaagattatgggccatcagcctgaaaatatcgtcgtggagatggctcgcgagaaccagttcacaaatcaggggagacggaactctcaacagcgcctgaaaggccttaccgattccattaaggaatttggaagccagatcctcaaagagcaccccgtggaaaattcccaactgcagaacgacagactgttcctctactatctgcagaatggccgggatatgtacacaggggaggaacttgacattgattacctgtctcagtatgacatcgatcatatcattcctcaagcctttatcaaggacaacagcattgataatcgcgttctcacgtcctctaaagagaacagaggaaagagcgacgatgtcccctccaaagacgtggtgcggaagatgaaaagctactggtctaaactgctgtccgcgaagctgatcacccagcgcaaattcgacaacctgacaaaggccgagagaggcgggctcaccgatgacgataaagctggatttattaagcggcagctggtcgaaacacgccagatcaccaagcacgtggccagaatcctcgacgagcggttcaatacggaaaccgatgagaacaataaaaagattagacaagttaaaatcgtgacacttaagagcaacctggtctctaattttcgcaaagagttcgaactgtataaggtgcgggagattaacgactaccaccatgctcacgatgcctatctcaatgcggttatcggcaaggccctgctgggggtgtacccccagcttgaacctgagtttgtctatggcgactacccgcatttccacggacacaaagaaaacaaggctaccgccaaaaagtttttctactccaatattatgaacttctttaaaaaggatgacgtgagaacagataagaatggcgagatcatttggaaaaaggacgaacatatcagcaacatcaaaaaggttctgtcttatccccaggtgaatattgtcaaaaaggtggaggagcagaccgggggattcagcaaggaatccatcctccctaaaggcaacagcgataagctgattccccgcaaaacgaagaaattttactgggacacaaagaaatatgggggattcgactctcctatcgtggcttactccattctcgtcatcgccgatatcgagaagggcaagagcaaaaagctgaaaaccgttaaggcccttgtgggggtgacaattatggaaaagatgacctttgagcgggaccccgtcgctttcctggagagaaagggctatcgcaatgtgcaagaagagaacatcattaagctcccgaaatactccctgtttaagctggaaaacggacggaaaagacttctggcgtctgcccgcgagctccagaagggcaatgaaatcgttctgcctaaccacctcgggaccctgctttatcatgctaaaaatattcacaaggtggatgagcccaagcatctggactacgtcgataaacacaaggacgagttcaaagaactgctcgatgtggttagcaacttttccaagaaatacacactggccgagggaaatcttgaaaagatcaaggagctgtatgcccagaacaatggcgaagacctcaaagagctggcttctagcttcatcaacctcctgacgtttaccgccattggggcgcctgctacattcaagtttttcgataaaaatatcgaccggaagagatacacctccacaaccgagattcttaacgccacgctgatccaccaatctattacaggactgtatgaaacccggatcgatctcaataaactgggcggggactga

SEQ ID NO: 3709 - RNA, 3171 nt, synthetic construct
  misc_feature 1..3171: note = Cas9 variant
  source 1..3171: mol_type = other RNA
atgcagaccacaaacctgagctacatcctcggcctggaccttgggattgcctccgtgggatgggctgtcgttgagatcaatgaaaacgaggatcccattggcctgatcgacgtgggggtgagaattttcgaacgggccgaggtccctaagacgggagaatctctcgcgctgagccgcagacttgctcggtccacccgcagactgatccggcgcagagcccaccggctcctgctggccaaacgctttctcaagagagagggcatcctgtctacaattgatcttgagaaagggctgccgaatcaggcttgggaactccgggtggccggactggagcgcagacttagcgctatcgaatggggcgccgttctgctccatctgattaagcaccggggctatctgtccaaacgcaagaacgagtctcagaccaataacaaggagctcggggcgctgcttagcggagtggcccagaatcatcagctgctccaatccgacgattacagaacacccgctgaactggcccttaaaaagttcgctaaagaggaaggccacatccggaaccagagaggggcctatacccatacatttaatcgcctggacctcctggcggagctgaacctcctgttcgcccagcagcaccaatttggaaatcctcactgcaaggaacatattcagcagtacatgaccgagcttctgatgtggcagaaacccgctctcagcggcgaggccatcctgaagatgcttgggaagtgtacgcacgaaaagaacgagttcaaagctgccaaacatacctattctgccgaacggtttgtctggctgacaaagctcaataacctgcgcattctggaggatggagctgaaagagcgctcaatgaggaggaacggcaactgcttatcaaccacccttacgagaaatccaagctgacctatgcccaggtgagaaaactcctgggcctgagcgaacaggctatcttcaagcaccttcgctactctaaggagaacgccgaatccgccacatttatggagctcaaggcttggcatgccattcggaaagcgctggagaatcaaggcctgaaagacacctggcaggatctcgctaagaaacccgacctgcttgatgaaatcgggacggccttcagcctgtacaagacagacgaggatattcagcagtatctcaccaacaaggttcctaattctgtgatcaacgccctgctggtctcccttaattttgacaaattcattgaactcagcctgaagtccctgagaaaaatcctcccgctgatggagcaaggaaagcgctacgaccaggcttgccgggagatctatggccaccattacggggaagccaaccagaaaacatctcagcttctgcccgctattcctgcccaagagatcagaaatcccgtggtgctccgcaccctgagccaggcgcggaaggtcattaacgccatcattagacagtatggatcccctgctcgggttcacatcgaaaccggccgcgagctggggaagtcctttaaagaaagacgggagatccagaagcaacaggaggataatagaacaaaacgcgaatctgccgtgcagaagttcaaagagcttttctccgactttagctctgaacccaagagcaaggatattctcaaattccggctgtacgagcagcaacatggaaagtgtctgtattccggcaaagaaatcaacattcacagactcaatgagaagggctacgtggagatcgaccacgctctgccgttttctcgcacgtgggatgacagcttcaacaataaagtccttgtgctggcctccgaaaaccagaataaggggaaccagaccccttacgagtggctccaaggaaaaattaacagcgaaagatggaagaattttgttgcgctggtgctgggctctcagtgctccgccgctaagaaacagcggcttctcacacaggtcatcgatgacaacaagttcattgatcgcaatctgaacgacaccagatatatcgcccggtttctgagcaattacatccaagagaacctcctgcttgtggggaaaaataagaaaaacgttttcacacccaatggacagattaccgctctgctccgctctagatggggcctgatcaaggcccgggaaaacaataaccgccatcacgccctggatgctattgtggtcgcgtgtgccacgccttccatgcagcagaagatcacaagatttattcggttcaaagaggtgcatccctataagatcgagaatcgctacgaaatggtcgaccaagagagcggggaaatcattagcccccactttcctgagccgtgggcttatttcagacaggaggtgaacatccgggtttttgacaatcaccccgataccgtgcttaaagaaatgctgcctgacagaccccaggccaaccatcagttcgtccaacctctcttcgtgtctcgcgcccccacccggaagatgagcggccagggacacatggagacaattaaatccgctaagagactggccgaaggcatctctgttctccgcattccgctgacccagcttaagcctaacctgctcgagaatatggtgaacaaagaacgggagcccgcgctgtacgctgggctgaaggccagacttgccgagtttaatcaagatcctgctaaagccttcgcgacacccttttataagcagggaggccagcaggtcaaagctatccgcgtggaacaagtgcaaaagagcggggttctggtccgggagaacaatggagtggccgacaacgcctccatcgtgagaacggatgtcttcattaagaataacaaatttttcctcgtgcctatctacacctggcaggttgctaagggcattctgcccaataaagccatcgtggctcataagaacgaagacgagtgggaagagatggatgagggggccaaatttaagttcagcctctttccgaatgacctggtcgaacttaaaacaaagaaggagtacttctttggctattacattggactggatcgcgcgaccggcaacatctctctcaaagaacacgacggggagatctccaagggaaaagatggcgtgtatcgggttggggtgaagctggccctgagcttcgaaaaataccaggtcgacgagcttggaaagaatagacaaatttgccggcctcagcagcgccagcccgtgagatga

SEQ ID NO: 3710 - RNA, 3249 nt, synthetic construct
  misc_feature 1..3249: note = Cas9 variant
  source 1..3249: mol_type = other RNA
atggccgctttcaagcccaaccctatcaattacattctgggcctcgacatcgggattgccagcgtgggatgggcgatggtcgagatcgatgaagacgagaacccgatttgcctgatcgatcttggcgttagagtgtttgaacgggctgaggtgcccaaaaccggggactccctggccatggcccgcagactcgctcggtctgtccgcagactgacacggcgcagagcccaccggcttctgcgcgctagacggctcctgaagcgcgaaggagtgctgcaggccgcggatttcgacgagaatggcctcatcaaaagcctgcctaacacgccctggcaacttagagccgctgccctggatcggaagctcacccctctggagtggtccgctgttcttctgcatctcattaaacaccgcgggtatctgtctcagagaaagaatgaaggagagacagccgacaaggaactgggcgcgctcctgaaaggcgtggccgataacgctcatgcccttcagaccggggactttcggacacccgctgagctggccctcaataagttcgagaaagaaagcggacacatcagaaaccagcgcggcgattactcccataccttttctcggaaggacctgcaagccgagcttattctcctgttcgaaaaacagaaggagtttgggaatcctcacgtcagcggaggcctgaaggaagggatcgagacactgctcatgacccagagaccggctctgtccggagatgcggtgcagaaaatgcttggccactgtacgttcgagcccgccgaacctaaggctgccaaaaacacctatacagccgagcgctttatttggctgaccaagctcaataacctgcggatccttgaacaaggcagcgagagacccctgacagacaccgaacgcgctacgctcatggacgagccttaccggaaatctaagctgacatatgcccaggcgagaaaactgctcgggctggaggataccgctttctttaagggacttcgctacggcaaggacaatgccgaagcctccacactgatggagatgaaggcttatcatgccattagccgggctctcgaaaaagaggggctgaaagataagaaatctcccctgaacctttccccggaactccaggacgagatcggaaccgccttcagcctgtttaagaccgatgaggacatcacaggcagactgaaggatcgcattcagcctgaaatcctcgaggcgctgcttaaacacatttctttcgacaagttcgttcaaatctccctgaaagccctccggagaattgtgcccctgatggaacaggggaagcggtacgatgaggcttgcgccgagatctacggagaccattatggcaaaaagaatacggaagagaagatctacctgcctcccattcccgctgatgaaatccgcaaccctgtcgtgcttagagccctcagccaggcgcggaaagtgattaacggcgtcgttagacgctatgggtccccggcccggatccacattgagaccgctagagaagtgggaaagtcttttaaagaccgcaaggagatcgagaaaagacaagaagagaatcggaaggaccgcgaaaaggccgctgccaaattcagagagtactttcccaacttcgtgggcgaacctaagagcaaagatatcctgaagctgcggctctatgagcagcagcacgggaaatgtctgtactccggaaaggagattaatcttggccgcctgaacgaaaaagggtatgtcgagatcgaccatgccctcccctttagcagaacatgggatgactctttcaataacaaggtgctggttctgggctccgaaaatcagaacaagggaaatcaaaccccttacgagtactttaacggcaaagataatagccgggaatggcaggagttcaaggctcgcgtggagacatctagatttccccggagcaaaaagcagcgcattcttctccagaaattcgacgaagatgggtttaaggagagaaacctgaatgacacccggtatgtcaacagattcctgtgccaatttgtggcggatcgcatgcggctcacgggaaagggcaaaaagagagttttcgcctccaatgggcagatcacaaacctgcttcgcggattctggggcctgcggaaagtgagagctgaaaacgaccgccaccatgccctcgatgccgtcgtggtcgcttgttctaccgtggccatgcagcagaagattacccggtttgttagatacaaagagatgaatgcgttcgacgggaagacaatcgataaggagaccggcgaagtgctgcaccagaaaacacattttccgcagccttgggagttctttgctcaggaagtcatgattcgcgtgttcggaaagcccgacggcaaacctgagtttgaagaggccgacacgcccgagaagctgcggacccttctcgccgaaaaactgagctccagacctgaggctgttcacgaatatgtgacacccctgttcgtcagccgggccccgaaccgcaagatgtctgggcagggacacatggagaccgtgaagtccgcgaaaagactcgatgaaggcgtgagcgttctgcgggtccctcttacacaactgaagctcaaagacctggagaagatggtgaatcgcgagagagaacccaaactgtacgaggctcttaaggcccggctggaagcccataaagatgaccccgctaaggcctttgctgagcctttctataagtacgataaagccgggaacagaacccaacaggtgaaggcggtccgcgtggaacaagttcagaaaacgggagtgtgggtccggaatcacaacggcatcgccgacaatgctaccatggtgagagttgatgtgtttgagaagggggacaaatattacctcgtcccgatctactcttggcaagtggccaagggcattctgcccgatcgcgctgttgtgcagggaaaggacgaggaagattggcagctcatcgacgattccttcaactttaaattcagcctgcatcctaatgaccttgtcgaggtgattacaaagaaagcccggatgttcggctattttgcctcctgccacagagggaccggaaacatcaatattcgcatccacgacctggatcataagatcggcaaaaacgggattctcgaaggaatcggcgtgaagacagctctgtctttccagaagtaccagattgacgagctggggaaagagatccggccctgtagacttaagaaacgccctcccgtcagatga

SEQ ID NO: 3711 - RNA, 3255 nt, synthetic construct
  misc_feature 1..3255: note = Cas9 variant
  source 1..3255: mol_type = other RNA
atgaagtaccacgtgggcatcgacgtcgggaccttcagcgttggactggccgctattgaggtggatgacgccggcatgcccatcaaaacactctccctggtgtctcatattcacgatagcgggcttgaccctgatgaaatcaagtccgcggtcacgagactggcttctagcggaattgcccggcgcaccagacggctctatcgcagaaaacggcgcagactgcagcaacttgacaagtttatccagcggcagggctggccggtgatcgagctggaagattactccgaccccctctatccttggaaagttcgcgccgagctggctgcctcttacattgctgatgaaaaggagagaggggagaagctgagcgtggccctccggcatatcgcgcgccacagaggatggcggaacccctatgccaaagtctccagcctgtaccttcctgacggcccctctgatgctttcaaggccattcgcgaagagatcaaaagagcttccggccagcctgtgccggaaacagccaccgttgggcaaatggtgacactgtgcgagctcggaaccctgaaacttcggggcgaagggggagtcctgagcgcgagactccagcagtctgactatgcccgcgaaattcaggagatctgtcggatgcaagaaattggccaggagctgtacagaaaaatcatcgatgtggtgtttgctgccgaatcccccaaggggagcgcttcttcccgcgtcggaaaggaccctctgcagcccggcaaaaatcgggccctcaaggccagcgacgctttccagagataccgcattgcggccctgatcggcaaccttcgggttagagtggatggggagaaacgcattctgtccgtggaggaaaagaatctcgtctttgaccatctggtgaaccttacacctaaaaaggagcccgaatgggttaccatcgctgagattctgggaatcgatcggggccaactcatcgggacggccaccatgacagacgatggagaaagagccggcgctcgcccgcctacccacgacacaaatcggtctattgtgaacagcagaatcgctcccctggtcgattggtggaaaaccgcgtccgctctggagcagcacgccatggtgaaggccctcagcaatgctgaggttgacgatttcgactctcctgaaggggccaaggtgcaggcctttttcgccgatctggacgacgatgtccatgcgaaacttgactccctgcacctccccgtgggacgggccgcttatagcgaggatacgctggtccgccttacaagacggatgctgtctgacggcgtggatctctacaccgccagactgcaagaatttggcattgagcccagctggacacctccgacaccccgcatcggggaacctgttggaaaccccgctgtggaccgggtcctgaagaccgtgtccagatggctcgagtctgccaccaaaacgtggggcgcgcctgagcgcgttattatcgaacatgtgagagaggggttcgtcaccgaaaagcgggcccgcgagatggatggagacatgagacggcgcgctgccagaaatgctaaactgtttcaggagatgcaggaaaaacttaacgtgcagggcaagcccagccgggccgatctgtggcgctatcaatccgtgcagagacagaattgccagtgtgcctactgcgggagcccgatcacattctctaactccgagatggaccacattgttcctcgggctggccaaggaagcaccaatacacgcgaaaacctcgtcgcggtgtgtcacagatgcaatcagtctaaaggcaacaccccctttgccatctgggctaagaacacgtccattgagggggtgagcgtcaaagaagccgtggagcggacaagacattgggttaccgataccggaatgcgctccacagacttcaagaaattcaccaaggccgtggtcgagcggtttcagagagctacaatggatgaagagatcgacgcccgctctatggaaagcgtggcgtggatggctaatgagctgcggtccagagttgcccagcacttcgcctctcatggcacgaccgtgcgcgtctatcgggggagcctgacagctgaagccagacgcgcgtccggaattagcggcaaacttaagtttttcgacggggtgggcaagtctcggctcgatagacggcaccatgctatcgacgccgccgttattgcttttacctccgattacgtggccgagacactggctgtccgcagcaacctgaaacaatctcaggcccacagacaggaggcgcctcagtggcgggagttcaccggaaaggacgccgagcaccgcgctgcctggagagtgtggtgtcaaaagatggaaaagctctccgctctgcttacggaggatctgcgggacgatagagtggtcgttatgagcaatgtgcgcctccggctgggcaacgggtctgcccataaggaaaccatcggaaaactgagcaaggtgaaactttccagccagctctctgtctccgacatcgataaggccagctccgaggctctgtggtgcgcgctgacaagagagcccggctttgaccctaaagaagggctccccgccaatccggagcgccacattcgggtgaacggaacccatgtttatgctggcgataatatcgggctgttccctgtgtctgccggcagcattgcccttagaggaggctacgctgaactggggtcctcttttcaccacgcccgcgtctacaagatcacaagcggaaagaagcccgcgttcgctatgctccgggtgtataccattgacctgctgccctacagaaaccaggatctcttttccgttgagcttaagcctcaaacgatgtctatgcgccaggccgagaaaaagctgagagacgccctggctacaggcaatgccgaatatctcgggtggctggtggtcgacgatgagcttgtggttgacaccagcaaaatcgcgacagatcaggtgaaggctgtcgaagccgagctgggaaccatccggcgctggagagtggacggcttcttttccccgagcaaactccggctgcgccccctgcagatgtctaaggaagggattaagaaagagtccgcccctgagcttagcaagatcattgatagacccggctggctccctgctgtgaacaaactgttctctgacggaaatgtcaccgttgtgcggagagattccctgggccgcgtgcggctcgaaagcacagcccatctgcccgtcacgtggaaggtgcaatga

SEQ ID NO: 3712 - RNA, 2955 nt, synthetic construct
  misc_feature 1..2955: note = Cas9 variant
  source 1..2955: mol_type = other RNA
atggccagaatcctggctttcgacattggcatcagctccattgggtgggccttttctgagaacgatgaactcaaggactgcggagtgcggatcttcaccaaagtcgagaatcccaagacaggcgaaagcctggcgcttcctcgcagactggctcggtccgcccgcaaaagactcgcccggcgcaaggctagactgaaccaccttaaacatctgattgccaatgagtttaagctcaactacgaagattatcagtctttcgacgagagcctggctaaggcctacaaagggtccctgatctctccgtatgagctccggtttcgcgcgctgaatgaacttctgagcaagcaagatttcgccagagttatcctccacattgctaaacggcgcggatacgacgatatcaagaactccgacgataaagagaagggcgccattctgaaggctatcaaacagaatgaagagaaacttgccaactatcagagcgtgggggagtacctgtataaagaatactttcagaagttcaaagaaaattctaaggaatttacgaacgtgagaaataaaaaggagtcctacgaacggtgtattgcgcagagcttcctcaaggacgagctgaaactgatctttaagaaacaacgcgagttcggattttctttctccaagaaattcgaagaggaagtcctcagcgtggccttttataagagagctctgaaggatttctctcatcttgttggcaactgctcctttttcaccgacgagaaacgggcccccaagaatagccctctggcttttatgttcgtggccctcacaagaattatcaacctgcttaataacctgaaaaacaccgaaggcatcctctacacaaaggatgacctgaatgccctgctcaacgaggtcctgaaaaatgggacccttacatataagcagaccaagaaactgctcggactgtccgacgattacgagtttaagggcgaaaaagggacgtatttcattgagtttaagaaatacaaggagttcatcaaggctcttggagagcacaacctgtctcaggacgatctcaatgaaattgcgaaagacatcaccctgattaaggatgagatcaaactgaagaaagccctcgctaagtatgacctgaaccaaaatcagatcgatagcctttccaaactggagtttaaggaccatctcaacattagcttcaaggccctgaaactggtgacaccccttatgctcgaaggcaagaaatacgatgaggcctgtaatgaactgaacctgaaggttgctatcaatgaggacaaaaaggattttctccctgccttcaacgagacctactataaggacgaagtgacaaatcccgtcgtgctgcgcgcgattaaagagtaccggaaggtgcttaacgctctgctcaaaaagtatgggaaagtccacaagatcaatattgaactggccagagaggttggaaagaaccactctcagcgcgccaaaatcgaaaaggagcagaacgagaattacaaagctaagaaagacgccgaactggagtgcgaaaaacttggcctcaagatcaactccaaaaatattctgaagctgagactcttcaaagagcaaaaggaattttgtgcttatagcggcgagaaaatcaagatttctgatctgcaggacgagaaaatgcttgaaatcgatcatatttacccttatagccggtccttcgacgattcttacatgaacaaggtgctggtgtttaccaagcagaatcaagagaaactcaaccagacgccgttcgaagcctttgggaatgacagcgcgaagtggcagaaaatcgaggtcctggccaagaacctgcccacaaagaagcagaagcgcattcttgataaaaattacaaggacaaagaacaaaagaacttcaaagatcggaatctcaacgacaccagatatatcgctcgcctggtgctgaattacacaaaggattatctcgactttctgcctctttccgatgacgagaacaccaagctgaatgacacccagaaaggaagcaaggttcacgtggaggccaaatctggcatgctcacatccgctctgcggcatacgtgggggttcagcgccaaggatagaaacaaccatctgcaccacgcgatcgacgccgtcattatcgcttacgccaataactctattgtgaaggctttttccgatttcaagaaggaacaggagagcaattccgccgaactttatgccaaaaagatctctgagctcgactacaaaaacaagcgcaaatttttcgagccctttagcggattccggcagaaggttctggataagattgacgaaatcttcgtgtccaaacctgagagaaagaaaccctctggcgctctgcacgaagagacctttcggaaggaagaggagttctatcaaagctacgggggaaaagaaggcgtcctcaaggcgctggagcttggcaaaatccgcaaggtgaatgggaagattgtcaaaaacggagatatgtttagagtggacatcttcaagcataaaaagacaaataaattttacgccgttccgatttataccatggatttcgctctgaaggtgctccctaacaaggccgtcgcccggtccaaaaagggcgaaatcaaagactggattctgatggatgagaattacgaattttgcttcagcctgtataaggactctcttatcctgatccagacaaaagatatgcaggagcccgagtttgtgtactataacgctttcacctccagcacggtttctctcattgtgtccaagcacgacaataagtttgaaacactgagcaaaaaccagaagatcctcttcaaaaatgccaacgagaaggaagtcattgcgaaatctatcgggattcaaaatctgaaggtgttcgagaagtacatcgtgagcgctcttggagaagttaccaaagccgagtttagacagcgcgaggacttcaagaaatga

SEQ ID NO: 3713 - RNA, 3366 nt, synthetic construct
  misc_feature 1..3366: note = Cas9 variant
  source 1..3366: mol_type = other RNA
atgagcgacctggtgctcggcctggatatcgggattggatccgtcggcgttgggatccttaacaaggtgaccggagagattatccacaaaaattctagaattttccccgccgctcaggccgaaaacaatctggtgcggcgcacaaacagacaaggccggcgcctcgcgagacggaagaaacatcgcagagtccggctgaatcgcctttttgaggaaagcgggctgatcacggacttcaccaagatctccattaacctcaatccttaccagctgagagtgaaaggactgacagatgagctctctaacgaggagctgtttatcgctcttaagaatatggttaagcaccggggcattagctatctggacgatgcctccgacgatggcaactctagcgtgggggactacgcccagatcgtcaaagaaaattccaagcagctcgaaaccaaaacaccgggacaaattcagctggagcgctatcagacctacggccagcttagaggggatttcacagtggaaaaggacggaaagaagcatcggctgatcaacgtttttcccaccagcgcttatcgctctgaggccctccggattctgcaaacgcagcaggagttcaatcctcagatcaccgatgaatttatcaacagatacctggagattctcacaggcaagagaaaatattaccacgggcccggaaatgaaaagtcccgcaccgactacggccggtatagaacaagcggcgagaccctggataacatcttcgggattcttatcggaaaatgcacgttttaccctgacgagttccgcgctgccaaggcgtcttatacagcccaagaatttaacctgctcaatgacctgaacaatcttaccgtgcccacagagaccaaaaagctgtccaaagaacagaagaaccagattatcaattacgtcaagaacgagaaagctatgggccctgccaaactcttcaaatatatcgctaagctgctgagctgtgatgtggccgacattaaagggtaccggatcgataagtctggaaaggcggaaattcatacctttgaggcctatagaaaaatgaagacactcgaaacgctggacatcgagcaaatggatcgcgagacccttgacaaactggcttacgtgctcacactgaataccgaacgggagggcattcaggaagcccttgagcacgagttcgctgatgggtccttcagccagaagcaggtcgacgaactggttcaatttagaaaagccaactcctctatcttcggaaagggctggcacaattttagcgtgaagctcatgatggagctgatcccggaactgtacgagacatccgaggaacagatgaccattctcacgcgcctgggcaaacagaagacaacctctagctccaacaaaaccaagtatatcgatgagaaacttctgacagaagagatttacaatcccgtggtcgccaagagcgtgcggcaggctatcaagattgttaacgcggccatcaaagaatatggggacttcgataatattgtgatcgagatggctagagaaaccaacgaggacgacgagaagaaagccatccaaaagattcagaaagccaataaggatgaaaaagacgctgccatgctcaaggcggctaaccagtacaacggaaaggccgagctgcctcattctgtctttcacggccataaacagctggccacaaagatccgcctttggcaccaacagggggaacggtgcctctatacgggaaaaaccattagcatccacgatctgattaataactccaatcagttcgaggtggaccatatcctgcccctctctatcacatttgatgacagcctggctaacaaggttcttgtgtacgccaccgctaatcaggaaaaaggccaaagaacaccttatcaggccctggattccatggacgatgcgtggagcttccgggagctcaaggcctttgtccgcgagtctaagaccctgtccaacaaaaagaaagaatacctgcttacggaggaagacattagcaagttcgatgtgcggaaaaagtttatcgagagaaatctcgtcgacaccagatacgcttctcgcgtggttctgaacgccctgcaggaacacttccgggctcataagattgatacaaaagtgtccgtcgtgagagggcaatttaccagccagctccgcagacactggggcatcgagaagacacgggacacctatcatcaccacgccgttgacgcgctgattatcgccgcttcctctcagcttaatctgtggaaaaagcagaaaaacacgctcgtgagctactccgaggatcaactgctggacatcgaaacaggagagcttatttctgatgacgaatataaggagagcgtcttcaaggccccctaccagcatttcgtggataccctcaaatccaaggagtttgaagacagcatcctgttctcttatcaggtggattccaaatttaatcgcaagattagcgacgctacaatctacgccaccagacaggccaaagttggcaaggataaagctgacgagacctatgtcctggggaagattaaggatatctacacacaagacggatacgatgcgttcatgaaaatctataagaaagacaagtctaaatttctcatgtaccggcacgacccgcagacgttcgaaaaggtgattgagcctatcctggaaaactatcccaataagcagattaacgagaaaggcaaggaggtgccttgtaatccctttcttaaatacaaggaggaacatgggtatatccgcaaatactccaagaagggaaacggccccgaaattaaaagcctgaagtattacgattctaaactcgggaaccacatcgacattacccctaaggatagcaataacaaagtcgtgctgcagtccgttagcccgtggagagccgacgtgtacttcaataagacaaccggcaagtatgagatcctgggacttaaatacgctgatctccaatttgaaaagggcacagggacctataaaatctctcaggagaagtacaacgacattaaaaagaaggagggagtcgattccgacagcgagttcaaatttacgctgtataagaatgatctgctcctggtgaaagacacagaaaccaaggaacagcaacttttccggtttctgtcccgcaccatgcccaaacagaagcactacgttgagctcaaaccttatgataagcagaagttcgaaggcggggaggccctgatcaaagtgctgggaaacgtcgccaattctggccagtgcaagaaagggcttggcaagagcaacatttccatctacaaagtgagaacagacgttctgggaaatcaacatattatcaagaacgagggcgacaagcccaaactcgatttctga

SEQ ID NO: 3714 - RNA, 2556 nt, synthetic construct
  misc_feature 1..2556: note = Cas9 variant
  source 1..2556: mol_type = other RNA
atgaccaacggcaagatcctggggctcgacattggagtggccagcgtcggcgttgggatcattgaggctaaaacaggaaaggtgatccacgccaattccagactgttctctgcggctaacgccgaaaataacgccgagcggcgcggctttagaggggctcggcgccttacgagacggaaaaagcatcgcgtgaaaagagtccgggatctgttcgaaaagtacgacattctcaccgattttcgcaatctgaaccttaatccctatgagctgagagtgaagggactcacagaacagctgaccaacgaggagctgttcgccgctctccggacaatcgccaaacgcagaggcatcagctacctggacgatgcggaagacgattccaccggctctagcgactatgccaagtccattgatgagaatcggcgccttctgaaatctatgacacctgggcaaatccagctcgaaagactggagaagtacggacagcttcggggcaactttaccgtttatgacgagaatggggaagctcacagactgattaacgtgttcagcacgtccgattacaaaaatgaggcccgcaagatcctcgaaacccagagcaactataataagcaaattacagacgagtttatcgaagattacattgagatcctgacccagaaacggaagtactatcatggaccgggcaacgagaaatctagaacagactacgggcgcttccggaccgacggaacgacactggaaaacatctttggcattctcatcggcaagtgctccttctatcccgaggaatacagagctagcaaagcctcttataccgcgcaggagtttaatttcctgaacgatcttaataacctgaaggtccctacagaaaccgggaaactctccaccgagcagaaggagtacctggtgaattttgccaagaacagcaaaacacttggagcttctaagctgctcaaagaaattgccaagctggttgacggcgatgtgaaagacatctccgggtatcgcgaggatagcaagggaaagcccgacctgcacacgttcgaaccttaccggaaactcaagttcaatctgaccacagtcgatattgacaacctttccagagatatcctggacaaactcgctgatatcctgacccttaatacagagcgcgaaggcattgaggacgccatcaaccaaaatctgcccgagcagtttaccaaggaacagatttctgagatcgtgcagattcggaaaagccaatccagcgccttcaacaaggggtggcattctttttccgctaagctcatgaatgaactgatccctgagctgtacgcgacgagcgaggaacagatgacaatcctcaccagactggagaaattcaaggccaccaaaaagtctagcaaaaacacaaagaccattgacgaaaaggagatcacagatgaaatttataatccggtggtcgctaaatccgttcgccagacgatcaagattatcaacgccgccgtgaaaaagtacggagactttgataaaattgtgatcgagatgccccgggacaagaacgctgatgacgagaaaaagttcatcgataagaaaaataaggaaaacaaaaaggagaaagacgattctcttaagagagccgcgtatctgtacaatggcaccgacaagctccctgatgacgtctttcacggcaacaaacaactggctacaaagattcggctgtggtatcagcagggggaacgctgtctttacagcggaaaacccatcctcattcaggatctggtgcacaattccaacaatttcgagatcgaccatattctgcctctcagcctgtcttttgacgattcccttgccaacaaggttctggtgtatgcctgggctaatcaagaaaaagagcagaagaccccctaccaggtcatcgacagcatggatgccgcttggtctttcagagagatgaaggactacgtgctcaaacagaagggcatcgggaaaaagaaacgggaatatctgctgacaaccgagaacattgataagatcgaagttaagaaaaagtttattgagagaaatcttgtggacacgcgctacgcctcccgggtcgtgctcaacagcctgcaaaccgcgctgaaagaactcggaaaggatacaaaagtctccgtggttagaggccagttcacctctcagctgcgcagaaagtggaaaatcgacaagagccgggagacatatcaccatcacgccgtggatgctcttattatcgccgcttcctctcagctgaagctctggcaaaaacacgagaatctgatgtttgaaaactacggggagaatcaggtcgtgaacaaggaaaccggcgagatcctgagcatttccgacgatgagtataaagaaagcgttttccagccgccttaccagggattcgtgaacacgatctcttccaaggcctttgaggacgaaattcttttcagctatcaagtcgattctaaatttaatcgcaaggtgtccgacgcgacaatctacagcaccagaaaggccaaactcggcaaggacaaaaaggaggaaacatacgtgctggggaaatga

SEQ ID NO: 3715 - RNA, 2598 nt, synthetic construct
  misc_feature 1..2598: note = Cas9 variant
  source 1..2598: mol_type = other RNA
atgagacacaagatcggcctggacattgggatcaccagcgtgggatgggccgtcattaacctcgatatcccccggattgaggacctgggcgttcgcatcttcgatagagctgaaaatcctcagacaggggagtcccttgccctgccgcggcgcctcgcgagatctgctcggcgcagactgcggcgcagaaaacatcggcttgaacgcatcagacggctgctcattcgcgagggaatcctgacgaaggaggaactggacaaactctttgaggaaaagcacgagattgatgtgtggcaactgagagtggaagcccttgaccggaaactgaacaatgatgagctcgccagagtcctgcttcatctggctaagcgccggggcttcaagagcaacagaaaatccgagcgcaataacaaggaaaattctaccatgctcaaacacatcgaggaaaaccgggccctgctgagcgggtacagaacagtggctgagatgattgttaaggaccccaaatttgccttccataagcgcaataagggagaaaactataccaatacaatcgcgcgggatgacctcgagagagagattaaactgatctttaccaagcagcgcgaatacggcaacatcgtgtgcacagagaccttcgaaaatgagtatattatgatctgggcctcccagcggccttttgcttctaaaaacgatattgaaaagaaagtcggcttctgtacgtttgagcccaaggagaaaagagcccctaaggctacctacacattccagagctttgtggcctgggaacacatcaataagctgcgcctggtttatcccaccgggacacggggactcaccgacgaggaaagacggctgctttacaaacaagcgttccacaagaacaaaattacgtatcatgatatccgcacactgctccaccttcctgacgacacctactttaagggcatcgtgtacgatagaggggccccgctgaaacagtccgagacaattcggttcctcgaactggacgcttatcatcagatcagaaaggccgtcgataaggtgtacggaaaaggcaagtctagctccttccttcccattgactttgataccttcgggtatgctctgaccctctttaaagacgatgccgacatccgcagctacctgcggaacgagtatgagcagaatggaaagagaatgcctaaccttgccaataaagtgtacgataacgaacccattgaggaactgctcaatctgtctttcacaaagtttggccacctgtccctcaaggctctgcgcaacatccttccttatatggagcaaggcgaggtctacagcgttgcgtgcgaaagagccgggtacacgttcaccggacccaaaaagaaacagaagacactgctcctgccgaatatccctcccattgctaaccctgtggtgatgcgggccctgacccaggcccgcaaagtcgtgaatgctatcattaagaagtatggctctcccgtttccatccacattgagcttgccagagacctcagccagacatttgatgaacggcgcaaaaccaagagagagcaagacgaaaaccggaaaaagaatgagacggcgatccgccagctgatggagtacgggctgacaattaaccccaccggacatgacatcgtgaaattcaagctctggtccgaacagaatggcagatgtgcttattctctgcaacctatcgagattgaacggcttctggagccggggtacgtcgaagtggatcacgttatcccctatagccgctccctcgacgatagctacaccaacaaagtgctggtcctgacaaaggagaatagagagaagggaaaccggattcctgccgaatatcttggcgtgggcaccgagagatggcagcagtttaaaacattcgtcctcacgaacaagcagttttctaaaaagaaacgcgaccggctgctgagactccattacgatgaaaatgaggaagccgagtggaagaaccgcaatctgaacgacacccggtacatctccagattctttgctaatttcattcgcgagcaccttaagttcgccgaaagcgatgacaaacaaaaggtgtatacagttaacgggcgggtgaccgctcatctgagatctcgctgggattttaataaaaaccgggaggaaagcgacctccaccacgccgtcgatgcggccatcgtggcttgcacatccccctctgacatcgccagagttaccgctttctaccagcggcgcgagcagtgtaaggagagcgccaaaaaggcggaacctcattttccccagccgtggcctcacttcgccgatgagctgagagctcggctgtccaagaatcccaaagaaagcattaaggcccttaacctcggaaattatgacgaccaaaaactggagtctctgcagcctgtgtttgtctcccgcatgcccaagagaagcgtgacgggcgctgcccatcaggaaaccctccggagatacatcgggattgatgagcgctctggaaaaatccagacagtggttaagaccaagctgtccgagattaaacttgacgaaacaggccacttccctatgtatgggaaggagagcgatcccccggcctccgcttga

SEQ ID NO: 3716 - RNA, 2886 nt, synthetic construct
  misc_feature 1..2886: note = Cas9 variant
  source 1..2886: mol_type = other RNA
atggccagaatcctggctttcgacattggcatcagctccattgggtgggccttttctgagaacgatgaactcaaggactgcggagtgcggatcttcaccaaagcggagaatcccaagacaggcgaaagcctggcccttcctcgcagactggctcggtccgcccgcaaaagactcgctcggcgcaaggccagactgaaccaccttaaacatctgattgctaatgagtttaagctcaactacgaagattatcagtctttcgacgagagcctggccaaggcgtacaaagggtccctgatctctccgtatgagctccggtttcgcgccctgaatgaacttctgagcaagcaagatttcgctagagtcatcctccacattgccaaacggcgcggatacgacgatatcaagaacaatggcgacgaggaaaaagggaagattctgaaggctatcaaacagaacgaggagaaacttgttaattatcagtccgtgggagaatacctgtataaagagtactttcagaagttcaaagaaaacagcaaggagtttattaatgtgagaaacaaaaaggaatcttacgagcggtgtatcacgcaatccttcctcaagtatgagctgaaactgatttttcagaagcagcgcgaatttggctttagcttctctaaaaagttcgaggaagaggtcctctccgtggccttttacaaaagagcgctgaaggatttcagccatcttgttggcaattgctctttcttctccgacgaaaagcgggcccccaaaaacagccctctggcttttatgttcgtggccctcaccagaatcatcaatctgcttaacaacctgaagaatacagaggggattctctataccaaagatgacctgaacgctctgctcaatgaggtcctgaagaacggaacacttacctacaaacagacaaagaagctgctcggcctgtccgatgactatgaatttaaaggggagaagggaacctacttcatcgaatttaaaaagtataaagagttcattaaggcccttggcgaacacaatctgtctcaagacgatctcaacgagatcgccaaggacattacgctgatcaaagatgagatcaagctgaaaaaggctctcgcgaaatacgacctgaatcagaaccagattgatagcctttccaagctggaatttaaagaccatctcaatatcgggttcaaggccctgaagctgattacaccccttatgctcgagggaaagaagtacgatgaggcttgtaacgaactgaatctgaaagtggccatcaacgaggacaagaaagattttctccctgccttcaatgaaacctattacaaggacgaggttaccaaccccgtggtcctgcgcgctattaaggaatatcggaaagtgcttaatgccctgctcaagaaatacggcaaggtgcacaaaatcaacatcgagctggcgagagaagtcggcaagaaccacagccagcgcgctaagattgagaaagagcaaaatgaaaactataaggccaaaaaggatgccgagctggaatgcgagaaacttgggctcaagatcaattctaagaacattctgaaactgagactcttcaaggaacagaaagagttttgtgcttactccggagagaagatcaaactgagcgaccttcaggacgaaaagatgctggagattgatcatatctatccttactctcggagcttcgacgattcctacatgaataaagttctcgtgtttacaaagcaaaaccaggaaaagctgaataaaaccccgttcgaggcctttggcaacgacaatgtgaagtggcagaaaattgaagtcctggctaagaaccttcccgagaaaaagcagaagcgcatcctcgataaaaattataaggacaaagagcaaaaggatttcaaagaccggaacctgaatgatacgagatacatcgcccgcctggtgctcaactatacaaaggactacctggattttcttcctctgtctgacgatgaaaataccaagctcaaagggagcaaggttcacgtggaggcgaaatccggaatgctgacaagcgccctgcggcatacctggggcttctctaccaaggacagaaacaaccaccttcaccatgctattgacgccgctatcattgcctatgcgaataactccatcgtcaaagattttagcgacttcaagaaggaacaggagtctaattccgccgagctctacgctaaaaagattagcgaactggattataaaaacaagcgcaaatttttcgagcccttttccgggttccggcagaaggtgctggacaagatcgatgaaatcttcgtttctaaacctgagagaaagaaacccagcggagccctccacgaagagacatttcggaaggaggaagagttctaccagtcctacggcggcaaagaaggggtgctgaaggctcttgagctgggaaaaattcgcaaggtcaatggcaagatcgtgaaaaacggggacatgtttagagtcgatattttcaagcataaaaagacgaataaattttatgccgtgccgatctacaccatggacttcgccctcaaggttctgcctaacaaggctgtggcgcggtctaaaaagggagaaattaaagattggatcctgatggacgagaattatgagttttgcttcagcctttacaaggattccctgatcctcattcaaacaaaagacatgcaggaacccgagctggtctattttaacgccttcaccagctctacagtgtccctcatcgttagcaagcacgataataagtttgaaaccctgtctaaaaaccttaaggtgttcgagaaatacattgtctccgctctgggcgaagtgacgaaggccgagttcagacagcgcgaggactttaaaaatgaactccggtga

SEQ ID NO: 3717 - RNA, 2955 nt, synthetic construct
  misc_feature 1..2955: note = Cas9 variant
  source 1..2955: mol_type = other RNA
atggccaagatcctggctttcgacattggcatcagctccattgggtgggccttttctgagaacgatgaactcaaagactgcggagtgagaatcttcaccaaggcggagaatcccaaaacaggcgaaagcctggcccttcctcggcgcattgctagatccgcccggaagcgcctggctagacggaaagcccgcctcaaccacctgaagcatcttatcgctaatgagtttaagctgaactacgaagattatcagtctttcgacgagatcctcgccaaagcgtacaaggggagcctgatttccccgtatgagctgagatttcgggccctcaatgaactgctttctaaacaagatttcgctcgcgtcatcctgcacattgccaagagacggggatacgacgatatcaaaaacaatggcgacgaggaaaaggggaagattctcaaagctatcaagcagaacgaggagaaactggccaattatcagagcgttggagaatacctttataaggagtactttcagaaattcaaggaaaactccaaagagtttattaatgtgcgcaacaagaaggaaagctacgagagatgtatcgcgcaatctttcctgaaagatgagctcaagctgatctttaaaaagcagcgggagttcggcttttccttcagcaaaaagttcgaagaagaggtgctgtctgtcgccttttataagcgcgctctcaaagacttctcccatctggtgggcaattgcagctttttcacggatgaaaagagagcccccaaaaactctcctcttgcttttatgttcgttgccctgacccggattatcaatctcctgaacaaccttaagaatacactgtacaccaaagacgatctcaacgccctgctgaatgaggtgctcaagaacgggacactgacctataagcagacaaagaaacttctgggactctccgacgactacgagtttaaaggcgaaaaggggaattatttcattgagtttaaaaagtacaaggagttcatcaaagctctgggagaacacagcctttcccaggatgacctgaacgaaattgcgaaggatatcaccctcatcaaagacgagattaagctgaaaaaggccctggctaaatatgatctcaatgagaaccaaatcgacaatctgtctaaacttgaatttaaggatcatctgaacattagcttcaaagccctcaagctgatcacgcccctgatgcttgagggcaaaaagtacgacgaagcctgtaatgagctcaccctgaaagtcgctattaacgaggataagaaggactttctgcctgccttcaatgaaacatactataaagatgaggtgaccaaccccgttgtgctcagagcgatcaaggaataccgcaaagtcctgaatgcccttctgaagaaatatgggaaggtgcacaagatcaacattgagctcgctcgggaagtgggaaagaaccactcccagagagccaagatcgagaaagagcagaatgaaaactacaaggctaaaaaggacgccgagctggaatgcgagaagctgggccttaaaattaatagcaagaacatcctcaaactgcgcctgttcaaggaacagaaagagttttgtgtctattctggcgagaagattaaactctccgacctgcaagatgaaaagatgcttgagatcgaccatatttacccttatagccggtctttcgatgacagctacatgaataaggttctggtgtttacaaaacagaaccaggaaaagctcaatcaaaccccgttcgaggcttttgggaacgattccgccaaatggcagaagatcgaagtgctggcgaaaaatctgcccacgaagaagcagaaaagaatccttgacaagaactacaaagataaggagcagaaagacttcaaggatcgcaatctcaacgacacacggtatattgccagactggtcctgaattacaccaaggattatctcgactttctgcctctttctgatgacgagaacacaaaactgaatgacacccaaaagggaagcaaagtgcacgttgaagctaagtccggcatgctcaccagcgccctgcgccatacatgggggttctctacgaaagatcggaacaaccatctgcaccacgctatcgacgccgtgattatcgcgtacgccaataactccattgtcaaggcttttagcgatttcaagaaagagcaggaatctaataccgccgagctttatgctaagaaaatctccgagctcgactacaagaacaaaagaaagtttttcgaaccctttagcggattccgccagaaggtgctggataaaatcgacgagattttcgtttccaagcctgaacggaaaaagccctctggcgccctgcacgaggaaacatttagaaaagaggaggagttctatcagagctacgggggaaaggaaggcgtgctcaaagccctggaacttggcaagatccggaaggtcaatgggaaaattgtgaagaacggagatatgtttcgcgtcgacatcttcaaacataagaaaaccaataagttttacgctgtgccgatttatacaatggatttcgcgctgaaggttctccctaacaaagccgtggctagatccaagaaaggcgagatcaaggactggatcctgatggatgaaaattacgagttttgcttctctctgtataaagacagccttattctgatccaaaccaaggatatgcaggagcccgaatttgtctactataacgccttcacgtccagcacagtgtctctcattgtttccaagcacgacaataaatttgagaccctgagcaagaaccagaaaatcctcttcaagaatgccaacgaaaaagaggtgattgctaagtctatcgggatccagaatctgaaggtcttcgaaaaatacattgtgtccgcccttggagaggtgaccaaggcggagtttcggcaaagagaagagttcaaaaacgaactgcgctga

SEQ ID NO: 3718 - RNA, 2955 nt, synthetic construct
  misc_feature 1..2955: note = Cas9 variant
  source 1..2955: mol_type = other RNA
atggccagaatcctggctttcgacattggcatcagctccattgggtgggccttttctgagaacgatgaactcaaggactgcggagtgcggatcttcaccaaagcggagaatcccaagacaggcgaaagcctggcccttcctcgcagactggctcggtccgcccgcaaaagactcgctcggcgcaaggccagactgaaccggcttaaacacctgattgctaatgagtttaagctcaactacgaagattatcagtctttcgacgagagcctggccaaggcgtacaaagggtccctgatctctccgtatgagctccgctttagagccctgaatgaacttctgagcaagcaagatttcgctcgggtcatcctccatattgccaaacgcagaggatacgacgatatcaagaactccgacgataaagagaagggcgctattctgaaggccatcaaacagaatgaagagaaacttgcgaactatcagagcgttggggagtacctgtataaagaatactttcagaagttcaaagaaaattctaaggaatttacgaacgtgcggaataaaaaggagtcctacgaacgctgtattgcccagagcttcctcaaggacgagctgaaactgatctttaagaaacaaagagagttcggattttctttctccaagaaattcgaagaggaagtgctcagcgtcgctttttataagcgggccctgaaggatttctctcaccttgtgggcaactgctcctttttcaccgacgagaaaagagctcccaagaatagccctctggcctttatgttcgttgccctcacacgcattatcaacctgcttaataacctgaaaaacaccgaaggcatcctctacacaaaggatgacctgaatgctctgctcaacgagtttctgaaaaatgggacccttacatataagcagaccaagaaactgctcggactgtccgacgattacgagttcaagggcgaaaaagggacgtattttattgagttcaagaaatacaaggaatttatcaaggcgcttggagagcataacctgtctcaggacgatctcaatgaaattgccaaagacatcaccctgattaaggatgagatcaaactgaagaaagctctcgccaagtatgacctgaaccaaaatcagatcgatagcctttccaaactggagttcaaggaccacctcaacattagctttaaggccctgaaactgatcacaccccttatgctcgaaggcaagaaatacgatgaggcttgtaatgaactgaacctgaaggtggccattaatgaggacaaaaaggatttcctccctgcgttcaacgagacctactataaggacgaagtcacaaatcccgtggttctgcgggctatcaaagagtacagaaaggtgcttaacgccctgctcaaaaagtatgggaaagtccataagattaatatcgaactggcccgcgaggtgggaaagaactactctcagcgggctaaaatcgaaaaggagcagaacgagaattataaagccaagaaagacgctgaactggagtgcgaaaaacttggcctcaagattaactccaaaaatatcctgaagctgagactctttaaagagcaaaaggagttctgtgcctacagcggcgagaaaattaagatctctgatctgcaggacgagaaaatgcttgaaattgatcacatctatccttacagccgctcctttgacgattcttacatgaacaaggtgctggtcttcaccaagcagaatcaagagaaactcaaccagacgccgtttgaagcgttcgggaatgacagcgccaagtggcagaaaattgaggttctggctaagaacctgcccacaaagaagcagaagcggatccttgataaaaattataaggacaaagaacaaaaggattttaaagacagaaacctcaatgatacccgctacatcgcccggctggtgctgaactatacaaaggactacctcgatttcctgcctctttccgacgacgagaataccaagctgaacgatacccacaaaggaagcaaggtgcatgtcgaggctaaatctggcatgctcacatccgccctgagacacacgtgggggtttagcaccaaggaccgcaataaccatctgcggcacgcgattgatgccgtgatcattgcttatgccaacaattctatcgttaaggctttctccgactttaagaaggaacaggagagcaactccgccgaactttacgccaaaaagatttctgagctcgattataaaaataagagaaaattctttgagcccttcagcggattccggcagaaggtgctggacaagatcgatgaaatctttgtctccaaacctgagcgcaagaaaccctctggcgctctgcacgaagagacattcagaaaggaagaggagttttaccagagctacgggggaaaagaaggcgtgctcaaggcgctggagcttggcaaaattcggaaggttaacgggaagatcgtgaaaaatggagacatgttcagagtcgatatttttaagcataaaaagaccaacaaattctatgccgtgccgatctacacaatggactttgctctgaaggtcctccctaataaggccgtggcccgctccaaaaagggcgaaattaaagattggatcctgatggacgagaactatgagttctgctttagcctgtacaaggattctcttatcctgattcaaaccaaagacatgcaggaacccgagttcgtttattacaatgcttttacgtccagcacagtgtctctcatcgtctccaagcacgacaacaagttcgaaaccctgagcaaaaatcagaagattctcttcaaaaacgccaatgagaaggaagtgatcgcgaaatctattgggatccagaacctgaaggtttttgagaagtatatcgtgagcgctcttggagaagtcaccaaagccgagttccggcaaagagaggattttaagaaatga

SEQ ID NO: 3719 - RNA, 2955 nt, synthetic construct
  misc_feature 1..2955: note = Cas9 variant
  source 1..2955: mol_type = other RNA
atggccagaatcctggctttcgacattggcatcagctccattgggtgggccttttctgagaacgatgaactcaaggactgcggagtgcggatcttcaccaaagtcgagaatcccaagacaggcgaaagcctggcgcttcctcgcagactggctcggtccgcccgcaaaagactcgcccggcgcaaggctagactgaaccaccttaaacatctgattgccaatgagtttaagctcaactacgaagattatcagtctttcgacgagagcctggctaaggcctacaaagggtccctgatctctccgtatgagctccggtttcgcgcgctgaatgaacttctgagcaagcaagatttcgccagagttatcctccacattgctaaacggcgcggatacgacgatatcaagaactccgacgataaagagaagggcgccattctgaaggctatcaaacagaatgaagagaaacttgccaactatcagagcgtgggggagtacctgtataaggaatactttcagaagttcaaagaaaattctaaggaatttacgaacgtgagaaataaaaaggagtcctacgaacggtgtattgcgcagagcttcctcaaggacgagctgaaactgatctttaagaaacaacgcgagttcggattttctttctccaagaaattcgaagaggaagtcctcagcgtggccttttataagagagctctgaaggatttctctcatcttgttggcaactgctcctttttcaccgacgagaaacgggcccccaagaatagccctctggcttttatgttcgtgacactcaccagaattatcaacctgcttaataacctgaaaaacacagaaggcatcctctacaccaaggatgacctgaatgccctgctcaacgaggtcctgaaaaatgggacacttacctataagcagacgaagaaactgctcggactgtccgacgattacgagtttaagggcgaaaaagggacctatttcattgagtttaagaaatacaaggagttcatcaaggcccttggagagcacaacctgtctcaggacgatctcaatgaaattgctaaagacatcacactgattaaggatgagatcaaactgaagaaagcgctcgccaagtatgacctgaaccaaaatcagatcgatagcctttccaaactggagtttaaggaccatctcaacattagcttcaaggctctgaaactgatcacaccccttatgctcgaaggcaagaaatacgatgaggcctgtaatgaactgaacctgaaggtggccattaatgaggacaaaaaggattttctccctgctttcaacgagacctactataaggacgaagttaccaatcccgtggtcctgcgcgccatcaaagagtaccggaaggtgcttaacgcgctgctcaaaaagtatgggaaagtgcacaagattaatatcgaactggctagagaggtcggaaagaaccactctcagcgcgccaaaatcgaaaaggagcagaacgagaattacaaagccaagaaagacgctgaactggagtgcgaaaaacttggcctcaagattaactccaagaatatcctgaagctgagactcttcaaagagcaaaaggaattttgtgcctatagcggcgagaaaattaagatctctgatctgcaggacgagaaaatgcttgaaattgatcatatctacccttatagcagatccttcgacgattcttacatgaacaaggttctggtgtttacgaagcagaatcaagagaaactcaacaagacaccgttcgaggcttttgggaatgacagcgccaaatggcagaagattgaagtgctggcgaaaaacctgcccaccaagaagcagaaacgcatccttgataagaattacaaagacaaggaacagaaagatttcaaggaccggaacctcaatgatacaagatatatcgcccgcctggtcctgaactacaccaaggactatctcgattttctgcctctttccgacgacgagaataccaaactgaacgatacacaaaagggaagcaaagtgcacgttgaggctaagtctggcatgctcacgtccgccctgcggcatacctgggggttcagcacaaaagacagaaataaccatctgcaccacgctattgatgccgtgatcattgcgtacgccaacaattctatcgtcaaggctttttccgacttcaagaaagaacaggagagcaactccgccgaactttatgctaagaaaatttctgagctcgattacaagaataaacgcaagtttttcgagccctttagcggattccggcagaaggtgctggacaaaatcgatgaaatcttcgtttccaagcctgagcggaaaaagccctctggcgccctgcacgaagagacctttcggaaagaagaggagttctatcagagctacgggggaaaggaaggcgtgctcaaagccctggagcttggcaagattcgcaaggtcaacgggaaaatcgtgaagaatggagacatgtttagagtcgatattttcaaacataagaaaacaaacaagttttacgctgtgccgatctataccatggacttcgcgctgaaggttctccctaataaagccgtggctcggtccaagaaaggcgaaattaaggattggatcctgatggacgagaactacgaattttgcttcagcctgtataaagattctcttatcctgattcaaacgaaggacatgcaggagcccgagtttgtctactataatgccttcacatccagcaccgtgtctctcatcgtttccaagcacgacaacaaatttgaaaccctgagcaagaatcagaaaattctcttcaagaacgccaatgagaaagaagtgatcgctaagtctattgggatccagaacctgaaggtcttcgagaaatacatcgtgagcgcccttggagaagtgacaaaggcggagtttagacaacgcgaggatttcaaaaagtga

SEQ ID NO: 3720 - RNA, 2955 nt, synthetic construct
  misc_feature 1..2955: note = Cas9 variant
  source 1..2955: mol_type = other RNA
atggccagaatcctggctttcgacattggcatcagctccattgggtgggccttttctgagaacgatgaactcaaggactgcggagtgcggatcttcaccaaagcggagaatcccaagacaggcgaaagcctggcgcttcctcgcagactggcccggtccgcccgcaaaagactcgctcggcgcaaggccagactgaaccaccttaaacatctgattgctaatgagtttaagctcaactacgaagattatcagtctttcgacgagagcctggccaaggcgtacaaagggtccctgatctctccgtatgagctccggtttcgcgccctgaatgaacttctgagcaagcaagatttcgctagagtcatcctccacattgccaaacggcgcggatacgacgatatcaagaactccgacgataaagagaagggcgctattctgaaggccatcaaacagaatgaagagaaacttgcgaactatcagagcgttggggagtacctgtataaagaatactttcagaagttcaaagaaaattctaaggaatttacgaacgtgagaaataaaaaggagtcctacgaacggtgtattgcccagagcttcctcaaggacgagctgaaactgatctttaagaaacaacgcgagttcggattttctttctccaagaaattcgaagaggaagtgctcagcgtcgctttttataagagagccctgaaggatttctctcatcttgtgggcaactgctcctttttcaccgacgagaaacgggctcccaagaatagccctctggcctttatgttcgttgccctcacaagaattatcaacctgcttaataacctgaaaaacaccgaaggcatcctctacacaaaggatgacctgaatgctctgctcaacgaggtgctgaaaaatgggacccttacatataagcagaccaagaaactgctcggactgtccgacgattacgagtttaagggcgaaaaagggacgtatttcattgagtttaagaaatacaaggagttcatcaaggcgcttggagaccactctctgagccaggatgacctcaacgagattgccaaagatatcaccctgattaaggacgaaatcaaactgaagaaagctctcgccaagtatgatctgaatcaaaaccagatcgactcccttagcaaactggagtttaaggatcatctcaatatttctttcaaggccctgaaactgatcacaccccttatgctcgagggcaagaaatacgacgaggcttgtaacgaactgaatctgaaggtcgccattaacgaagataaaaaggactttctccctgcgttcaatgagacctactataaggacgaggtgacaaaccccgttgtgctgcgcgctatcaaagaataccggaagattcttaatgccctgctcaaaaagtatgggaaagtccacaagatcaacatcgagctggccagagaagtgggaaagaatcactcccagcgcgctaaaattgagaaggaacagaacgagaactacaaagccaagaaagatgctgagatcgaatgcgagaagctgggccttaagattaatagcaaaaacatcctcaagctgcggctgttcaaagaacaaaaggagttttgtgcctattctggcgaaaagattaagctcagcgacctgcaggatgagaaaatgcttgagatcgaccatatttacccttattccagatctttcgatgacagctacatgaataaggtgctggtctttaccaagcagaaccaagaaaaactcaataagacgccgttcgaggcgtttgggaacgattccacaaaatggcagaagatcgaagttctggccaaaaatctgcccgagaagaagcagaaacgcatccttgacaagaactacaaagataaggaacagaaagacttcaaggatcggaatctcaacgacaccagatatattgctcgcctggtgctgaattacacaaaggattatctcgactttctgcctcttagcgacgatgagaacaccaaactgaatgacacccaaaagggatctaaagtgcacgtcgaggccaagtccggcatgctcacaagcgctctgcggcatacgtgggggttctctgccaaagatagaaacaatcatctgcaccacgcgatcgacgccgctattatcgcctacgctaacaactccattgtgaaggcctttagcgatttcaagaaagaacaggagtccaattctgttgaactttatgccaagaaaatcagcgagctcgactacaagaacaaacgcaagtttttcgagcccttttccggattccggcagaaggtgctggataaaatcgacgaaattttcgtctctaagcctgagcggaaaaagcccagcggcgctctgcacgaagagacctttagaaaagaagaggagttctatcagtcctacgggggaaaggaaggcgtgctcaaagcgctggagcttggcaagatccgcaaggttaatgggaaaattgtgaagaacggagatatgtttagagtcgacatcttcaaacataagaaaacaaataagttttacgccgtgccgatttataccatggatttcgctctgaaggtcctccctaacaaagccgtggcccggagcaagaaaggcgaaatcaaggactggatcctgatggatgagaattacgaattttgcttctctctgtataaagactcccttattctgatccaaacaaaggacatgcaggagcccgagctcgtttactttaacgctttcaccagctctacggtgtccctgattgtcagcaagcacgataataaatttgaaacactctctaagaaccagaaaatcctgttcaagaatgccaacgagaaagaagtgattgctaagagcatcgggatccagaatcttaaggttttcgagaaatatattgtgtccgctctgggagaagtcaccaaggccgagtttagacaacgcgaggacttcaaaaagtga

SEQ ID NO: 3721 - RNA, 2955 nt, synthetic construct
  misc_feature 1..2955: note = Cas9 variant
  source 1..2955: mol_type = other RNA
atggccagaatcctggctttcgacattggcatcagctccattgggtgggccttttctgagaacgatgaactcaaggactgcggagtgcggatcttcaccaaagtcgagaatcccaagacaggcgaaagcctggcgcttcctcgcagactggctcggtccgcccgcaaaagactcgcccggcgcaaggctagactgaaccaccttaaacatctgattgccaatgagtttaagctcaactacgaagattatcagtctttcgacgagagcctggctaaggcctacaaagggtccctgatctctccgtatgagctccggtttcgcgcgctgaatgaacttctgagcaagcaagatttcgccagagttatcctccacattgctaaacggcgcggatacgacgatatcaagaactccgacgataaagagaagggcgccattctgaaggctatcaaacagaatgaagagaagctcgccaactatcagagcgtgggggagtacctgtataaagaatactttcagaagttcaaagaaaattctaaggaatttacgaacgtgagaaataaaaaggagtcctacgaacggtgtattgcgcagagcttcctcaaggacgagctgaaactgatctttaagaaacaacgcgagttcggattttctttctccaagaaattcgaagaggaagtcctcagcgtggccttttataagagagctctgaaggatttctctcatcttgttggcaactgctcctttttcaccgacgagaaacgggcccccaagaatagccctctggcttttatgttcgtggccctcacaagaattatcaacctgcttaataacctgaaaaacaccgaaggcatcctctacacaaaggatgacctgaatgccctgctcaacgaggtcctgaaaaatgggacccttacatataagcagaccaagaaactgctcggactgtccgacgattacgagtttaagggcgaaaaagggacgtatttcattgagtttaagaaatacaaggagttcatcaaggctcttggagagcacaacctgtctcaggacgatctcaatgaaattgcgaaagacatcaccctgattaaggatgagatcaaactgaagaaagccctcgctaagtatgacctgaaccaaaatcagatcgatagcctttccaaactggagtttaaggaccatctcaacattagcttcaaggccctgaaactgatcacaccccttatgctcgaaggcaagaaatacgatgaggcctgtaatgaactgaacctgaaggtggctattaatgaggacaaaaaggattttctccctgccttcaacgagacctactataaggacgaagttacaaatcccgtggtcctgcgcgcgatcaaagagtaccggaaggtgcttaacgctctgctcaaaaagtatgggaaagtgcacaagattaatatcgaactggccagagaggtcggaaagaaccactctcagcgcgccaaaatcgaaaaggagcagaacgagaattacaaagctaagaaagacgccgaactggagtgcgaaaaacttggcctcaagattaactccaaaaatatcctgaagctgcggcttttcaaagagcaaaaggaattttgtgcttatagcggcgagaaaattaagatctctgatctgcaggacgagaaaatgcttgaaattgatcatatctacccttatagcagatccttcgacgattcttacatgaacaaggttctggtgtttaccaagcagaatcaagagaaactcaacaagacgccgttcgaagcctttgggaatgacagcgcgaaatggcagaagattgaggtgctggccaaaaacctgcccacaaagaagcagaaacgcatccttgataagaattacaaagacaaggaacagaaagatttcaaggaccggaacctcaatgataccagatatatcgctcgcctggtcctgaactacacaaaggactatctcgattttctgcctctttccgacgacgagaataccaaactgaacgatacccaaaagggaagcaaagtgcacgttgaggccaagtctggcatgctcacatccgctctgcggcatacgtgggggttcagcaccaaagacagaaataaccatctgcaccacgccattgatgcggtgatcattgcctacgctaacaattctatcgtcaaggccttttccgacttcaagaaagaacaggagagcaactccgctgaactttatgccaagaaaatttctgagctcgattacaagaataaacgcaagtttttcgagccctttagcggattccggcagaaggtgctggacaaaatcgatgaaatcttcgtttccaagcctgagagaaagaagccctctggcgccctgcacgaagagacatttcggaaagaagaggagttctatcagagctacgggggaaaggaaggcgtgctcaaagctctggagcttggcaagattcgcaaggtcaacgggaaaatcgtgaagaatggagacatgtttagagtcgatattttcaaacataagaaaaccaacaagttttacgcggtgccgatctatacaatggacttcgccctgaaggttctccctaataaagctgtggcccggtccaagaaaggcgaaattaaggattggatcctgatggacgagaactacgaattttgcttcagcctgtataaagattctcttatcctgattcaaaccaaggacatgcaggagcccgagtttgtctactataatgccttcacgtccagcacagtgtctctcatcgtttccaagcacgacaacaaatttgaaaccctgagcaagaatcagaaaattctcttcaagaacgctaatgagaaagaagtgatcgccaagtctattgggatccagaacctgaaggtcttcgagaaatacatcgtgagcgcgcttggagaagtgaccaaggctgagtttagacaacgcgaggatttcaaaaagtga

SEQ ID NO: 3722 - RNA, 2955 nt, synthetic construct
  misc_feature 1..2955: note = Cas9 variant
  source 1..2955: mol_type = other RNA
atggccagaatcctggctttcgacattggcatcagctccattgggtgggccttttctgagaacgatgaactcaaggactgcggagtgcggatcttcaccaaagcggagaatcccaagacaggcgaaagcctggcccttcctcgcagactggctcggtccgcccgcaaaagactcgctcggcgcaaggccagactgaaccaccttaaacatctgattgctaatgagtttaagctcaactacgaagattatcagtctttcgacgagagcctggccaaggcgtacaaagggtccctgatctctccgtatgagctccggtttcgcgccctgaatgaacttctgagcaagcaagatttcgctagagtcatcctccacattgccaaacggcgcggatacgacgatatcaagaactccgacgataaagagaagggcgctattctgaaggccatcaaacagaatgaagagaaacttgcgaactatcagagcgttggggagtacctgtataaagaatactttcagaagttcaaagaaaattctaaggaatttacgaacgtgagaaataaaaaggagtcctacgaacggtgtattgcccagagcttcctcaaggacgagctgaaactgatctttaagaaacaacgcgagttcggattttctttctccaagaaattcgaagaggaagtgctcagcgtcgctttttataagagagccctgaaggatttctctcatcttgtgggcaactgctcctttttcaccgacgagaaacgggctcccaagaatagccctctggcctttatgttcgttgccctcacaagaattatcaacctgcttaataacctgaaaaacaccgaaggcatcctctacacaaaggatgacctgaatgctctgctcaacgaggtgctgaaaaatgggacccttacatataagcagaccaagaaactgctcggactgtccgacgattacgagtttaagggcgaaaaagggacgtatttcattgagtttaagaaatacaaggagttcatcaaggcgcttggagaccactctctgagccaggatgacctcaacgagattgccaaagatatcaccctgattaaggacgaaatcaaactgaagaaagctctcgccaagtatgatctgaatcaaaaccagatcgactcccttagcaaactggagtttaaggatcatctcaatatttctttcaaggccctgaaactgatcacaccccttatgctcgagggcaagaaatacgacgaggcttgtaacgaactgaatctgaaggtcgccattaacgaagataaaaaggactttctccctgcgttcaatgagacctactataaggacgaggtgacaaaccccgttgtgctgcgcgctatcaaagaataccggaaggtccttaatgccctgctcaaaaagtatgggaaagtgcacaagattaacatcgagctggccagagaagtgggaaagaattactcccagcgcgctaaaatcgagaaggaacagaacgagaactataaagccaagaaagatgctgagctggaatgcgagaaacttggcctcaagattaatagcaaaaacatcctgaagctgagactcttcaaagaacaaaaggagttttgtgcctactctggcgaaaagattaagatcagcgacctgcaggatgagaaaatgcttgagattgaccacatctatccttactcccggtctttcgatgacttttacatgaataaggtcctggttttcaccaagcagaaccaagaaaaactcaatcagacgccgtttgaggcgttcgggaacgatagcgccaagtggcagaaaattgaagtgctggctaagaatctgcccacaaagaagcagaagcgcatccttgacaaaaactataaggataaagagcaaaaggactttaaagatcggaatctcaacgacaccagatacatcgcccgcctggtgctgaattatacaaaggattacctcgacttcctgcctctttccgacgatgaaaacaccaagctgaatgacacccagaaaggaagcaaggtccatgtggaggctaaatctggcatgctcacatccgccctgcggcacacgtgggggtttagcgcgaaggatagaaacaatcatctgcaccacgccattgacgctgttatcattgcctatgctaacaactctatcgtgaaagccttctccgattttaagaaggagcaggaaagcaattccgccgagctttacgctaaaaagatttctgaactcgactataaaaacaagcgcaaattctttgagcccttcagcggattccggcagaaggtcctggataagatcgacgagatctttgtgtccaaacctgaaagaaagaaaccctctggcgcgctgcatgaggaaaccttccggaaggaggaagagttttaccaaagctacgggggaaaagagggcgttctcaaggccctggaacttggcaaaattcgcaaggtgaatgggaagatcgtcaaaaacggagatatgttcagagtggacatttttaagcacaaaaagacaaataaattctatgctgtcccgatctacaccatggattttgccctgaaggtgctccctaacaaggccgttgctcggtccaaaaagggcgagattaaagactggatcctgatggatgaaaattatgagttctgctttagcctgtacaaggactctcttatcctgattcagacaaaagacatgcaggaacccgagttcgtgtattacaacgcctttacctccagcacggtctctctcatcgtgtccaagcatgataataagttcgagacactgagcaaaaaccagaagattctcttcaaaaatgcgaacgaaaaggaggttatcgctaaatctattgggatccaaaatctgaaggtgtttgaaaagtatatcgtcagcgcccttggagaggtgaccaaagccgagttcagacagcgcgaagactttaagaaatga

SEQ ID NO: 3723 - RNA, 2955 nt, synthetic construct
  misc_feature 1..2955: note = Cas9 variant
  source 1..2955: mol_type = other RNA
atggccagaatcctggctttcgacattggcatcagctccattgggtgggccttttctgagaacgatgaactcaaggactgcggagtgcggatcttcaccaaagcggagaatcccaagacaggcgaaagcctggcccttcctcgcagactggctcggtccgcccgcaaaagactcgctcggcgcaaggccagactgaaccaccttaaacatctgattgctaatgagtttaagctcaactacgaagattatcagtctttcgacgagagcctggccaaggcgtacaaagggtccctgatctctccgtatgagctccggtttcgcgccctgaatgaacttctgagcaagcaagatttcgctagagtcatcctccacattgccaaacggcgcggatacgacgatatcaagaactccgacgataaagagaagggcgctattctgaaggccatcaaacagaatgaagagaaacttgcgaactatcagagcgttggggagtacctgtataaagaatactttcagaagttcaaagaaaattctaaggaatttacgaacgtgagaaataaaaaggagtcctacgaacggtgtattgcccagagcttcctcaaggacgagctgaaactgatctttaagaaacaacgcgagttcggattttctttctccaagaaattcgaagaggaagtgctcagcgtcgctttttataagagagccctgaaggatttctctcatcttgtgggcaactgctcctttttcaccgacgagaaacgggctcccaagaatagccctctggcctttatgttcgttgccctcacaagaattatcaacctgcttaataacctgaaaaacaccgaaggcatcctctacacaaaggatgacctgaatgctctgctcaacgagtttctgaaaaatgggacccttacatataagcagaccaagaaactgctcggactgtccgacgattacgagttcaagggcgaaaaagggacgtattttattgagttcaagaaatacaaggaatttatcaaggcgcttggagagcacaacctgtctcaggacgatctcaatgaaattgccaaagacatcaccctgattaaggatgagatcaaactgaagaaagctctcgccaagtatgacctgaaccaaaatcagatcgatagcctttccaaactggagttcaaggaccatctcaacattagctttaaggccctgaaactgatcacaccccttatgctcgaaggcaagaaatacgatgaggcttgtaatgaactgaacctgaagattgccatcaatgaggacaaaaaggatttcctccctgcgttcaacgagacctactataaggacgaagtgacaaatcccgtcgtgctgcgcgctattaaagagtaccggaaggttcttaacgccctgctcaaaaagtatgggaaagtgcacaagatcaatatcgaactggccagagaggtcggaaagaaccactctcagcgcgctaaaattgaaaaggagcagaacgagaattacaaagccaagaaagacgctgaactggagtgcgaaaaacttggcctcaagatcaactccaagaatattctgaagctgcggctctttaaagagcaaaaggagttctgtgcctatagcggcgagaaaatcaagatttctgatctgcaggacgagaaaatgcttgaaatcgatcatatttacccttatagcagatcctttgacgattcttacatgaacaaggtgctggtgttcaccaagcagaatcaagagaaactcaaccagacgccgtttgaagcgttcgggaatgacagcgccaagtggcagaaaatcgaggtcctggctaagaacctgcccacaaagaagcagaagcgcatccttgataaaaattacaaggacaaagaacaaaagaactttaaagatcggaatctcaacgacaccagatatattgcccgcctggttctgaattacacaaaggattatctcgacttcctgcctctttccgatgacgagaacaccaagctgaatgacacccagaaaggaagcaaggtgcacgtggaggctaaatctggcatgctcacatccgccctgcggcatacgtgggggtttagcgcgaaggatagaaacaaccatctgcaccacgccatcgacgctgtcattatcgcctacgctaataactctattgtgaaagccttctccgattttaagaaggaacaggagagcaattccgccgaactttatgctaaaaagatctctgagctcgactacaaaaacaagcgcaaattctttgagcccttcagcggattccggcagaaggttctggataagatcgacgaaatttttgtgtccaaacctgagagaaagaaaccctctggcgcgctgcacgaagagaccttccggaaggaagaggagttttatcaaagctacgggggaaaagaaggcgtcctcaaggccctggagcttggcaaaatccgcaaggtgaatgggaagattgttaaaaacggagatatgttcagagtggacatctttaagcataaaaagacaaataaattctacgctgtcccgatttataccatggattttgccctgaaggtgctccctaacaaggccgtcgctcggtccaaaaagggcgaaatcaaagactggatcctgatggatgagaattacgagttctgctttagcctgtataaggactctcttattctgatccagacaaaagatatgcaggaacccgagttcgtgtactataacgcctttacctccagcacggtttctctcattgtgtccaagcacgacaataagttcgaaacactgagcaaaaaccagaagatcctcttcaaaaatgcgaacgagaaggaagtcattgctaaatctatcgggatccaaaatctgaaggtgtttgagaagtacattgttagcgcccttggagaagtgaccaaagccgagttcagacagcgcgaggactttaagaaatga

SEQ ID NO: 3724 - RNA, 2955 nt, synthetic construct
  misc_feature 1..2955: note = Cas9 variant
  source 1..2955: mol_type = other RNA
atggtgagaatcctggccttcgacattggcatcagctccattgggtgggctttttctgagaacgatgaactcaaggactgcggagtccggatcttcaccaaagttgagaatcccaagacaggcgaaagcctggcccttcctcgcagactggcgcggtccgctcgcaaaagactcgcccggcgcaaggccagactgaaccaccttaaacatctgattgctaatgagtttaagctcaactacgaagattatcagtctttcgacgagagcctggccaaggcttacaaagggtccctgatctctccgtatgagctccggtttcgcgccctgaatgaacttctgagcaagcaagatttcgcgagagtgatcctccacattgccaaacggcgcggatacgacgatatcaagaactccgacgataaagagaagggcgctattctgaaggccatcaaacagaatgaagagaagctcgctaactatcagagcgtgggggagtacctgtataaagaatactttcagaagttcaaagaaaattctaaggaatttacgaacgtcagaaataaaaaggagtcctacgaacggtgtattgcccagagcttcctcaaggacgagctgaaactgatctttaagaaacaacgcgagttcggattttctttctccaagaaattcgaagaggaagtgctcagcgttgcgttttataagagagccctgaaggatttctctcatcttgtgggcaactgctcctttttcaccgacgagaaacgggctcccaagaatagccctctggcctttatgttcgtcgctctcacaagaattatcaacctgcttaataacctgaaaaacaccgaaggcatcctctacacaaaggatgacctgaatgccctgctcaacgaggtgctgaaaaatgggacccttacatataagcagaccaagaaactgctcggactgtccgacgattacgagtttaagggcgaaaaagggacgtatttcattgagtttaagaaatacaaggagttcatcaaggcccttggagagcacaacctgtctcaggacgatctcaatgaaattgctaaagacatcaccctgattaaggatgagatcaaactgaagaaagcgctcgccaagtatgacctgaaccaaaatcagatcgatagcctttccaaactggagtttaaggaccatctcaacattagcttcaaggctctgaaactgatcacaccccttatgctcgaaggcaagaaatacgatgaggcctgtaatgaactgaacctgaaggttgccattaatgaggacaaaaaggattttctccctgctttcaacgagacctactataaggacgaagtgacaaatcccgtcgtgctgcgcgccatcaaagagtaccggaaggtgcttaacgcgctgctcaaaaagtatgggaaagtccacaagattaatatcgaactggctagagaggttggaaagaaccactctcagcgcgccaaaatcgaaaaggagcagaacgagaattacaaagccaagaaagacgctgaactggagtgcgaaaaacttggcctcaagattaactccaaaaatatcctgaagctgcggcttttcaaagagcaaaaggaattttgtgcctatagcggcgagaaaattaagatctctgatctgcaggacgagaaaatgcttgaaattgatcatatctacccttatagcagatccttcgacgattcttacatgaacaaggtgctggtgtttaccaagcagaatcaagagaaactcaacaagacgccgttcgaggcttttgggaatgacagcgccaaatggcagaagattgaagtcctggcgaaaaacctgcccacaaagaagcagaaacgcatccttgataagaattacaaagacaaggaacagaaagatttcaaggaccggaacctcaatgataccagatatatcgcccgcctggtgctgaactacacaaaggactatctcgattttctgcctctttccgacgacgagaataccaaactgaacgatacccaaaagggaagcaaagttcacgtggaggctaagtctggcatgctcacatccgccctgcggcatacgtgggggttcagcaccaaagacagaaataaccatctgcaccacgctattgatgccgtcatcattgcgtacgccaacaattctatcgtgaaggctttttccgacttcaagaaagaacaggagagcaactccgccgaactttatgctaagaaaatttctgagctcgattacaagaataaacgcaagtttttcgagccctttagcggattccggcagaaggttctggacaaaatcgatgaaatcttcgtgtccaagcctgagagaaagaagccctctggcgccctgcacgaagagacatttcggaaagaagaggagttctatcagagctacgggggaaaggaaggcgtcctcaaagccctggagcttggcaagattcgcaaggtgaacgggaaaatcgtcaagaatggagacatgtttagagtggatattttcaaacataagaaaaccaacaagttttacgctgttccgatctatacaatggacttcgcgctgaaggtgctccctaataaagccgtcgctcggtccaagaaaggcgaaattaaggattggatcctgatggacgagaactacgaattttgcttcagcctgtataaagattctcttatcctgattcaaaccaaggacatgcaggagcccgagtttgtgtactataatgccttcacgtccagcacagtttctctcatcgtgtccaagcacgacaacaaatttgaaaccctgagcaagaatcagaaaattctcttcaagaacgccaatgagaaagaagtcatcgctaagtctattgggatccagaacctgaaggtgttcgagaaatacatcgtgagcgcccttggagaagttaccaaggcggagtttagacaacgcgaggatttcaaaaagtga

SEQ ID NO: 3725 - RNA, 2955 nt, synthetic construct
  misc_feature 1..2955: note = Cas9 variant
  source 1..2955: mol_type = other RNA
atggccagaatcctggctttcgacattggcatcagctccattgggtgggccttttctgagaacgatgaactcaaggactgcggagtgcggatcttcaccaaagcggagaatcccaagacaggcgaaagcctggcccttcctcgcagactggctcggtccgcccgcaaaagactcgctcggcgcaaggccagactgaaccaccttaaacatctgattgctaatgagtttaagctcaactacgaagattatcagtctttcgacgagagcctggccaaggcgtacaaagggtccctgatctctccgtatgagctccggtttcgcgccctgaatgaacttctgagcaagcaagatttcgctagagtcatcctccacattgccaaacggcgcggatacgacgatatcaagaactccgacgataaagagaagggcgctattctgaaggccatcaaacagaatgaagagaaacttgcgaactatcagagcgttggggagtacctgtataaagaatactttcagaagttcaaagaaaattctaaggaatttacgaacgtgagaaataaaaaggagtcctacgaacggtgtattgcccagagcttcctcaaggacgagctgaaactgatctttaagaaacaacgcgagttcggattttctttctccaagaaattcgaagaggaagtgctcagcgtcgctttttataagagagccctgaaggatttctctcatcttgtgggcaactgctcctttttcaccgacgagaaacgggctcccaagaatagccctctggcctttatgttcgttgccctcacaagaattatcaacctgcttaataacctgaaaaacaccgaaggcatcctctacacaaaggatgacctgaatgctctgctcaacgaggtgctgaaaaatgggacccttacatataagcagaccaagaaactgctcggactgtccgacgattacgagtttaagggcgaaaaagggacgtatttcattgagtttaagaaatacaaggagttcatcaaggcgcttggagaccactctctgagccaggatgacctcaacgagattgccaaagatatcaccctgattaaggacgaaatcaaactgaagaaagctctcgccaagtatgatctgaatcaaaaccagatcgactcccttagcaaactggagtttaaggatcatctcaatatttctttcaaggccctgaaactgatcacaccccttatgctcgagggcaagaaatacgacgaggcttgtaacgaactgaatctgaaggtcgccattaacgaagataaaaaggactttctccctgcgttcaatgagacctactataaggacgaggtgacaaaccccgttgtgctgcgcgctatcaaagaataccggaaggtccttaatgccctgctcaaaaagtatgggaaagtgcacaagattaacatcgagctggccagagaagtgggaaagaattactcccagcgcgctaaaatcgagaaggaacagaacgagaactataaagccaagaaagatgctgagctggaatgcgagaaacttggcctcaagattaatagcaaaaacatcctgaagctgagactcttcaaagaacaaaaggagttttgtgcctactctggcgaaaagattaagatcagcgacctgcaggatgagaaaatgcttgagattgaccacatctatccttactcccggtctttcgatgacagctacatgaataaggtcctggtttttaccaagcagaaccaagaaaaactcaatcagacgccgttcgaggcgtttgggaacgattccgccaagtggcagaaaattgaagtgctggctaagaatctgcccacaaagaagcagaagcgcatccttgacaaaaactataaggataaagagcaaaaggacttcaaagatcggaatctcaacgacaccagatacatcgcccgcctggtgctgaattatacaaaggattacctcgactttctgcctcttagcgacgatgaaaacaccaagctgaatgacacccagaaaggatctaaggtccatgtggaggctaaatccggcatgctcacaagcgccctgcggcacacgtgggggttctctgcgaaggatagaaacaatcatctgcaccacgccattgacgctgttatcattgcctatgctaacaactccatcgtgaaagcctttagcgatttcaagaaggagcaggaatccaattctgccgagctttacgctaaaaagattagcgaactcgactataaaaacaagcgcaaatttttcgagcccttttccggattccggcagaaggtcctggataagatcgacgagatcttcgtgtctaaacctgaaagaaagaaacccagcggcgcgctgcatgaggaaacctttcggaaggaggaagagttctaccaatcctacgggggaaaagagggcgttctcaaggccctggaacttggcaaaattcgcaaggtgaatgggaagatcgtcaaaaacggagatatgtttagagtggacattttcaagcacaaaaagacaaataaattttatgctgtcccgatctacaccatggatttcgccctgaaggtgctccctaacaaggccgttgctcggagcaaaaagggcgagattaaagactggatcctgatggatgaaaattatgagttttgcttctctctgtacaaggactcccttatcctgattcagacaaaagacatgcaggaacccgagtttgtgtattacaacgccttcaccagctctacggtctccctcatcgtgagcaagcatgataataagtttgagacactgtctaaaaaccagaagattctcttcaaaaatgcgaacgaaaaggaggttatcgctaaaagcattgggatccaaaatctgaaggtgttcgaaaagtatatcgtctccgcccttggagaggtgaccaaagccgaatttagacagcgcgaggacttcaagaaatga

SEQ ID NO: 3726 - RNA, 2958 nt, synthetic construct
  misc_feature 1..2958: note = Cas9 variant
  source 1..2958: mol_type = other RNA
atggccaagatcctggctttcgacattggcatcagctccattgggtgggcctttgtggagaacgatgaactcaaagactgcggagtcagaatcttcaccaaggcggagaatcccaaaacaggcgaatctctggcgcttcctcggcgcctggccagaagcgcccggaagcgcctcgctagacggaaagcccgcctgaaccaccttaagcatctgattgctaatgagtttaagctcaactacgaagattatcagtccttcgacgagtctctggccaaagcgtacaaggggacgctgatcagcccgtatgagctcagatttaaagccctgaatgaacttctgtccaagcaagatctcgctcgggttatcctgcacattgccaaacgcagaggatacgacaacatcaaaaattctgatgacaaggagaagggcgctattcttaaggccgtgaaagaaaacgaggagaagctggcgaattataaaagcgtgggggaatacctctataaggagtacttccagaaatttaaggaaaactccaaggagttcatcaatgtccggaacaaaaaggaaagctacgagcgctgtattgcccagtcttttctgaaagatgagctgaagctcatcttccagaaacaaagagaatttggattcaatttttccaagaagttcgaggaagaggtgctgagcgttgctttctataaacgggcccttaaggacttttctcatctggtgggcaactgctccttctttgtcgatgaaaaacgcgctcccaagaatagccctctcgccttcgagtttgtggccctgaccagaattgttaaccttctgaacaatctcaacaaaaataactcttacatcaaggacgatctgaatgctctgctctccgaggtgctgaagaacggcacacttacctataaacagacaaagaaaatcctggggctcagcgacgactacgaatttaagggacagaaaggcaattatttcattgagttcaagaagtacaaagaatttatcaaggcgctgtgtgagcacaaccttaatcaggatgacctgaacgaaattgccaaagatatcaccctcgtcaaggacgagacaaaactgaagaaagctctggccaagtatgatctcaatcaaaaccagattgagaatctgtccaagatcgagttcaaagaccatcttaacatctcttttaaggccctgaaactcattgtgcccctgatgcgggaagggaagaaatacgatgaagtgtgcaatgagctgaaccttaagaccgctatcaacgaggacaagaaagagttcctccctgcctttaatgaaacgtactataaggatgaagtcaacaatcccgttgtgctgagagcgattaaagagtaccgcaaggtgctgaacagcctcctgaaaaagtatggaaaggtccacaaaatcaatattgaacttgctcgggaggtgggcaagaaccacagagagcgctccaaaatcgaaaaggagcagaatgaaaacttcaaagccaagaaggacgccgagctggaatgtgagaaactcgggctgaagatcaatagcaaaaacattctgaagctccggcttttcaaagagcagaaggaattttgcgtttactctggagagaaaatcaagatttccgatctgcaagacgaaaagatgctggagatcgaccatatttatccttacagcagatctttcgatgacagctatatgaataaagtgctcgtctttaccaagcagaaccaggaaaaactgaataagacaccgttcgaggcttttggcaaagatgacgtgaagtggcaaaagatcgagacccttgccaaaaacctgcccgctaagaaacagaagcgcattctcgataaaaattacaaggacaaggaacagaaagatttcaaggaccggaacctgaacgatacaagatacatcgcccgcctggttcttaattataccaaagactacctcgagtttctgcctctgtccgatgacgaaaacatcaagctcaatgatacgcagaaaggctctaaggtgcacgtcgaggctaagagcgggatgctgacatccgtgcttcggcatacctggggattcagcacaaaagacagaaacaatcatctgcaccacgccattgacgctgtcatcattgcctatgctaacgcctctgtggttaaggcgttttccgatttcaaaaaggagcaagaaaattacaccgccgagctctatgctaaaaagatcaacgaactggactttaagaataaacgcaagttctttgagcccttcagcaacttccggcagaaagtgctggaaaagattgatgagatctttgtctctaaacctgagagaaagaaaccctccggcgcccttcacgaagagaccttctacaaggaagaggaattttataaggagtacgggggaaaagagggcgtgctcaaggctctggaactggggaaaatccggaaggttaatggaaaaattgtgagcaacgccaatatgttccgcgtcgacatctttaagtacaagaaaacaaacaagttctatgccgtgccgatttacacgatggattttgctctcggcatcctgcctaataaagcggtggttggcgggaaggacaaacagggaattatcaaggattggcttctgatggacgagaactatgagttctgtttttccctctacaaggattctctgatcctgcttcagaccaaagacatgcaagaacccgaactggtctatttcaagagctttaaatcctctacagccggcctcgtggtgagcaagcatgataacaaattcgagaatctgaacgagaatcagaagaaactcttcaagtccgctaacgaaaagaaagtcgtggccgaggggattggaatccagaatctgaaggtttttgaaaaatacattgtgagcgcccttggcgagatcaccaaggctgagattaaagaaagagagaacttcaagaagaaatga

SEQ ID NO: 3727 - RNA, 2961 nt, synthetic construct
  misc_feature 1..2961: note = Cas9 variant
  source 1..2961: mol_type = other RNA
atgcccagcgaccctgccgaggctaagccgctggaactcctggatccctacgcccttagagcgcagggcctggaccaagctctccctctgacccacttcgggcgggccctttttcatctgaaccagcgcagaggattcaaatccaatcggaagacagatcgcggcgacaacgagaatgggaaaatcaaggatgcctctcagagactcgactgggctatgcacgaagccaaagctcggacgtatggagagtttctgcatctgcgcagacagaaggcccccgatcctcggcaagtgcccaccgtccgcacaagactcagcgttggcaagcgcgggggacctgacgcgaaagaagaggccggctacgatttctatccggaccggagacacctggaggaagagtttcatgaactttggtccgctcaggcccagttccaccccgagctgacccaggatctccgggacctggtgtttgagaagattttctaccaacgccctcttaaagaacccaaggtgggcctgtgcctctttacatctgaggaaagactggctaaagcccaccctctgacccagcggagagtcctctatgagacagtgaaccagctgcgcatcaccgcggatgggcggagcgttagacccctttcccgcgaacagcgggaccaaattatcctggccctcgacacgaagaagccgaccaaatctctgaatagcatggtggtcacacttcaggctctgggaaaggtgctcaaactgagagagggcgagcgcttcaccctggaatccggggttcgggaggccattgcttgtgatcctgtgagagccgccatgctcgctacatttggaccccgctggagcgcgctggactggcctgaacagtggcaagtcatctctcgggtgagaaaacttcaggatgacaaggatttcgccgagctggtggaatggctcatcgagctgtacggcgtcgacaaggaggctgccgttaaaattgccaacacccatcttcccgaagggtatggacgcctgggcctcacggctacaacccggatcctggatagactgaagtccaatgtgtttacatacgcccaggcggtggctgcctgcggctggcaccatagcgaccagcggaccggggagtgtctcgatcgcctgccctactatggagccgtccttgacagacacgtgattcctggcacctacgatgaaaacgacgacgatatcacacggttcgggagaattacgaatccgaccgttcacatcggactgaaccaactccgccggctggtgaataagattatcgaggtctatggcaaacccaaccagatcgtggttgaactggctagagagcttaagcagtctgagcagcagaaaaatgacgccattaagctcatccgcgatacaaccacagctgccaaacagagatccgaaaagctggaggaactggggattaccgacaacggacggaatcgcatgctcctgagactttgggaggatctgaaccctgacgatgcgatgcggcgcttctgcccctacacgggccagagaatcagcgccgctatgatttttgacggctcttgtgatgtggaccatatcctcccttattcccggacactggatgacgggttcgccaaccgcaccctgtgccttagagaggctaatcgggaaaagcgcaaccagaccccctgggaggcctggggaggcacaccgaattgggaagcgatcgagaccaacctcaaaaatctgcctgaaaacaagagatggcggtttgcccccgatgctatggccagattcgagggggagaatgactttctggaccgcgctctcgtcgatacacaatacctggcccggattagcagaacgtatcttgacaccctgttcacagaaggaggccacgtgtgggtcgtgcctgggcgcctcaccgagatgctgcggagacattggggcctgaactcccttctcacagataaagaccgcggagccgttaagtctaaaaatcggaccgatcacagacatcacagcatcgacgctgcggtggtcgccgctacggatcgctccctgctgaaccggattagcagagccgccggccagggggaagtggctggacagtctgccgagctcatcgcgcgggaaacaccccctccctgggagggctttcgcaatgacctgaagtcccagcttgggagaattatcgttagccaccgggctgatcatggacgcatcgacagacaagcccggaagcagggcagagattctacagccgggcagctgcaccaagagaccgcttacagcattgtggacgatacacgcgtcgcctcccggatcgacttcctctctgtgaaaccggcgcagctgctggaccagcctggcagaagcggacaggtgcgcgatcttcaactccggaaggctctgagagttgccaccggcgacctgacggggaaagattacgaaaaggccctccgcgactttgctgccaaacccggaccctataagggcattcggagagtccgcatcattaagcctctgcaggagcaggctagagtgccggtgcccgtccttgatcctatcaaagcctaccaagggggatccaaccatgtgttcgaaatttggcatctgcccgacggcaaggttgagcctcaagtgatcaccagctttgaagcgcacgccctcgaggtcgagaaacggccccaccctgctgccaagcgcctgctgagagtgcacaaaggggatatggttgctcttaagcgggaaggccgcaccgtggtcggacatgtgcagcagatgcacatcaaaaatggcctgttcattgttccccataacgaggccaatgccgacgctagaaactctgatcggacagacccgtttaagtggatccagattgcggcccaacctgctatcgccgccgggattagacgcgtggctgtcgatgaaatcggacggctcagagacggcggggccaagaccatctga

SEQ ID NO: 3728 - RNA, 2964 nt, synthetic construct
  misc_feature 1..2964: note = Cas9 variant
  source 1..2964: mol_type = other RNA
atggccagaatcctggctttcgacattggcatcagctccattgggtgggccttttctgagaacgatgaactcaaggactgcggagtgcggatcttcaccaaagcggagaatcccaagacaggcgaaagcctggcccttcctcgcagactgtcccggtctgctcgcaaaagactcgcccggcgcaaggctagactgaaccaccttaaacatctgattgccaatgagtttaagctcaactacgaagattatcagagcttcgacgagtccctggctaaggcctacaaagggtctctgatcagcccgtatgagctccggtttcgcgcgctgaatgagttcctttccaagcaagattttgccagagtcatcctgcacattgctaaacggcgcggatacgacgatatcaagaacaatggcgacgaggaaaaaggggagattctcaaggccatcaagcagaacgaggaaaaactggttagctatcagtctgtgggagagtacctttataaggaatacttccagaaatttaaggaaaattccaaagagttcattaacgtgagaaataagaaagaaagctacgagcggtgtatcgctcaatcttttctgaaggatgaactcaagctgattttccagaaacagcgcgagtttggcttctccttcagcaagaaatttgaagaggaagtcctgtctgtggccttctataagagagcgctcaaagacttttcccatctggttggcaactgcagcttctttacggatgagaagcgggcccccaaaaattcccctcttgctttcatgtttgtggccctgaccagaatcatcaacctcctgaataaccttaagaacacagaggggattctgtacaccaaggacgatctcaatacactgctgaacgaagtcctcaaaaatggaaccctgacatataagcagaccaaaaagctgcttggcctctctaacgactacgagttcaagggggaaaaaggaacgtattttatcgagttccaaaagtacaaagaatttgtgaaggctctgggcgagcacaatcttagccaggacgatctgaacgagattgccaaagacatcaccctcattaaggatgaaatcaagctgaaaaaggccctggctaaatatgacctcaatcagaaccagatcgattccctgagcaaacttgagttcaaggaccatctgaatatttcttttaaggcgctcaaactgatcacacccctgatgcttgaagggaagaagtacgatgaggcctgtaacgagctcaatctgaaagttgctattaacgaagacaagaaagatttcctgcctgccttcaatgagacctactataaggacgaagtgacaaaccccgtcgtgctccgcgccatcaaagagtaccggaaggtgctgaatgcccttctgaagaaatatggaaaggtccacaaaattaacatcgaactcgctagagaggttggcaagaaccactcccaacgcgcgaaaatcgagaaggaacagaatgagaactacaaggctaaaaaggatgccgaactggagtgcgaaaaactgggccttaagattaatagcaaaaacatcctcaagctgcggctgtttaaggagcagaaagagttctgtgtgtattctggggaaaagattaaaatcagcgacctccaagacgagaagatgctggaaattgatcatatctacccttattccagatcttttgacgatagctacatgaataaagtgcttgtcttcaccaagcagaaccaggagaaactgaataagacgccgtttgaaacattcggaaacgaccgcgtgaagtggcagaaaattgaggttctcgccaagaatctgcccaccaaaaagcaaaaacggatcctggataagaactacaaggacaaagagcagaaggattttaaagacagaaatcttaacgatacacgctatatcgctcggctcgtgctgaattacaccaaggactatctggatttcctccctctgtccgacgatgaaaacaccaaacttaatgacacacagaagggcagcaaggtccacgtggaggccaaatctgggatgctgacgtccaccctcagacatacatggggatttagcaccaaggaccgcgataaccatctgcaccacgctattgacgccgcgatcattgcctacgctaacaattctatcgttaaagccttctccgattttaagaaagaacaggagagcaacacagctgagctgtatgccaagaagatttccgaacttgactacaaaaataagcggaaattctttgagcccttctctggcttcagacaaaagctcctggataaaatcgacgaaatctttgtgagcaagcctgagcggaagaaaccctccggggcgctgcacgaagagaccttccgcaaggaggaagagttttatcagtcttacggaggcaaagaaggcgtcctcaaggccctggagcttgggaaaattagaaaggtgaacggaaaaatggtcaagaatggcgatatgttccgggtggacatctttaagcataaaaagacgaacaaattctacgctgttccgatttatacaatggattttgccctgaaggtgctccctaataaagctgtcgtgcaggggaaggacaagaaaagcggactgatcaaggattggattctgatggacgaaaactacgagttctgcttttccctttataaagatagcctgatcctcatccagaccaaggacatgcaagagcccgaactggtttactatgagagactcgactcttccaatgccagcctgaccgtgtctaaacacgataacaagttcgaaacactttccaagaatcagaaaattctgtttaagaacgccaatgagaaagaagtcatcgctaagagcattggcatccagaacctcaaagtgttcgagaagtacattgtgtctgcgctgggggaggttaccaaggccgagttccgccagcgggaagactttaaaaagtga

SEQ ID NO: 3729 - RNA, 2964 nt, synthetic construct
  misc_feature 1..2964: note = Cas9 variant
  source 1..2964: mol_type = other RNA
atggccagaatcctggctttcgacattggcatcagctccattgggtgggccttttctgagaacgatgaactcaaggactgcggagtgcggatcttcaccaaagcggagaatcccaagacaggcgaaagcctggcccttcctcgcagactggctcggtccgcccgcaaaagactcgctcggcgcaaggccagactgaaccaccttaaacatctgattgctaatgagtttaagctcaactacgaagattatcagtctttcgacgagagcctggccaaggcgtacaaagggtccctgatctctccgtatgagctccggtttcgcgccctgaatgaacttctgagcaagcaagatttcgctagagtcatcctccacattgccaaacggcgcggatacgacgatatcaagaactccgacgataaagagaagggcgctattctgaaggccatcaaacagaatgaagagaaacttgcgaactatcagagcgttggggagtacctgtataaagaatactttcagaagttcaaagaaaattctaaggaatttacgaacgtgagaaataaaaaggagtcctacgaacggtgtattgcccagagcttcctcaaggacgagctgaaactgatctttaagaaacaacgcgagttcggattttctttctccaagaaattcgaagaggaagtgctcagcgtcgctttttataagagagccctgaaggatttctctcatcttgtgggcaactgctcctttttcaccgacgagaaacgggctcccaagaatagccctctggcctttatgttcgttgccctcacaagaattatcaacctgcttaataacctgaaaaacaccgaaggcatcctctacacaaaggatgacctgaatgctctgctcaacgaggtgctgaaaaatgggacccttacatataagcagaccaagaaactgctcggactgtccgacgattacgagtttaagggcgaaaaagggacgtatttcattgagtttaagaaatacaaggagttcatcaaggcgcttggagaccactctctgagccaggatgacctcaacgagattgccaaagatatcaccctgattaaggacgaaatcaaactgaagaaagctctcgccaagtatgatctgaatcaaaaccagatcgactcccttagcaaactggagtttaaggatcatctcaatatttctttcaaggccctgaaactgatcacaccccttatgctcgagggcaagaaatacgacgaggcttgtaacgaactgaatctgaaggtcgccattaacgaagataaaaaggactttctccctgcgttcaatgagacctactataaggacgaggtgacaaaccccgttgtgctgcgcgctatcaaagaataccggaaggtccttaatgccctgctcaaaaagtatgggaaagtgcacaagattaacatcgagctggccagagaagtgggaaagaattactcccagcgcgctaaaatcgagaaggaacagaacgagaactataaagccaagaaagatgctgagctggaatgcgagaaacttggcctcaagattaatagcaaaaacatcctgaagctgagactcttcaaagaacaaaaggagttttgtgcctactctggcgaaaagattaagatcagcgacctgcaggatgagaaaatgcttgagattgaccacatctatccttactcccggtctttcgatgacagctacatgaataaggtcctggtttttaccaagcagaaccaagaaaaactcaatcagacgccgttcgaggcgtttgggaacgattccgccaagtggcagaaaattgaagtgctggctaagaatctgcccacaaagaagcagaagcgcatccttgacaaaaactataaggataaagagcaaaaggacttcaaagatcggaatctcaacgacaccagatacatcgcccgcctggtgctgaattatacaaaggattacctcgactttctgcctcttagcgacgatgaaaacaccaagctgaatgacacccagaaaggatctaaggtccatgtggaggctaaatccggcatgctcacaagcgccctgcggcacacgtgggggttctctgcgaaggatagaaacaatcatctgcaccacgccattgacgctgttatcattgcctatgctaacaactccatcgtgaaagcctttagcgatttcaagaaggagcaggaatccaattctgccgagctttacgctaaaaagattagcgaactcgactataaaaacaagcgcaaatttttcgagcccttttccggattccggcagaaggtcctggataagatcgacgagatcttcgtgtctaaacctgaaagaaagaaacccagcggcgcgctgcatgaggaaacctttcggaaggaggaagagttctaccaatcctacgggggaaaagagggcgttctcaaggccctggaacttggcaaaattcgcaaggtgaatgggaagatcgtcaaaaacggagatatgtttagagtggacattttcaagcacaaaaagacaaataaattttatgctgtcccgatctacaccatggatttcgccctgaaggtgctccctaacaaggccgttgctcggagcaaaaagggcgagattaaagactggatcctgatggatgaaaattatgagttttgcttctctctgtacaaggactcccttatcctgattcagacaaaagacatgcaggaacccgagctcgtgtattttaacgccttcaccagctctacggtctccctgatcgtgagcaagcatgataataagtttgagacactctctaaaaaccagaagattctgttcaaaaatgcgaacgaaaaggaggttatcgctaaaagcattgggatccaaaatcttaaggtgttcgaaaagtacatcgtctccgccctgggagaggtgaccaaagccgaatttagacagcgcgaggacttcaagaacgagctccggtga

SEQ ID NO: 3730 - RNA, 2964 nt, synthetic construct
  misc_feature 1..2964: note = Cas9 variant
  source 1..2964: mol_type = other RNA
atggccagaatcctggctttcgacattggcatcagctccattgggtgggccttttctgagaacgatgaactcaaggactgcggagtgcggatcttcaccaaagcggagaatcccaagacaggcgaaagcctggctctccctcgcagactggcccggtccgcccgcaaaagactcgctcggcgcaaggccagactgaaccaccttaaacatctgattgctaatgagtttaagctcaactacgaagattatcagtctttcgacgagagcctggccaaggcgtacaaagggtccctgatctctccgtatgagctccggtttcgcgccctgaatgaacttctgagcaagcaagatttcgctagagtcatcctccacattgccaaacggcgcggatacgacgatatcaagaacaatggcgacgaggaaaaatccgagattctgaaggctatcaagcagaacgaggaaaaacttgttaattatcagagcgtgggggagtacctgtataaggaatactttcagaaattcaaggagaactctaaagaatttattaatgtgagaaacaagaaagagtcctacgagcggtgtatcgcccagagcttcctcaaggatgaactgaagctgatttttcaaaaacagcgcgagttcggattttctttctccaagaaattcgaagaggaagtcctcagcgtggcgttttataagagagccctgaaagacttctctcatcttgttggcaattgctcctttttcacggatgagaagcgggctcccaagaacagccctctggtgtttatgttcgtcgccctcaccagaatcatcaatctgcttaacaacctgaaaaatacagagggcattctctacaccaaggacgatctgaacgctctgctcaatgaagtgctgaaaaacgggacacttacctataagcagaccaaaaagctgctcggactgtccgacgactacgagtttaagggcgaaaaagggacctatttcatcgagtttaagaaatacaaggagttcattaaagcccttgatgaacactctctgagccaagacgatctcaatgagatcgccaaggacattacgctgatcaaggatgaaatcaaactgaagaaagctctcgcgaagtatgacctgaaagagaaccagattgattcccttagcaagctggaatttaaagaccatctcaatatctctttcaaggccctgaagctgattacaccccttatgctcgagggcaaaaagtacgatgaggcttgtaacgaactgaatctgaaagttgccatcaacgaggacaagaaagattttctccctgccttcaatgaaacatactataaggacgaggtgaccaaccccgtcgtgctgcgcgctattaaggaataccggaaaatccttaatgccctgctcaagaaatatggaaaggtgcacaaaatcaacattgagctggcgagagaggtcgggaagaatcactcccagcgcgctaagatcgaaaaagagcagaacgaaaactacaaggccaaaaaggacgccgagctggaatgcgagaaacttggactcaagattaatagcaagaacatcctgaaactgcggcttttcaaggagcaaaaagaattttgtgtttattctggcgagaagattaaactgagcgatcttcaggacgaaaagatgctggagatcgatcatatttacccttattccagatctttcgacgatagctacatgaataaagtgctcgtgtttgctaagcagaaccaagaaaagctgaataaaacaccgttcgaggcctttggcaacgactccaccaagtggcagaaaatcgaggtcctgacgaagaatcttcccaccaaaaagcagaagcgcatcctcgataaaaactacaaggacaaagaacagaaggatttcaaagaccggaatctgaacgatacaagatatattgctcgcctggtgctcaattacacaaaggactatctggattttcttcctctgagcgacgacgagaacaccaagctcaatgatacccaaaaagggtctaaggttcacgtggaagccaaatccggaatgctgacaagcgcgctgcggcatacgtggggcttctctaccaaggacagaaacaatcaccttcaccatgccatcgatgctgtcattatcgcctacgctaacaactccattgtgaaagcctttagcgacttcaagaaggagcaggagtccaattctgcggaactctatgccaaaaagatcagcgagctggattacaaaaacaagcgcaaatttttcgaacccttttccgggttccggcagaaggttctggacaagatcgatgagattttcgtgtctaaacctgaaagaaagaaacccagcggagctctccacgaggagacatttcggaaggaagaggagttctatcagtcctacggcgggaaagaaggagtcctgaaggcccttgaactgggcaaaatccgcaaggtgaatggcaagattgtcaaaaacggggacatgtttagagtggatatcttcaagcataaaaagaccaataaattttacgctgttccgatttatacaatggacttcgccctcaaggtgctgcctaacaaggccgtcgctcggagcaaaaagggagagatcaaagattggatcctgatggacgagaattacgaattttgcttctctctttataaggattccctgattctcatccaaaccaaagacatgcaggagcccgaactggtgtactttaacgcgttcacgagctctacagtttccctcattgtgagcaagcacgacaataagtttgagaccctgtctaaaaaccagaagatccttttcaaaaatgccaacgaaaaggaggtcattgctaaaagcatcggcatccagaatctgaaggtgttcgagaagtatattgtgtccgccctcggggaagttaccaaagccgagtttagacaacgcgaagatttcaagaacgagctgcggtga

SEQ ID NO: 3731 - RNA, 2964 nt, synthetic construct
  misc_feature 1..2964: note = Cas9 variant
  source 1..2964: mol_type = other RNA
atggccagaatcctggctttcgacattggcatcagctccattgggtgggccttttctgagaacgatgaactcaaggactgcggagtgcggatcttcaccaaagcggagaatcccaagacaggcgaaagcctggcccttcctcgcagactggctcggtccgcccgcaaaagactcgctcggcgcaaggccagactgaaccaccttaaacatctgattgctaatgagtttaagctcaactacgaagattatcagtctttcgacgagagcctggccaaggcgtacaaagggtccctgatctctccgtatgagctccggtttcgcgccctgaatgaacttctgagcaagcaagatttcgctagagtcatcctccacattgccaaacggcgcggatacgacgatatcaagaactccgacgataaagagaagggcgctattctgaaggccatcaaacagaatgaagagaaacttgcgaactatcagagcgttggggagtacctgtataaagaatactttcagaagttcaaagaaaattctaaggaatttacgaacgtgagaaataaaaaggagtcctacgaacggtgtattgcccagagcttcctcaaggacgagctgaaactgatctttaagaaacaacgcgagttcggattttctttctccaagaaattcgaagaggaagtgctcagcgtcgctttttataagagagccctgaaggatttctctcatcttgtgggcaactgctcctttttcaccgacgagaaacgggctcccaagaatagccctctggcctttatgttcgttgccctcacaagaattatcaacctgcttaataacctgaaaaacaccgaaggcatcctctacacaaaggatgacctgaataccctgctcaacgaggtgctgaaaaatgggacacttacctataagcagacgaagaaactgctcggactgtccgacgattacgagtttaagggcgaaaaagggacctatttcattgagtttaagaaatacaaggagttcatcaaggctcttggagagcacaacctgtctcaggacgatctcaatgaaattgcgaaagacatcacactgattaaggatgagatcaaactgaagaaagccctcgctaagtatgacctgaaccaaaatcagatcgatagcctttccaaactggagtttaaggaccatctcaacattagcttcaaggccctgaaactggtcacaccccttatgctcgaaggcaagaaatacgatgaggcctgtaatgaactgaacctgaaggtggctatcaatgaggacaaaaaggattttctccctgccttcaacgagacctactataaggacgaagttaccaatcccgtggtcctgcgcgcgattaaagagtaccggaaggtgcttaacgctctgctcaaaaagtatgggaaagtgcacaagatcaatattgaactggccagagaggtcggaaagaaccactctcagcgcgccaaaatcgaaaaggagcagaacgagaattacaaagctaagaaagacgccgaactggagtgcgaaaaacttggcctcaagatcaactccaagaatattctgaagctgagactcttcaaagagcaaaaggaattttgtgcttatagcggcgagaaaatcaagatttctgatctgcaggacgagaaaatgcttgaaatcgatcatatttacccttatagccggtccttcgacgattcttacatgaacaaggttctggtgtttacgaagcagaatcaagagaaactcaaccagacaccgttcgaagcctttgggaatgacagcgcgaagtggcagaaaatcgaggtgctggccaagaacctgcccaccaaaaagcagaagcgcattcttgataaaaattacaaggacaaagaacaaaagaacttcaaagatcggaatctcaacgacacaagatatatcgctcgcctggtcctgaattacaccaaggattatctcgactttctgcctctttccgatgacgagaacaccaagctgaatgacacacagaaaggaagcaaggtgcacgttgaggccaaatctggcatgctcacgtccgctctgcggcatacctgggggttcagcgccaaggatagaaacaaccatctgcaccacgcgatcgacgccgtgattatcgcttacgccaataactctattgtcaaggctttttccgatttcaagaaggaacaggagagcaattccgccgaactttatgccaaaaagatctctgagctcgactacaaaaacaagcgcaaatttttcgagccctttagcggattccggcagaaggtgctggataagattgacgaaatcttcgtttccaaacctgagagaaagaaaccctctggcgctctgcacgaagagacatttcggaaggaagaggagttctatcaaagctacgggggaaaagaaggcgtgctcaaggcgctggagcttggcaaaatccgcaaggtcaatgggaagattgtgaaaaacggagatatgtttagagtcgacatcttcaagcataaaaagaccaataaattttacgccgtgccgatttatacaatggatttcgctctgaaggttctccctaacaaggccgtggcccggtccaaaaagggcgaaatcaaagactggattctgatggatgagaattacgaattttgcttcagcctgtataaggactctcttatcctgatccagaccaaagatatgcaggagcccgagctcgtctactttaacgctttcacgtccagcacagtgtctctgattgtttccaagcacgacaataagtttgaaaccctcagcaaaaaccagaagatcctgttcaaaaatgccaacgagaaggaagtgattgcgaaatctatcgggattcaaaatcttaaggtcttcgagaagtatatcgtgagcgctctgggagaagtgaccaaagccgagtttagacagcgcgaggacttcaagaacgaactccggtga

SEQ ID NO: 3732 - RNA, 2964 nt, synthetic construct
  misc_feature 1..2964: note = Cas9 variant
  source 1..2964: mol_type = other RNA
atggccagaatcctggctttcgacattggcatcagctccattgggtgggccttttctgagaacgatgaactcaaggactgcggagtgcggatcttcaccaaagcggagaatcccaagacaggcgaaagcctggcccttcctcgcagactggctcggtccgcccgcaaaagactcgctcggcgcaaggccagactgaaccaccttaaacatctgattgctaatgagtttaagctcaactacgaagattatcagtctttcgacgagagcctggccaaggcgtacaaagggtccctgatctctccgtatgagctccggtttcgcgccctgaatgaacttctgagcaagcaagatttcgctagagtcatcctccacattgccaaacggcgcggatacgacgatatcaagaactccgacgataaagagaagggcgctattctgaaggccatcaaacagaatgaagagaaacttgcgaactatcagagcgttggggagtacctgtataaagaatactttcagaagttcaaagaaaattctaaggaatttacgaacgtgagaaataaaaaggagtcctacgaacggtgtattgcccagagcttcctcaaggacgagctgaaactgatctttaagaaacaacgcgagttcggattttctttctccaagaaattcgaagaggaagtgctcagcgtcgctttttataagagagccctgaaggatttctctcatcttgtgggcaactgctcctttttcaccgacgagaaacgggctcccaagaatagccctctggcctttatgttcgttgccctcacaagaattatcaacctgcttaataacctgaaaaacaccgaaggcatcctctacacaaaggatgacctgaatgctctgctcaacgaggtgctgaaaaattccacccttacatataagcagaccaagaaactgctcgggctgtctgacgattacgagtttaagggagaaaaaggcacgtatttcattgagtttaagaaatacaaggagttcatcaaggcgcttggggaccacagcctgtcccaggatgacctcaacgagattgccaaagatatcaccctgattaaggacgaaatcaaactgaagaaagctctcgccaagtatgatctgaatcaaaaccagatcgacagcctttctaaactggagtttaaggatcatctcaatatttccttcaaggccctgaaactgatcacaccccttatgctcgagggaaagaaatacgacgaggcttgtaacgaactgaatctgaaggtcgccattaacgaagataaaaaggactttctccctgcgttcaatgagacctactataaggacgaggtgacaaaccccgttgtgctgcgcgctatcaaagaataccggaaggtccttaatgccctgctcaaaaagtatggcaaagtgcacaagattaacatcgagctggccagagaagtggggaagaattacagccagcgcgctaaaatcgagaaggaacagaacgagaactataaagccaagaaagatgctgagctggaatgcgagaaacttggactcaagattaattctaaaaacatcctgaagctgagactcttcaaagaacaaaaggagttttgtgcctacagcggcgaaaagattaagatctccgacctgcaggatgagaaaatgcttgagattgaccacatctatccttactctcggagcttcgatgactcctacatgaataaggtcctggtttttaccaagcagaaccaagaaaaactcaataagacgccgttcgaggcgtttggcaacgatagcgccaaatggcagaagattgaagtgctggctaaaaatctgcccacaaagaagcagaaacgcatccttgacaagaactataaagataaggagcagaaagacttcaaggatcggaatctcaacgacaccagatacatcgcccgcctggtgctgaattatacaaaggattacctcgactttctgcctctttctgacgatgaaaacaccaaactgaatgacacccaaaaggggtccaaagtccatgtggaggctaagagcggaatgctcacatctgccctgcggcacacgtggggcttctccgcgaaagatagaaacaatcatctgcaccacgccattgacgctgttatcattgcctatgctaacaacagcatcgtgaaggccttttccgatttcaagaaagagcaggaatctaatagcgccgagctttacgctaagaaaatttccgaactcgactataagaacaaacgcaagtttttcgagcccttttctgggttccggcagaaggtcctggataaaatcgacgagatcttcgtgagcaagcctgaaagaaagaagccctccggagcgctgcatgaggaaacctttcggaaagaggaagagttctaccagagctacggcgggaaggagggagttctcaaagccctggaacttggcaagattcgcaaggtgaatggcaaaatcgtcaagaacggggatatgtttagagtggacattttcaaacacaagaaaacaaataagttttatgctgtcccgatctacaccatggatttcgccctgaaggtgctccctaacaaagccgttgctcggtctaagaaaggagagattaaggactggatcctgatggatgaaaattatgagttttgcttctccctgtacaaagacagccttatcctgattcaaacaaaggacatgcaggaacccgagctcgtgtattttaacgccttcacctcttccacggtcagcctgatcgtgtctaagcatgataataaatttgagacactcagcaagaaccagaaaattctgttcaagaatgcgaacgaaaaagaggttatcgctaagtccattggcatccagaatcttaaggtgttcgaaaaatacatcgtcagcgccctgggggaggtgaccaaggccgaatttagacaacgcgaggacttcaaaaacgagctccggtga

SEQ ID NO: 3733 - RNA, 2964 nt, synthetic construct
  misc_feature 1..2964: note = Cas9 variant
  source 1..2964: mol_type = other RNA
atggccagaatcctggctttcgacattggcatcagctccattgggtgggccttttctgagaacgatgaactcaaggactgcggagtgcggatcttcaccaaagcggagaatcccaagacaggcgaaagcctggcccttcctcgcagactggctcggtccgcccgcaaaagactcgctcggcgcaaggccagactgaaccaccttaaacatctgattgctaatgagtttaagctcaactacgaagattatcagtctttcgacgagagcctggccaaggcgtacaaagggtccctgatctctccgtatgagctccggtttcgcgccctgaatgaacttctgagcaagcaagatttcgctagagtcatcctccacattgccaaacggcgcggatacgacgatatcaagaactccgacgataaagagaagggcgctattctgaaggccatcaaacagaatgaagagaaacttgcgaactatcagagcgttggggagtacctgtataaagaatactttcagaagttcaaagaaaattctaaggaatttacgaacgtgagaaataaaaaggagtcctacgaacggtgtattgcccagagcttcctcaaggacgagctgaaactgatctttaagaaacaacgcgagttcggattttctttctccaagaaattcgaagaggaagtgctcagcgtcgctttttataagagagccctgaaggatttctctcatcttgtgggcaactgctcctttttcaccgacgagaaacgggctcccaagaatagccctctggcctttatgttcgttgccctcacaagaattatcaacctgcttaataacctgaaaaacaccgaaggcatcctctacacaaaggatgacctgaatgctctgctcaacgaggtgctgaaaaatgggacccttacatataagcagaccaagaaactgctcggactgtccgacgattacgagtttaagggcgaaaaagggacgtatttcattgagtttaagaaatacaaggagttcatcaaggcgcttggagaccactctctgagccaggatgacctcaacgagattgccaaagatatcaccctgattaaggacgaaatcaaactgaagaaagctctcgccaagtatgatctgaatcaaaaccagatcgactcccttagcaaactggagtttaaggatcatctcaatatttctttcaaggccctgaaactgatcacaccccttatgctcgagggcaagaaatacgacgaggcttgtaacgaactgaatctgaaggtcgccattaacgaagataaaaaggactttctccctgcgttcaatgagacctactataaggacgaggtgacaaaccccgttgtgctgcgcgctatcaaagaataccggaaggtccttaatgccctgctcaaaaagtatgggaaagtgcacaagattaacatcgagctggccagagaagtgggaaagaattactcccagcgcgctaaaatcgagaaggaacagaacgagaactataaagccaagaaagatgctgagctggaatgcgagaaacttggcctcaagattaatagcaaaaacatcctgaagctgagactcttcaaagaacaaaaggagttttgtgcctactctggcgaaaagattaagatcagcgacctgcaggatgagaaaatgcttgagattgaccacatctatccttactcccggtctttcgatgacagctacatgaataaggtcctggtttttaccaagcagaaccaagaaaaactcaatcagacgccgttcgaggcgtttgggaacgattccgccaagtggcagaaaattgaagtgctggctaagaatctgcccacaaagaagcagaagcgcatccttgacaaaaactataaggataaagagcaaaaggacttcaaagatcggaatctcaacgacaccagatacatcgcccgcctggtgctgaattatacaaaggattacctcgactttctgcctcttagcgacgatgaaaacaccaagctgaatgacacccagaaaggatctaaggtccatgtggaggctaaatccggcatgctcacaagcgccctgcggcacacgtgggggttctctgcgaaggatagaaacaatcatctgcaccacgccattgacgctgttatcattgcctatgctaacaactccatcgtgaaagcctttagcgatttcaagaaggagcaggaatccaattctgccgagctttacgctaaaaagattagcgaactcgactataaaaacaagcgcaaatttttcgagcccttttccggattccggcagaaggtcctggataagatcgacgagatcttcgtgtctaaacctgaaagaaagaaacccagcggcgcgctgcatgaggaaacctttcggaaggaggaagagttctaccaatcctacgggggaaaagagggcgttctcaaggccctggaacttggcaaaattcgcaaggtgaatgggaagatcgtcaaaaacggagatatgtttagagtggacattttcaagcacaaaaagacaaataaattttatgctgtcccgatctacaccatggatttcgccctgaaggtgctccctaacaaggccgttgctcggagcaaaaagggcgagattaaagactggatcctgatggatgaaaattatgagttttgcttctctctgtacaaggactcccttatcctgattcagacaaaagacatgcaggaacccgagtttgtgtattacaacgccttcaccagctctacggtctccctcatcgtgagcaagcatgataataagtttgagacactgtctaaaaaccagaagattctcttcaaaaatgcgaacgaaaaggaggttatcgctaaaagcattgggatccaaaatctgaaggtgttcgaaaagtatatcgtctccgcccttggagaggtgaccaaagccgaatttagacagcgcgaggacttcaagaacgagctgcggtga

SEQ ID NO: 3734 - RNA, 2979 nt, synthetic construct
  misc_feature 1..2979: note = Cas9 variant
  source 1..2979: mol_type = other RNA
atgagaatcttcagcgacggccggaaccccaaggatgggtcctctctggccgtgacccgcagagctgcccgggcgatgcgcagacggcgcgacagactcctgaaacggaagacacgcatgcaggctaaacttgtcgagcacggatttttccctgccgatgccggcaagagaaaagctctggaacaactcaatccgtacgccctgcgggctaaggggcttcaggaggccctgctccccggagaatttgcgcgcgccctgttccatattaaccagagacggggctttaagagcaatcgcaaaacggacaagaaagataacgactccggggttctgaagaaagctatcggacagctcagacaacagatggccgagcagggctctcggaccgtgggcgaatatctgtggacaagacttcagcaagggcagggagtgcgcgctcggtacagagagaagccttataccacagaggaaggcaagaaacgcattgataagagctacgacctgtatatcgatcgggccatgattgagcaggagttcgacgcgctctgggccgctcaggccgcttttaatcccaccctgttccacgaggccgccagagctgatcttaaagacacactgctccatcaacgccctctgcggcccgtcaagcctgggagatgcaccctgctcccggaggaagaacgcgcgcccctggcccttccttccacgcagcggtttagaatccaccaggaagtgaaccatctgcgcctcctggatgagaatcttcgggaagttgctctgaccctcgcccaaagagacgccgtggtcacagctctggagaccaaagccaagctgtctttcgagcagatccggaaactcctgaaacttagcggatccgtgcagtttaacctggaagacgcgaagcgcacagagctcaaaggcaatgctaccagcgccgccctggctagaaaggaacttttcggggccgcttggtctggatttgatgaggccctgcaggacgaaattgtttggcaactcgtgacggaggagggcgaaggcgcgctgatcgcctggctgcagacacacaccggggtcgatgaggctcgggcccaggctattgtggacgtgtccctccccgaaggatacggcaacctgagcagaaaagcccttgcgcgcatcgtccctgccctgcgggctgccgttattacatatgataaggctgtgcaggccgccgggttcgaccaccattctcaactcggattcgagtacgatgcttccgaagtggaggacctggtccaccccgagaccggcgaaatcagaagcgtgtttaaacagctgccgtactatgggaaggcgcttcagcgccatgttgccttcggatctggcaagcctgaggatcccgacgaaaagagatacggcaagattgctaatcctaccgtgcacatcgggctcaaccaggtccggatggtggttaatgccctgatccgcagatatggacggcccacagaggtggtcattgagctggcccgcgatctcaaacaatccagagaacagaaggtggaggctcagcggcgccaggccgacaaccaaagacggaatgcgcgcatcagacggagcattgctgaagtcctgggcatcggggaggaaagagtgcgcggatccgacattcagaaatggatctgttgggaggagctttcttttgatgccgccgaccggagatgcccctacagcggcgttcagatctccgctgccatgctgctcagcgatgaagtggaggtcgaacacattctgcctttctctaagacgctggacgattcccttaacaaccgcaccgtggcgatgcggcaagctaatagaatcaagcgcaaccggacaccgtgggacgccagagccgagtttgaagctcaggggtggagctatgaggatattctccagcgcgccgagcggatgcccctgagaaaacggtaccgcttcgctcctgacggctatgaaagatggctgggagatgacaaggattttctcgcccgggcgctgaatgacacccgctacctttctagagttgccgctgagtacctgcggctcgtgtgtcccggcacaagagtcatccctgggcagctgaccgccctgcttcgcggaaaattcggcctcaacgatgtgctggggctggacggagaaaagaatcggaacgaccatagacaccatgctgtggatgcctgcgttattggcgtcacggaccaagggctcatgcagcgctttgccacagctagcgcgcaggcccggggcgatggactgaccagacttgtggacggcatgcccatgccgtggcctacctatcgcgatcacgtggagcgggctgtcagacatatctgggtgtcccaccgccccgaccacgggttcgaaggagccatgatggaggagacatcttacggcatcagaaaagatgggagcattaagcagcggcgcaaggccgacggatccgctggcagagaaatcagcaatctgattcggatccatgaggccacccaacctctccgccacggggtttctgcggatggccagcccctggcttataaaggatacgtgggcgggtccaactattgtattgaaatcacagtcaatgacaagggaaaatgggagggcgaggtgattagcacgtttagagcctacggggttgtgcgggccggaggcatggggagactgcgcaaccctcatgaaggccagaatggacggaaacttatcatgagactcgtcatcggcgattctgtgcgcctggaggttgacggggctgaacggaccatgagaattgtgaagatctccggaagcaacggccagattttcatggcccccatccacgaggcgaatgtcgatgctcggaacacagacaagcaagacgcctttacctatacatccaaatacgccgggtctctgcagaaggctaagacccgcagagtgacgattagcccgatcggagaagtgcgggatcctggcttcaaaggctga

SEQ ID NO: 3735 - RNA, 2985 nt, synthetic construct
  misc_feature 1..2985: note = Cas9 variant
  source 1..2985: mol_type = other RNA
atgaccctgggcctcgacctggggacaaacagcatcggatgggcccttattgatttcgacgataatcagcaacccagaaacctgatcgcttgcggctcccggatttttcaggaggccgtggaagcgaagacggggacccctaaaaatcacgctcgcagaacagcccgggccgctcgcaagctcgtcgccagacggaaacagcgcagaaccaagctgcttaacctgctcatccggcatggactgctgccgcaggacgttgctgagcgcaatgccctcctgcttgataaccaagcgaataacccctaccagctgagaaaacggggcctcgacgaaaagctggagcctttcgcctttgggcgcgctctttatcacctggcccatagacggggattccagtctaatcgcaaggctgccagcgatgaagacggcaaagtgaagacagcgatttccaccctcagagccgagatgcagggccggacactgggggcttttctggccgatcaacccacccagagacgccggtacacggacagagctatgtatgtggaggagttcgagcagctctggtctaaacaggccagctttacccaagaacagctgacacaggcccttaaggtcgctatccacaactccatcttctttcaacgccctctgaaatctcagaagcatctcgtgggaaagtgtaccttcgagcccacacggaaaagagcggccaaggctattctgcttacccagcgctttcggatcctgcaggatgttaatcacctcgccgtgaaaaaccctattacgagagagttccgcccgctgacacaagacgaacggaataagctggccgaggctctcgataaacaaaagagcatgacctggggcgccgtcagaaaagtgatcgggtggaacaagaaggactccctgcacgaaggagagacatttaatcttgaagagggcaaaaaggacaaactgattgggaaccgcaccgcgtgcgatctccggggagctctgggcgacagatgggatgcccttaccgcccagcagcaagacgatctggttacagacctcctgacgatcgataacaccgacggcttcctgaagcggatgaaaacacattgggagttcgatgacgctaccgccgaagtgattgctaagatcgagctcgaacccgggtacgcccgcctgagcgcgaaggccatgagagctatccttccttatctggagcagggaatgatttactctgatgcctgtaaagctgccggctatgaccactccaatcccaaccagcggacaatcaccgacaagctcgggctgcctagcaatgtcagaaaccccgtggtgcagaaagcgctgtttgaaacgcgcaaggtcgttaatgccattgtgcggaaatacggaaagccggctgtgatcagagtcgagatggcccgcgatatgaagctctctaaaagacaaaaggaggaactccagaaagagcagaacaagcagaaaaaggctaatgaactggccgagggcattctgcggaaggagttcgggatccaacagcctgcccgcgctgacatccagaaatacaacctctggctggaatgcaaggaggtgtgtccctatacaggaaccaccatttccagagaaatgctttttagccctgaggttgatgtggaacatatcctgccctactctcggtccctcgacgatagctatatgaataaaacactgtgcatggcgaccttcaaccgccaagtcaagctgaataacacaccctacgagattggccagggcgaccctcttgcctatgctgagatctttcagagaattaaaacgctcccgttccccaagcggcgcagatttgaacagaaagagatcgaaaccgataagttcatcgagcggcaactgaatgacacacgctacatttgtgtggaagttagagattttctgcagcagctcggggcccctgtggaggtctccaagggagaggccaccgctaaactgcggggcagatggaaacttaacacactgctctctcccgacgggagcaatgaaaagtatcgcggagatcaccggcaccatgccatcgacgcggtggtcattgctctgaccaacagatccctgttccacaaacttagccgcctctctgcccagtccatcagcctggataagtctcggtttgacgtgcctcccccgtgggacggcttctacgatgacgtttacgagaagattgataaggtgatcgtcagccatgcccctgctagaaaaattgggggcgccctgcacgaagacacggcgtatggacattttaaggaggaagtggctgatcccaaaaccggcaaggtttccatcgaggaccgcttcgtgtaccggaaacctctcgccacactgaccgccaacgaggtcgggaagatcagagatgctaaggtgcgcgagttcgtggaagcccggcttgctcaatttggaaataactctaaaacagccttcggcgaccccaataaccctctgctccacgcggatgggaagacccccattagaacggttcggctggtcacaaattttaacaaagccaccacacacgctatccagaagggacagggccgcgactataaattctttaagtacgggaataaccatcacgtggaaattatcgagcatgtggaaaccggcaagagaaaaggaattttcgtcaccgccatggaggctgcccggcgcgtgagaggcgttgccaatacagaaaagagcgatatcgtgcagcggaaccacggggaagagtggagatttgtcatgtccctgagcatcaatgaccttgtgtctattcaagaagctgatcaggttcgcatcatgcgggtgcagcttttcgacgcgtccaacggaaatattatctttagagaccagaaaagcgccatgctggatgacaagctgtctcgctatcagacgaaagctcacctcctggtctgccagaagattaccacagatccgcttggcaacctggccccttgtaatgactga

SEQ ID NO: 3736 - RNA, 2988 nt, synthetic construct
  misc_feature 1..2988: note = Cas9 variant
  source 1..2988: mol_type = other RNA
atgagcaaggtgctgggcctcgacatcggggccaactccattggatgggctctgatcgatgacgaggaaaatgatattatcggcgccggggtcagagttttcaaagagggagtgaaccttaagggcgtgaaagaagagtctaagaatgtcgaacggcgcgcggctagactggcccggcgccagcacaaaagacggagccaacgcagaaaccggctcgtggccctgcttaagaccctggagatgtttcccgagaataacgaagacatttccgattactatgctcaggacccttacgagctccgcaagaaagggctgtatgaaaagctgacaatgtacgagttcggaagagttctcctgcatatctgccggcgcagaggctttaaatctagccggaagacggatatctccgaggaaggcaaaattttcgaggggaaggacggaatcgtgggcattaatcagacccgcgattctatcagagaagggggatttaagacaattggcgagtatcttgccagcctggacccgcacgtcatccggagacgcaaccggttcaccctcagagatatgtacgaagaggagtttaatctgatgtgggaaaaacagcaatccttctatccccttcagctgagcaacgagtttaaggaagctattgccgaggtgatcctctctcagcgcaaactgaagtcccagaaagcgctggttgggaattgtggactcgaacctaacaagaaaacagcccccaagagctctcctgctttccaatactttcggatcctggagcagctttcccgcattctgatcagcattccccataccggcagatacaatgaccctctcaacgaggaggagcggagaatgctgatcgataaactttctgtgacagaaaagctgaagttctccgacatgcgcaaaatgctcaatctgccgggcgagagcgacattaacatcgaagaggaagggggacggctgctcggcaacaccacgtatgccagactgatcaaggtctttgggaaaaagcgctgggctggattctccgaagaggaaaaggagcagatttggcacaccttccattttgccgataatcacgagtggcttaaagaatacgcgctgaagaaatggtctatcacacccgacgagattaaggaactcggcaaagtggccctggagaaggaatatgctcggttcagcaagaaatcccttaagaaaatcattcctcagctggaggaggggctcaccctggataaggccaaaatcgaagctggatacacacccgagtatgaaatcgaaaagagcctgtctgcctacctccctctgcccgagaacattagaaatccgatcgtgcaacaggccctttatgagctgcggcacgtcgttaacgctgtgattcgcacctacggcaagcctgacatcgcgagagtggagctcgcccgggaaatgaaaaagcccaaacagaagagagagaaaatgcgctccgaactgcggaagagacaaatgaaatttgaggaaattaagagcatcctgaaggagcgccttggcttcattgatcctaaaagagacgagatccataagtacatgctctgggaagagtgccgggaaacgtgtccctatacagggcgcaaaatctctctgagcgctctgtacggaggcgattttgaggtcgagcacattatcccctataagagatccctcgacgattctctgttcaataaaaccgtgtgccttcgggaagagaaccagattaagggggaccgcacaccttacgaagcctatagcggagatagacagaagtacgaggaaatcattctgcgggttcagaaaacctccatgccgcgcggcaagaaaaatctctttgccatcaaggagctgaaagacgacttcgctcatagacaactgagcgataccgcctatatctctcgggagacacgcaagtaccttgggtccacgattaagaaagtgcaggcggtcaagggcggaagcaccgctaaactcagatactattggggcctgaactctatcctgggggtgcgggacattaagatgagagatgaccaccgccaccatgccgttgatgccctcgtgatcgctaatacaacctacgcctttgtcaacacactgtcccggtatcacagcatggacgtggaaccccatgagtccagattccctcttccctgggaacagtttcgcaatgatgctgagtctgtcgtgcggaacattttcgttagccacagactggggaaaaaggccaccggccagctccatgaagagacgtactatgggaagatccgcaatacagacggagagccttactttgtggtccggaaaaagctgggcaccctgaccgcgaaacaaatcgccaacattgtggatcccgttgtgaagacacaggtcttcgaaagacttgaggaaaaagggatcgacattgagtcctctaataagatcccggctgatgccttcgtggaaaccctctatatgcctgaccgcaaaacacccattaagagcgtgcgggttaaggtcccttccacgaccatgatccagctgtacaaagataaggagctgtacgtggaccccggcagcaaccaccacatcgtgatttttgagaacgaagagggaaaaagagacggcatcgtcgtgtctctcttcgaagctgcccagcggctgcgcagaaatgagcctgttattcaaaagacatggaaacccgagtggcattttgtgatgtcccttagcatcgatgaactgattctcctggacgtcgatgagaagaacatcgactggggagataccggactggcgcttcggtattctaaggccctctaccgcgtgcagaaaatggacgttaataagattatcacactgagacaccatctggtggctcggctcaaagatgacgaaggcaaggagttcgggagagaacaccgcatcccgtccaccctgcggggacttaaagtcaagattgatcacatcggcagactgcgccgggcctatgactga

SEQ ID NO: 3737 - RNA, 2988 nt, synthetic construct
  misc_feature 1..2988: note = Cas9 variant
  source 1..2988: mol_type = other RNA
atgaaggtgatcggcttcgacattgggatcaacagcattggatgggcctttgtcgagaatgatgaactgaaagactgcggcgttagaatcttcaccaaggctgagaaccccaaaaataaggaatccctcgccctgcctcggcgcaacgcgagatctagccggaaacgccttaagagacggaagctgcgcctcattgctatgaaacacatcctggccaaggagcttaatctgaactacaaagattatatcgccaatgacggggaactcccgaaggcttacgagggaaaactgatttccccctatgagctgagatacaaggccctcaaccagaagctggaagctaaagatcttgtgcgggtgatcctgcatattgccaagcaccgcggctatatgaataaaaacgacaagaaatctaatgatgcggagaaggggaaaatcctcagcgccctgaagaacaatgctcttaagctggaaaaataccaatccgtcggagagtatttttacaaggagttctttcagaaatacaaggaaaacacaaaagacttcattaagatcagaaatattaaggataactataacaattgtgtgctcgcctctgacctggagaaagaactgaagctcatcctggagaaacagaaggaatttggctacagctattccaacgatttcatcgaggaggttattcaggtggcctttttccaacggcctcttaaagactttagccatctggtcggcacgtgcaccttctttgaagaggaaaagcgcgcttgtaaaaattcttactccgcgtgggagttcgtggccctcacaaaaatcgttaacgaacttaagagcctggagaaaatttctggggagctgatctccacccagacaattaatgaaatcctcaactatatcctggataagggaagcattacctacaaaaagttcagatcttatatcaatctgtacgagtccattaagtttaaaagcctcaagtacgacaaagacaacgctgaatccgccaagctgatcgatttccggaaacttgtggagtttaagaaagctctgggcgaacactatttcaatcgccaggagctcgaccagatttctacatacatcaccctgatcaaggataacgtcaaacttaaaacggccctggagaagtataatctcagcaacgaacaaattaataacctgctggagatcgaatttaatgaccatattaacctctccttcaaagccctgagcatgatccttcccctgatgaaggaggggaaaaagtacgatgaggcttgcgaaattgcgaacctcaagcctaaaaccacaaatcagaagcaggactttctgcccgccttctgtaactctatctttgtgcacgagctgtccaatcctattgtgaacagagctatcagcgaatatcggaaagtccttaatgccctcctgaagaaatacggaaaggttcacaagatccatctggagctcgccagagatattggcctgtctaaaaaggctcgcgaaaagatcgagaaggagcagaaagaaaaccaagccattaatacctgggcgcttaacgagtgcgaaaatatggggatcaaggctaacgccaagaatattctgaaactcaagctgtggaaagagcagaaggaaatctgtatctatagcggaaagaagatttccatcgagcacctgaaagacgagaaggcccttgaagtggatcatatttacccgtactctcggagcttcgacgattcctatatgaacaaggtgctcgtctttacaaaagagaatcaggaaaagctgaacaaaacccccttcgaggcttttggcaagaatatcgaaaaatggaacaagattcaaacgctggcccagatcctcccttacaagaaaaagaacaaaatcctggacgagaatttcaaggacaaccagcagcaagatttcattagcagaaatcttaacgacacacgctatatcgctaccctgattgccaaatacacaaaggagtatctcaattttctgcccctgaacgaaaatgagaacatcaatcttaagtctggcgaaaaagggtccaagattcacatccagaccgtgaacggaatgctcaccagcgttctgcggcacacatggggcttcgataaaaaggacagaaataaccatctgcaccatgcgctcgatgccatcattgtggcttactctaccaattccctgatcaaagcctttagcgacttcaagaagaaccaggagcttctgaaagctaagctctatgccaaagagctgaccaatgataactacattcaccaggcgaagtttttcgaaccttttgaggggttccgcgagaaaatcctgaacaagattgacgaaatctttgtctccaagcccccgcggaaaagagcccgcggagcccttcataaggaaacattctactctgagaaaaagatgattaaaaagtataatagcaaagagggcctcaacatcgctctggattgcgggaagatccggaagattggaaccaaatacgtggaaaatgacacaatggttagagtggatatctttaagaaacaaaacaagttctatgctattcctatctacaccatggactttgccctgggcattctccccaataaaatcgtcgtgatcggcaaggataagaacaataaccctaaacagtggcaggagattgacgaatcctatgagttctgtttctctctgtacaagaatgaccttatcctgctccagaaaaaggatatgcaagaagccgagtttgcttattacaacgggttcgacattgatagctcccgcatcaatattaaaaagcacgacaacaagtttgagaatctgacgagcaaccagaaactgcttttcacaaataaggagaaaaaccggaccggaatccagaatctgaagatctttgaaaaatacattgtcacgcccctcggcaacaagatcaaggcggatttccagcccagacaaaacatttctctgaaatccagcaagaaaaatgggctctga

SEQ ID NO: 3738 - RNA, 2988 nt, synthetic construct
  misc_feature 1..2988: note = Cas9 variant
  source 1..2988: mol_type = other RNA
atgaagatcctgggcttcgacattgggatcaacagcattggatgggcctttgtggagaatgatgaactcaaagactgcggcgtcagaatcttcaccaaggctgagaaccccaaaaataaggaatccctggcccttcctcggcgcaacgcgagatctaatcggcgcagactgaaacggcgcaagagcagactcattgctatcaagcacatcctggccaaagagcttaacctgaattacaaggattatattgccaacgacggggaactcccgaaggcttacgagggaaagctgacaaatgtttatgagctgcggtacaaagccctcaaccagaagctggaagctaaggatcttgcccgcgtgatcctgcatattgcgaaacacagaggctatatgaataagaacgagaaaaagtccaatgactctgaaaaagggaagatcctcagcgccctgaaaaacaatgctcttaagctggagaagtaccaatccgtgggagagtatttttacaaagagttctttcagaagtacaaagaaaacacgaagaacttcattaaaatccggaataccaaggataactataataactgtgtcctcgcctctgacctggaaaaggagctgaaactcattctggaaaagcagaaagagtttggctacagctataatgatgacttcatcaaggagatcattaacatcgctttcttccagcgcccccttaaagatttttcccatctggtgggcagctgcacattctttgaagaggaaaagagagcctgtaaaaattcttactccgcgtgggagttcgttgccctcagcaaaattatcaacgaactgaagcggcttgagaaaatttctggggagctgatctccgctcaaaccatcaatgaaattctcaaccacatcctggacaagggaaatattacatataaaaagttccgcagctgcatcaacctgcatgagtctattgaatttaagtccctcaattacgataaagacaacgccgagagcgctaagctggtggacttcaaaaagctgatcgaatttaaaaaggccctgggcgagcactccttcaatagacaggagctcgatgaaatcgccacccacattacactgatcaaagacaacgataaacttaagaccgctctggagaagtataacctcaataacgaacagattaatgcgctgctggagatcgagtttaacgaccatattaatctctctttcaaggccctgaaccttatcctgcctctcatgcgggaagggaaaagatacgatgaggcttgtgaaattgtcaatcttaagagcaaaacgtccaaccagaagcaagacctgcttcccgccttttgcgatagcatcttctctcaggagctctccaatcctgtggttaaccgcgccatcagcgaataccggaaggtgctgaatgctctgctcaaaaagtatggaaaagtccacaagattcatctggagcttgccagagacgtgggcctgtctaaaaaggcgcgcgagaagatcgaaaaagagcagaaggaaaacaaagagattaatgattgggctctcgacgaatgtgagaagtttgggctgaaagccaacaataagaacatcctgaaacttaagctctggaaggagcagaaagaaatttgcgcctacagcggaaagaaaatctccatcgagcacctgaaggatgaaaaagctctggaggtggaccacatttatccctactctcggagcttcgacgattcctatatgaacaaggtcctcgtttttaccaaggaaaatcaagagaaactgaacaagacacctttcgaggcctttggcaaaaatatcgaaagatggaacaagattcaggctcttgcccagaatctgccgtacaaaaagaagaacaaaatcctcgacgagaatttcaaggataaacaacagcaggacttcattagccgcaacctgaatgatacccggtatatcgcgacactgatcgccaagtacaccaaagaataccttaactttctccccctgaatgagaacgagaatacgaacctgaagtctggcgaaaaggggtccaaaattcatgtgcagacaatcaatggaatgctcaccagcgtgctgagacacacatggggcttcgacaagaaagatcgcaacaaccatcttcaccatgctctggacgccattatcgtcgcttattctaccaattccattatcaaggcctttagcgatttcaaaaagaaccaagagctcctgaaggcgaaactgtacgccaaggaacttacctccgacaattataaacaccaggctaagtttttcgagccttttgaagggttccgggagaaaatcctcaacaagattgatgagatctttgtgtctaagccccctagaaaacgcgcccggggaacactgcacaaggaaacgttctaccccgaggaaaccatgattaaaaagtataatagcaaagagggcctgaacatcgctctcaattgtgggaagattagaaaaatcggaacaaagtacgttgaaaacgacaccatggtgcggctggatatttttaagaaacagaataagttctatgccatcccgatctacacaatggactttgcccttggcattctgcctaacaaaatcgtcattgctggcaaggacaaaaataacaatcccaagcagtggcaagagatcgatgagtcctacgaattttgcttctctctctataagaacgacctgattctgcttcagaaaaaggatatgcaggaggcggaatttgcctactataatagcttcgacatcgattccagccgcatcaacattaaaaagcatgacaataaatttgagaacctgaccgataaccagaagctcctgttcacgaatcaagaaaagaacagaacagggatccagaatctcaaaatttttgagaagtacatcgtgacccctctgggagacaaaattaaggctgatttccagccccggcagaacatctctcttaaaacctccaagaagtatggcctgtga

SEQ ID NO: 3739 - RNA, 2991 nt, synthetic construct
  misc_feature 1..2991: note = Cas9 variant
  source 1..2991: mol_type = other RNA
atgatgggcaacttcaccctggggctcgacctgggaacaaatagcatcggctgggcccttattgattttgacgataaccagcaaccccagaatctgatcgcttgcgggtccagaattttccaggaggccgtggaagcgaagacgggaacccctaaaaaccacgctcggcgcgccgccagagctgcccggaagctcgtcgctcgcagaaaacagcggcgcacaaagctgcttaatctgctcgtttgtcatgacctgctgccgcaagatgaggccgaaagaaacgcgctcctgcttgacaatcaggccaacaatccctaccagctgcggaaacgcggcctcgatgagaagctggaaccttttgctttcgggagagccctttatcacctggctcatcggcgcggatttcagtctaacagaaaggccgcgagcgacgaggatggcaaagtgaagaccgccatctccgctctccgggccgagatgcaaggccacacactgggggctttcctggccgaccagcccacccagcgcagacggtacacagatagagccatgtatgctgaagagtttgaacagctctggtctaaacaaaccattttcgcgcctgagcagctgacgcaggcccttaaggtggagatcaaaaatagcatctttttccaacgccccctgaagtcccagaagcatctcgtcggaaaatgcacctttgaacctacacggaagagagctgccaaagccattctgcttgctcagcacttccgcatcctgcaggacgtgaaccacctcgccgttaagaatccgattacccgggagtttagacccctgacacaagatgaacgcaacaaactggcggaggctctcgacaagcagaaaggcatgaattggtctgccgtgcggaaggtcatcgggtggaacaagaaagacagcctgcatgaaggagagaccttcaaccttgaggaaggcaagaaagataagctgattgggaatagaacggcctgtgacctccgcggagctctgggcgatcggtgggacgccttcacagctcctcagcaggatgaccttgtgaccgatctgctcacaatcgacaaccccgatggctttctgaaaagaatgaagacccactgggggttcgacgatgccaccgcggaggccctggctacaacggaactcgagcctggatacgcccgcctgtccagcaaggctatgcgggccattcttccccatctggaacaaggcatgatctattctgacgcgtgcaaagccgctgggtacgaccactccaatccgaaccagagaaccatcacagataagctcggactgcctagcaatgttcggaaccccgtggtccagaaagccctgtttgagacccgcaaggtggtgaatgctattgtcagaaaatatggcaagcctgccgttatccgggtggagatggccagagacatgaaactttctaagcgccagaaggaggagctccaaaaagaacagaacaagcagaaaaaggctaatgagctggcggaagggattctgcggaaggagttcggaatccagcaacccgccagaacagatattcagaaatacaacctctggctggagtgtaaggaagtgtgcccctacaccggcacggtcatctcccgcgagatgctttatagccctgaagtggacgttgagcacatcctgccgtactctagatccctcgatgacagctatatgaataaaacactgtgtatggctacctacaaccggcagaccaagctgaataacacaccctatgagattggccaaggggatcctgtggcctacgccgaaatctttcagcgcattaaaacccttcccttccctaagagacggcgctttgagcagaaagaaatcgagacagacaagttcattgaaagacagctcaatgatacgcggtatatctgcgtcgaggtgcgcgactttctgcaacagctgggagctcccgttgaggtgtccaagggcgaagccaccgcgaaactcagagggcggtggaagctgaacacacttctgtctccgggaggcgggaacgagaaaaatcgcgctgatcatagacaccatgccatcgacgccgtcgtgattgctctcaccaaccggagcctgttccacaagctgtccagacttagcgcccagtctatctcctttgataaaagccgcttcgacgtccctcccccttgggacgatttttacgacgatgtgtacgaaaagattgacaaggttatcgtgtctcatgcgcccacacggaaaattagcggcgctctccacgaggccaccgcctatggacacttcaaggaagagatcgctgatcctaaaacgggcaagttctccattgaggacagatttgtctaccgcaaacccctgaccacactgaccgccaatgaagtggggaagatccgggatgctaaggttagagagctcgtggaagcccgcctggcgcagttcggaaacaattctaaagccgcttttggcgacccgaacgagcctcttctgcatgccgatgggaagacacccatccggaccattagactcacgacaaatttcaacaaaaccacaacccacgctatccaaaagggacaggaccgcgattataaatttttcaagtacggcaataaccatcacgtcgaaattatcgagcacgtggagaccgggaagcggaaaggcatttttgtgacagccatggaagccgctagacgggcgcgcggagttgccaatacggaaaagagcaacatcgtccagagaaatcatggcgacgggtggaaattcgtgatgtccctggctgtgaacgatatggtccggaccgaagacacacaggccatctatcgcgtgcaaaagctggacggaagcaataacagatttacccttcggtctcacaacgccgctacactcgatgacaaacagaccggcgttgataagacgcccaatctgttcaaagggacaaagattatcgtggaccctctgggaaacctcacccagtgtaatgattga

SEQ ID NO: 3740 - RNA, 2994 nt, synthetic construct
  misc_feature 1..2994: note = Cas9 variant
  source 1..2994: mol_type = other RNA
atgaaggtgctggtcgacgccggcctcatgcccagcgatcctgctgccgcgaaagctctggagacccttgacccgtacgaactgagagccacaggcctcgatgttatgctgccccttacgcacctgggacgggccgtgttccatctcaaccagcgcagaggctttaagtccaatcggaaaaccgaccgcggggataacgagtctggaaagatcaaagacgctacaaagagactgacctgggccatgcaagaagctggcgcccggacatatggggagttcctgcacatgcgcagagcgcgggccagcgatcctcgccaggtgccctccgtcagaacccggctctctgtggctagccgcggaggccctgactccaaggaagaggccggctacgatttttatcccgagagagctcatctggaagacgagttccacgccctttggtctgcgcaggccgcttttcatcctgatctgacatgcgaactccgggacgttgtgttcgagaaaatcttttaccagcgcccgctgaaggagcccaaagtcgggctttgtctgttcaccgccgaagagagactccctaaggctcaccccctgacgggacggagagtgctgtatgaaaccgttaatcaactccgcgtgacagccgatggccggaccacaagacctctgacccttgaggaacgcgacatgattgtctacgccctggacaacaaaaagcccgtcaagagcctctccagcatgcacctgaaacttgtggctctggggaagctcgtgaaactgaaggatggagagcggtttacgctggagtctggcgttagagacgcgattgcctgcgatccgatccgcgctacaatggggcatcctgacggattcggccccgcctggtcccggctcgattggcaggcccagtgggctctgattgaaaaacttagacaggtgcaaagcgacgatgactttgcctctctggtggcgtggctcggcgctacccacaatctgtccgaggatcatgccaagcgcgtcgccaaccttcatctgcctgaagggtatggacggctcggcctgacagctaccgaggccatcctgtgtaatctcaaagctgaagtgtgcacctacagccaggccgttgagagatgggggaagcaccactctaaccagcgcacaggagagtgtctggaagcgcttccctactatggcgaggtgctggaccggcacgtcatccccgggacgtacaatgaagatgacgacgatgtgaccagatatggacggattacaaaccctaccgttcatatcggcctcaatcagctgcgcagactggtgaaccggattatcgccacatacggcaagccggaccaaattgtcgtggagcttgctagagaactcaaacagtccgaggcccaaaagagcgaggctctgaaaaagatccgcgataccacggccgacgcgattcggagagggcgccagctggaagagatcggacagaaaaatacaggcgccaacagactcctgcttcggctgtgggaagatctcgggcccgctgtcggacctcgctgctgtccctataccggcaagcctatctccgtgaccatgctgttcgacggggcctgcgatgttgaccacattctgccctactctagaacacttgatgacagctttgctaatcggaccatctgtctccgcgaggccaacagacagaagggcgatcggacaccgtgggaggcctggggaggctccgaccagtgggatgctattgaagcgaacctgaaagacctgcctgagaataagcgcaaaagattcgcccccgacgctatggaacggttcgagggggaacgcgattttctcgacagagccctggtggatacgcaatatcttgcccggatcagcagagcttacctggacaccctcttcacagagggaggccatgtctgggtggttcctgggcgcatgaccgagatgctgcggagacactggggactgaacgcccttctctctgataaggaccgcggcgcggggaaagtgaagaatcggacagatcacagacatcacgctattgacgccgccgtcatcgctgccaccgatcattccctggtgaaccgcatcagcaaggcggctggccagggagaatctgccggccagagcgccgagctgattgctcgggacacgcccgaaccttgggaggggtttagaaatgatatctccgcccagattgctcgcatcgtggtttctcaccgggccgaccacggaagaattgatgtcgaaggccggaaacatgggaaggacagcaccgcgggacgcctccacaacgacacagcctacggcatcgtggatgaccataccgtggtctccagaacacccctgcttagcctgaaaccgggggatatcgaggtgaccacgaagggcaaaaatattcgggacacacaactccagaaggctctgtctgttgccaccacaggaaaggatggcaaagggttcgaggaagctctgcgcaactttgccgagaaggaaggaccttatcagggcatcagacgggtgagacttattgagaccctccagtccagcgcccgcgtcgaagtggggtctgacgaggatggacaacccctgaaggcttacaagggcgactccaatcactgctatgatctgtggaaactccccgacgggaaggttgtgcctcatgtcgtgagcacctacgaggcgcacgccggcacagataaacggccgcaccccgctgccaagagaatcctgcgcgttttcaagaaagacatggtggccattgaacaggacgatcagacggctatcttttatgtccagaaacttgaccgggccaacggactgttcctcgcgcctcatctggaggctaatgccgatgccagacaccgcaaccccaatgacgcttttaaattcctgcaaatgggcgccgggtccgtggtgcggaacaaacttagacgcgtctacgttgatgaaattggaagaatcaaggaccctgggccccctaagcattga

SEQ ID NO: 3741 - RNA, 2994 nt, synthetic construct
  misc_feature 1..2994: note = Cas9 variant
  source 1..2994: mol_type = other RNA
atgaagatcctgggcttcgacattgggatcaacagcattggatgggcctttgtggagaatgatgaactcaaagactgcggcgtcagaatcttcaccgaggctgaaaacccctccaataaggagtctctggcccttcctcggcgcaacgcgagaagctcccggcgcagactgaaacggcgcaaggctagactcgttgccattaaacggatcctggccaaggaacttaagctgaattttaaagattacgtggctgccgacggggagctcccgaaggcttatgagggaaaactgacatctatctacgaactgcgctataaggccctcattcagcaactggagacgaaagatcttgcgagagtgatcctgcacattgccaagcatcggggctacatgaacaagaatgagaaaaagagcaacgacaccaaaaaggggaaaatcctctccgctctgaagaataacgcccttaaactggaaaattatcagtctgtcggagagtacttctataaggaatttttccagaagtacaaagagaacacaaagaattttattaaaatccgcaacaccaaggataattacaacaactgtgtgctcagctccgacctggaaaaagagctgaagctcattctggaaaagcagaaagagttcggctataattacagcgaggattttatcaacgaaatccttaaggttgctttctttcaaagacccctgaaagacttctctcacctcgtgggcgcctgcacatttttcgaggaagagaagcgggcgtgtaaaaattcctatagcgcctgggagttcgtcgctctgaccaagattatcaacgaaattaagtctcttgagaaaatctccggggaaattgtgcctacacagaccatcaatgagatcctgaacctcattctggataagggaagcatcacgtacaaaaagtttcgctcttgcattaatctgcatgaatccatcagcttcaaatccctcaagtatgacaaggagaacgccgaaaatgctaaactgattgattttagaaaacttgttgagttcaaaaaggccctgggcgtgcactctctcagccggcaggagctggaccagatctccacccatatcacacttattaaagacaacgtcaagctgaaaaccgtgctcgaaaagtacaatctgagcaacgagcaaatcaataacctgctcgaaattgagtttaatgattatatcaacctgtctttcaaggcccttgggatgattctgcccctcatgagagagggaaaacgctactacgaggcttgtgaaatcacaaacctgaagcctaaaaccgtggacgaaaaggaggattttctgcccgcgttctgcgactccatttttgcccacgaacttagcaatcctgtcgttaaccgggctatctctgagtatagaaaagtgctcaatgccctgctgaagaagtacggcaaagtgcacaagatccatctcgagctggcccgcgatgtcgggcttagcaaaaaggctcgggagaaaattgaagaccagcagaagaacaataaggccatcaacgattgggcgctgaaagaatgtgagaatattggaatcaaggcttccgccaaaaacattctcaagctgaaactgtggaaggaacagaaggagatctgcatctattctggcaataaaattagcatcgagcaccttaaggacgaaaaagccctcgaggtggatcatatttacccgtattcccgcagcttcgacgattcttttatcaacaaggttctggtgttcacgaaagaaaatcaagagaagctgaacaaaacaccctttgaggctttcggcaagaatattgaaaagtggtccaaaatccagaccctcgcccagaacctgccttacaagaaaaagaataaaatccttgacgagaacttcaaggacaagcaacagcaggattttattagcagaaacctgaatgacacacggtatatcaccaccctcattgctaaatacacaaaggaatacctgaacttcctgcccctttctgagaatgaaaacacgaatctcaaatccggggagaagggaagcaaaatccacattcagaccatctccggcatgctgacatctgtcctgagacacacctgggggtttgataagaaggaccgcaacaatcatctccaccatgccctggatgcgatcattgtggcctatagcacatcctctatcattaaggctttcagcgactttaagaaaaaccaagagcttctgaaggcccggttctacgctaaagaactcacctccgataattataagcaccaggttaagtttttcgagccttttaaaggattcagagaaaagatcctgagcaaaattgacgagatctttgtgtctacgcccccgcgcaagcgggccagaggcgcgctgcatgaagagacattctactccgaggataaaatgattaagaagtataacagcaaagaagggcttcagatcgccctctcttgtggacgggtccgcaagatcggcaccaaatacgtggagaatgacaccatggtcagagtggatatttttaagaaacagaacaagttctatgctatccctatttacgttatggacttcgccctgggcatcctgcccaataaaattgtgatcacagggaaggataagaacaataaccctaaacaatggcagaccatcgacgaatcctacgagttttgcttcagcctctataagaacgacctgattcttctgcagaaaaagaatatgcaggaacccgagtttgcttactataactctttcgatatcgaccggagcagaattaaaatcaagaagcacgataataaatttgagaacctcacatccaatcaaaagctgctgttcacgaacaaagacaagggaaagaatcgcaccggcattcagaaccttaaaatctttgaaaagtacatcgtcacacccctgggggataaaattaaggccgacttccagcctcgggagaatatcagcctcaaaacctctaagaaacacggactgtga

SEQ ID NO: 3742 - RNA, 2994 nt, synthetic construct
  misc_feature 1..2994: note = Cas9 variant
  source 1..2994: mol_type = other RNA
atgggcaactacaccctggggctcgacatcggaagcaattccattggctgggccctggtggaggatgctgtcgaagcccccagaatcgttgacatgggggtgcgggtgttccctgagggagtcgatcgcgacacaaagggccttgaaaaatctaagaacgcgacgagacgggaggctcgcggggccagacggacccaccagcgcagacggcaacgcaaacagagactggtgcgggccctccgccaggttggactgcttccgtgcgataaggctgaagtgagaagcctgtttcagacagacccctatgagattcggaaacgcggcctcgatcatagactggagctgtacgaaatcggccgggccttctatcacctctcccaaagacgcgggtttaagtctaatagaaagagcggagctctgaaagaggacggcaccgtcaagaaagaagccggggagcttcagcggaagattgatgaggcgggatgtcgcacaatcggcgaatacttcgccgggctggaccctgagcagcagcggatcagaggacgctatacctttcggtccatgtaccaaaaagagttcgatctcctgtgggctaaacaggtggagttttatcccaaggttcttacagaagacctgagatctaaggtgcgcgatgagattatcttctttcagcggcctctcaagagcgccaaagacctgattggcgactgcgagctggaacccaccgagaagagatgtcctcgcgctgattggtacgcccggagattccggctcctgcaggacatcaacaatcttattatccaaaacccggatggcacggaacagaaactgtcccccgaccagcgcgcggccctcctgggggagcttggacaaagagaaaagctgacctttgataatattcgggctaaactcggcctgctggagacacagaagttcaacgccgagtacagaatcgggcgcaaggggaaaaaggtcgaagctatcaaaggcgacgtgtttgtgtggaccatgcggggaaagagcgtcttcggacctaaagcctgggatgccatggctgacgagagaaaggtttctctcaatgaactgttcgtggagcttgaagatgacgatctggcgcgcaagctcgagacagagtatggcctgaccgacaaacaggtgcaggccgctatgaaggcctcccttccccaaggctacatgagcttttctagaaaagccgtcctgaagctcctgcctttcatggaagctggggccctgacgcatgaggcgattgaccaggctggatatcggaaagaagaacccacacagaccgatgccatcgcccgcgtgtcctttccgcctgacctcagaaaccccattgttcagaaggctctgttcgaggtgcggaaggtcgtgaatgcccttgttcgcgaatacggcaaacctacaagaatcaagattgagatggctcgggatgtgcaagggagcaaacgccagagagaggaactgcactggcggaacgaagacaatcgcaagaaaaacgaggaggtcagagatcggctcagaaccgacatccatatcgatgacccctctcgcgatgacgtgattaagtataagctgtggcaggaatccggaaaaatgtgcccctacaccggccggcagatctgtcaagaggccctgtttgggcctaatccggagttccaggtcgaacacattcttccctatgatagaagcctcgacgattcctacatgaacctgacactgtgcgaagtgcacgagaacatccatggcaagcgcaatcagacgccttttgaggcgtacggatctggcgccgaacggtatgagcagattaaacaaagaatcaaggttctcccctggcctaaacgccagaagttcctgcagcaagaaatcaaccttgacagccacatttcccgggagctgaatgacaccagatacatctgtcgcgaaacagtggcttatctcaaacagctgggggtccatgtgcggggaaccagaggcaagattacagccgagctgcggcaccagtgggggcttgatggaatctttagcgagctcggcgttcgcagagacgatgaccaccggcgccatgctgtggatgccctggtcgtggcggtgaccgacaacgaacacctgagacggctcgccgtttctaagtacgtcctggctgggcccagattcgagacgccgtggtccgcctttcgcgatgaagctcggggcaatgtgaaaagaatgaacgtgagccatcgcgtctgccggaaggtgtctggagcccttcacgaggagacaaattatggccctaccggggttagagaccaggccggacaagatatttacgcttatcgcaaaaagctggaagacctcaccacacccatggtggagaaaatcgtcgatcctgtggttcgggacattgtgagacagcgcctgctgatgaagggcatcgatcccgcggccgctgacagaaagatccctaaagacgtctggaaggaacccctttacatgcggcgcaccaaaagcgataagatgattcagatcagacgggtgcgcattcatgacgttaaaaactccatcattgtgctcacagatgagtctgggagaccgtaccgggccgtcgaacctggaggcaatcaccacgtggaggtgttcgagtatgtccatgggacgaagaccggcacaagagaagccgaggttgtgaccatgtttgaagctgtgcgccggagcagagcccgcgcgcccgtcgtgcggagagaccacggacccggcacacggttcgtttgttccctggctatcaacgatatggtgatgatgcctgacaagagcgggaaaatggatctgttccgcatccagaagatgtctgcctccaaacaagtctactttagacatcacaccgccgctcggattgacagcgagcgcacgctcatcagaaagcaggcccacctgttcaatggatataaagtgtctgttgatccgaccggcgcgatttgccgggctaacgactga

SEQ ID NO: 3743 - RNA, 3000 nt, synthetic construct
  misc_feature 1..3000: note = Cas9 variant
  source 1..3000: mol_type = other RNA
atgaagatcctgggcttcgacattgggatcaacagcattggatgggcctttgtggaggataatcagctccaagactgcggcgtcagactgttcaccaaagctgaagatcccaagacaaaagagtcccttgccctgcctcggcgcaacgcgagatctaatcggcgcagactcgggcggcgcagaagccggctgatcgctcttaagcacattatctccaaaggactgaagctcaactaccaggactatatcgccaatgatggcgaactgccgaaggcctacgaggggcgcctgatttctccctatgaactcagatacaaagctctgaacgagaagatcgagcctaaagaccttgcccgggttattctgcatatcgctaagcaccgcggatatatgaataaaaacgaaaagaaaagctccgataatgagaaaggcaagattctctctgccctgaaaacgaacgcgcttaagctggaaaaataccagagcgtgggcgagtatttttacaaggagttctttcagaaatacagagaaaataccaaggacttcatcaacattcggaataaggaggggtcctatgaaaactgtgtgctcgccagcgatctggagaaagaactgaagctcatcctggagaaacaaaaggagtggggatactcttataatgacaactttatcaaagaaattcttaaggtcgctttctttcagcgccccctgaaggatttctcctacctcgtgggcgcctgcacatttttcgaggacgaaaagagagcttgtaagaacagctattctgcctgggagtttgttgcgctgaccaaaatcattaatgaacttaagtccctggagaaagagagcggggaactcgtgtcttcccagatcattaacgagatcctgaatcatatcctggataagggaagcattacatacaagaaattccgggaatatatcaagctccacgagtccatgaaattcaagtctctgaaatacgacaaggacaacgtcgaaagcaccaagctgattgagtttagaaaactggtggagttcaagaaagccctcggcgaacattccctgagccgcgaggaacttgatcagatcgctacatacattaccctgatcaaggacaatgagaaactcaagatcacgctggagaaatattctctgaacaatgaacaaattaagaacctcctggagatcgattttaatgaccacattaacctttccttcaaggccctgaatctcatcctgcctctgatgaaagaagggaagcggtacgatgaggcttgcaaacttctcaacctgaagaccaaaagcaataaccagaagtttgacttcctgcccgccttttgtgattctattttcgcccaggaactcacaaatcctatcgttaacagagctattagcgagtatcgcaaggtgctgaacgcgcttctgaaaaagtacggaaaaatgcacaagatccatatcgagctcgcccgggacattggcctgtccaaaaagctgagagctaagatcgaaaaagagcagaaggaaaattatgagaacaatatttgggcccttaacgaatgcgagaaatttggcctcaaggccaatgctaaaaacatcctgaagctgaagctctggaaagagcaaaaggagttctgtatttactctgggaaaaagatcagcatcgaacaccttcgcgatgaaaaagcccttgaggtcgaccatatttatccgtactcccggagctttgatgactctttcctgaataaggtgctcgtgtttaccaaagaaaaccaggagaagctgaataagacacccttcgaggcgttcggagctaacgaagagagatggtccaaaatccaggccctggcccaaaatcttccttacaagaaaaagaacaaaattctcgacgaggcttttaagggcaagcagcagcaggatttcatcagccgcaatctgaacgacacccggtatatttctacgctgatcgtcaaatacacaaaggaatatctcgattttctgccccttgacgagaaagaagatgttaatctgaagtccggggagaaaggaagcaagatccacgtgcaaaccattaacggcatgctcacatccgtgctgagacacacctgggggttcgcccagaaggaccgcaacaatcatctgcaccatgctcttgatgccaccatcgtcgcgtactctacaaacgccattatcaaggcttttagcgacttcaagaaagaacaggagctcctgaaggccaaactgtatgctaaggaactcacgtccgattcttacaagcaccaggccaaatttttcgagccttttgagggattccgggaacaaattctgaatcagatcaacaaactttttgtgagcaaacccccgagaaagcgggcgcgcggcgccctgcataaagagaccttctattccaaggacgaaatgatcaagaaatacaatagccaggagggcgttgaaattgctctcaactgcgggaagatcagaaaaattggaacaaagtacgtggagaatgataccatggtccggatcgacatttttaaaaagcagaacaaattctatgccatccctatttacacaatggatttcgctctgggcgtgctgcccaataagatcgttatcattgggaaggacaaaaagggaaaccctaaacaatggcaggagatcgacgaatcttatgagttttgtttctcccttcacaaggatgacctggtgctcattcagaaaaaggatatgcaggaacccgagtttgcctactataatggcttcgacatcagcaactcttccatttgcgtcgaaaagcacgataataaatttgagaacctgaccgacaatcaaagactcctgttcacgaacgccgaggggaacgtgaaggctaaaaagatcggcatccagggacttcgcatttttgaaaaatacatcattacacccctgggcgagaagatcaaggcggatttcaaacctcgggaagacattgccctcaagaccagcaaaaagcatgggctgtga

SEQ ID NO: 3744 - RNA, 3003 nt, synthetic construct
  misc_feature 1..3003: note = Cas9 variant
  source 1..3003: mol_type = other RNA
atgaagatcctgggcttcgacattgggatcaacagcattggatgggcctttgtggagaatgatgaactcaaagactgcggcgtcagaatcttcaccaaggctgagaaccccaaaaataaggaatccctggcccttcctcggcgcaacgcgagatctagccggcgcagactgaaacggcgcaaggctagactcattgccatcaagcggatcctggccaaagagcttaagctgaattttaaagattacgttgctgccgacggggaactcccgaaggcttatgagggatccctggcctctgtgtacgagctgcgctataaagcgctcacacagaagctggaaacgaaggatcttgccagagtgattctgcacatcgctaaacatcggggctacatgaacaagaatgagaaaaagagcaacgacgccaaaaaggggaaaattctctccgctctgaagaataacgcccttaagctggaaaattatcaatctgtcggagagtacttctataaagagtttttccagaagtacaaagaaaacaccaagaattttatcaaaattcgcaacacaaaggataattacaacaactgtgtgctcagctccgacctggagaaggaactgaaattcatcctcgagaagcagaaagaatttggctataagtacagcgagggcttcattaatgagatcctgaaagttgcgtttttccagagaccccttaaggatttttctcacctggtgggggcctgcaccttcttcgaagaggaaaaccgggcttgtaaaaattcctatagcgcctgggagtttgtcgctctcacaaaaatcattaacgaaatcaagtctctggagaaaatttccggagagatcgtgagcacccaaacaattaatgaagttcttaacctgatcctcgacaagggctctatcacctacaaaaagttccgctcctgcattaatctgcatgagagcatctcctttaagtctctgaaatatgataaggaaaacgccgagaatgccaaactcattgacttcagaaagctggtggaatttaaaaaggctcttggggtccacagcctgtcccggcaggagctcgatcagatcagcacgcatgtgaccctgattaaagacaacgtgaaacttaagacagtcctggagaagtacaatctctctaacgaacagatcaataacctgctggagatcgagttcaatgactatattaacctctcctttaaggcgctgggaatgatccttcctctgatgagagaaggcaaacgctacgatgaggcctgtgaaattaccaacctcaagcccaaaacagttgacgagaagaaggatttcctgcctgctttttgcgacagcatcttcgcccacgaactgtctaatcccgtggtgaaccgggccattagcgagtacagaaaagtccttaatgctctcctgaagaaatatgataaggtgcacaaaatccatctggaactcgcccgcgacgttgggctgtccaagaaggcgcgggagaaaattgagaaggaacaaaaagagaaccaggctgtgaatgcctgggcccttaaggaatgtgagaacatcggactgaaggcttctgccaagaatatcctcaagctgaaactgtggaaggaacagaaagagatttgcatctacagcggcaacaagatttccatcgagcaccttaaagatgaaaaggctctcgaggtcgaccatatttatccttacagcagatcttttgatgactccttcatgaataaagtgctggtttttaccaaggaaaaccaggagaagctgaataaaacgccgttcgaagccttcggcaagaacatcgagaaatggagcaagatccaaacactcgcgcagaatctgccctataaaaagaagaacaaaattcttgatgagaattttaaggacaaacagcaagaagacttcatctctcgcaacctgaacgatacccggtacattgccacactcatcaccaagtataccaaagagtacctgaattttctgcctcttaacgaaaatgagaacacaaatctcaagtccggggagaagggaagcaaaattcacgtgcagacggtcaacggcatgctgacctccgtgctgagacacacatgggggttcgacaagaaagatcgcaataaccatctccaccatgctctggacgccatcatcgtcgcttactctaccaatagcattatcaaggccttttccgatttcaaaaagaaccaggaacttctgaaggcgcggttttatgccaaagagctcacatctgacaattacaagcaccaggtgaaattctttgaacccttcaagggatttagagagaaaattctgagcaagatcgatgaaattttcgtttccaagcctccccgcaaacgggctagaggcgccctgcataaggagaccttttatagcgaggacgaaatgatcaaaaagtacaactctaaagaggggcttcaaatcgctctctcctgtggacgggtgcgcaagattggcacgaaatatgtcgaaaatgatacaatggtgagagttgacatcttcaagaagcagaacaaattctacgccattccgatctatgccatggattttgctctgggcattctgcctaataagatcgtggtcgtggggaaagacaagaacaacaatcccaaacagtggcagaccattgatgagagctacgagttctgcttttctctctacaagaacgacctgatcatgcttcaaaagaaagacatgcaggaagcggagttcgcctattacaatggatttgatatctccaccagctctatttgtgtggaaaagcacgacagcaaattcgagaacctgacatccaatcagaagctcctgtttagcaacgctaaagaaggctctgttaaggtcgagaatctggggatccagaaccttaagattttcgaaaaatatatcattacccctctgggagataagatcaaagccgactttcaaccccgggagaatatctccctcaagacaagcaaaaagaacggcctgtga

SEQ ID NO: 3745 - RNA, 3003 nt, synthetic construct
  misc_feature 1..3003: note = Cas9 variant
  source 1..3003: mol_type = other RNA
atggccagagctcagcggcgcctgatcagcagacgggccaaccgcatgaataagctcagacggctgcttaaacaagagaacgtgctgcaggcgaatgactacgatgaaaagggcctcattatcgggctgcccaaccaggcttgggagcttcgcgcccagggactggacagaaaactcgaacctaaggagtgggccgctgtcctgattaatctggttaaacaccggggctatctctcccaacgcaagaacgaatctcagaccgccgataaggagctgggggctctgctgagcggaatgaatcataaccaccagctcctgcagtcccaatctaatcagtacagaacaccggccgagcttgcgatcaaacagttcgccacgcaggacggccatattcggaaccaacgcggggcttatacccacacatttaatagactggatctccagaacgaactgaatcagctgttcgacgcccaaacccggctcggaaacccccatgtgagcggctccctgaagacagctatcaatgatcttctgatgaaccagaaagccgcgctctctggcgacgccatcctggagatgcttgggcgctgcacctttgaacctagcgagtacaaggctgccaaaaacacatattccgctgagagattcgtgtggctgggaaagctcaccaatctgcggattcaggataacggcctggaaagcgccctctctagagagcagcgcgaactgcttctgaatgagccctacaacaagacgaaactcacctatcaacaggtccggaagctgcttagactgcctgaaacagcctttttcaaagggctccgctacggaaaggacaatgctgagtccgcgacctttatggagatgaaaagctaccacgccatccggaagtctctggaaaacaaatccctgaaaagcgagtgggaaaagctcaaaacacagcccaagctgcttgatctgattggcaccgctttctctatctataaaacggacgatgagattgccgggtgtctcaagaatcagctgcctgaaaacgtgatcattgccctgcaagagcagcttaatttttccaacttcatggagctcagcctgaaagctctggaaaagctcctgccgcttatggagcagggactgagatacgacgaagcctgcacacagatctatggcaatcgccacgagaagatcgcggacaaaaccgaaaagtttctccccaacattcctgctgataaactgcggaatcccgttgtgctgagaacacttacccaagcccgcaaggtcatcaacgccattatccggagatacggctcccctgctcgcgtgcatattgagaccgggcgggaggttggaaaatctttcagcgacagagataagctcaagaaacagcaggaagagaatcaggaacaacggcgcagagccatcgacgagtggaagcagtttttccccaacgctgcccacgagccgaaagcggtggatatcctgaagctgcggctctatcagctgcaacagggcaaatgtctttactccgggctgcctattgacgtcagacgcctccccgaaaagggatatgtggagatcgatcatgccctgcctttcagccggacatgggacgattcttttaacaataagattctggtgcttgcttccgaaaaccagaataaaggcaaccagacgccctacgagtacctcagaggggccgacaatagcgaatcttggcgcctgttcgtcgagaacgttcaaaattgccagtttagccccaacaagaaacagaagatcatggctaaacagctggatgagaagggattcctcgaaagaaatctgaacgacacccggtatgtgtcccgctttctttgtcaattcatttctgagcaccttcacctcacaggcaaaggcaagaagagagtgtttgccagcaatgggcagatcaccgcgctgctgcggggacgctggggcctttccaaaaacagagaagagaatgaccggcatcacgccgtcgatgctgtggttgtggcctgcagcacagtcgctatgcagcagaagatcacccaattcgtgcgctaccagaaagggaacgtttttacgggagaaagaattgacaaggagacaggcgaggtgatctctattcatttccctaccccgtgggaacactttcgggaggaagtcatgatccgcgtgttcgatgacaatcccctcagaaccctgcctgagaaactgcccaaccggcctgaagccctccatgagtatgtcatgcccctgtttgtgtccagaatgccgacacgcaagatgaccgggcagggccacaaggagacaattaaaagcgccaagcggcttgatgaaaagatctctgttctgagagtgcctctcacgcaactgaagctgaacgaccttgagaatatggtcaaccgcgaacgggagcccgctctgtacgaggcgctcaaagccagactggaacagttcaagaatgatcctgctaaggccttcgccgagccctttttcaaacagggaggccagcaagtgaaggctgttcgcgtggaaattgtccagaaatccgggatgctcctgcggaagatcaacggagtggccgacaatggcagcatggtgagagttgatgtctttgagaaatccgggaagttctatcttgtgcctatctacgcgtggcaagtggctgaaggcattctgcccaactatgccgtcgtggcccacaaggacgagtctgattggatcctcatggacgagagctaccattttaaattcgctctgtacaagaatgatctgcttgaagttcagaccaaaaagggagggattatgggctattttgcctccctggaccgcgcgacaggagctatcaccattcgggagcacgacagagataaaaagaaatgtaaggacggcgaacatcggtctatcggggtgaagatggccagctccttcaaaaagctccaggtcgatgagctgggcaaaaacatccacgaaacacgcagcagaaagcggccgaatattggatga

SEQ ID NO: 3746 - RNA, 3012 nt, synthetic construct
  misc_feature 1..3012: note = Cas9 variant
  source 1..3012: mol_type = other RNA
atgagaatcctgggcttcgacattgggatcaacagcattggatgggcctttgtggagaatgatgaactcaaggactgcggcgtccggatcttcaccaaagctgagaaccccaagaataaagaatccctggcccttcctcgcagaaacgcgcggtctagccgcagacggctgaagcgcagaaaagctcggctcattgccatcaagcgcatcctggccaaggagcttaaactgaattacaaggattatgttgctgccgacggggaactcccgaaggcttacgagggatccctggcctctgtgtatgagctgagatacaaggcgctcacacagaacctggaaacgaaagatcttgcccgggtgattctgcacatcgctaagcatcgcggctatatgaataagaacgagaaaaagagcaatgacgccaaaaaggggaaaattctctccgctctgaagaacaatgcccttaaactggaaaactaccaatctgtcggagagtatttttacaaggagttctttcagaagtacaaaaagaataccaaaaacttcatcaagattagaaatacaaaagataactataacaattgtgtgctcagctccgacctggaaaaggagctgaagctcatcctggaaaaacagaaggagtttggctacaactatagcgaagatttcattaatgagatccttaaagttgcgtttttccagcggcccctgaaggacttttctcacctcgtgggcgcctgcaccttctttgaggaagagaaacgcgcttgtaagaactcctacagcgcctgggagttcgtcgctctgacaaagatcattaatgaaatcaaatctcttgaaaagatttccggggagatcgtgcctacccaaacaattaacgaggttctgaatctcatcctggataaaggaagcatcacctataagaaattcagatcttgcattaacctgcatgaatccatcagctttaagtccctcaagtacgacaaagagaatgccgaaaacgccaagctgattgatttccggaaacttgtggagtttaagaaagctctgggcgtccactctctcagcagacaggaactggaccagatctccacgcatattacccttatcaaggacaatgtgaaactgaagacagtgctcgagaagtataacctgagcaatgagcagatcaacaatctgctcgaaattgagttcaacgattacatcaacctgtcttttaaagcgcttgggatgattctgcccctcatgcgcgaaggaaagcggtacgacgaggcctgtgagatcgctaatctgaaacctaagaccgtcgatgagaaaaaggacttcctgcccgccttttgcgattccattttcgcccacgaacttagcaaccctgttgtgaatagagctatctctgaatatcgcaaggtgctcaacgccctgctgaaaaagtacggcaaagtccacaagattcatctcgagctggcgcgggacgtggggcttagcaaaaaggctagagaaaagatcgagaaagagcaaaaggaaaatcaggccgttaacgcctgggctctgaaagagtgtgaaaatatcggactcaaggcctccgctaaaaacattctgaagctgaaactttggaaagagcagaaggaaatctgcatttattctggcaataaaatcagcattgagcacctcaaggatgagaaagccctggaagtggaccatatctacccgtattcccgcagctttgatgactctttcatcaacaaggtcctggtgtttacaaaagagaatcaggaaaagctcaacaagacccccttcgaggcgtttggcaaaaatattgaaaagtggtccaaaatccaaacgctggcccagaaccttccttacaagaaaaagaataagattctggatgagaacttcaaagacaagcagcaagaggacttcatcagccggaacctcaatgatacaagatatattgctaccctgatcgccaaatacacaaaggaatacctgaactttcttctcctgtctgagaatgaaaacgctaatctgaaatccggggagaagggaagcaagatccacgttcagaccatttccggcatgctcacctctgtgctgcgccacacatgggggttcgacaaaaaggatcggaacaatcatcttcaccatgccctggacgcgatcattgtcgcctatagcacgaactccatcattaaggctttttctgatttcagaaagaatcaggagctcctgaaagcccgcttttacgctaaggaactgaccagcgacaactataagcaccaggtgaaattctttgagcccttcaagtcctttcgggagaaaatccttagcaagatcgatgaaattttcgtctctaaacctcccagaaagcgggcccgcagagccctccataaggacacatttcactccgaaaataaaatcattgataagtgtagctacaactctaaagagggactgcaaatcgctctgtcctgcggccgggtgagaaagattgggaccaaatatgttgagaatgacacaatcgtgcgcgtcgatattttcaagaaacagaacaagttttacgcgatcccgatctatgccatggacttcgctctcggcattctgcctaataagatcgtgattaccggaaaagataagaacaacaatcccaaacagtggcagacgatcgacgaaagctacgagttctgtttttctctttacaagaacgacctgattctcctgcagaaaaagaatatgcaagaacctgagttcgcctattacaacgattttagcatctccacaagctctatctgcgttgaaaagcacgacaataaattcgagaacctgacctccaatcagaaacttctgtttagcaacgccaaagagggctccgtgaaggtcgaatctctcgggattcagaatctgaaagtgttcgagaagtatatcattacacccctcggagataagatcaaagctgactttcaaccccgggaaaacattagcctgaagacctccaaaaagtacggccttagatga

SEQ ID NO: 3747 - RNA, 3012 nt, synthetic construct
  misc_feature 1..3012: note = Cas9 variant
  source 1..3012: mol_type = other RNA
atgatcgacgagagcctgaccttcggcattgatctcgggatcggatcctgcggctgggccgtgctgagacggccctctgcttttgggcgcaagggagtcattgaaggcatggggagctggtgtttcgacgttcctgagacatccaaagaaagaacgccgaccaaccagatccggcgctctaatagacttctgcggcgcgtgattagacggcgcagaaaccggatggccgcgatccgcagactcctgcacgctgccggacttctgcccagcacagattccgacgccctcaagcggcctggccatgatccctgggagctgcgcgctagaggcctggacaaacctctcaagcccgtggaatttgccgtcgtgctggggcacatcgctaaacggagaggattcaagtctgccgcgaagcgcaaagccaccaatattagctccgatgacaagaaaatgcttacagctctggaggccacccgggagagactcggccgctaccggacagttggggaaatgtttgctagagatcctgacttcgccagccgccggagaaaccgcgagggaaagtatgatcggaccacggcgagagacgatctggaacatgaggtgcacgccctttttgctgcccaacgccggctgggccaggggttcgcttctccggagctcgaagaggcctttaccgcctccgctttccatcagagacccatgcaggacagcgaacggctggtcggattttgccctttcgagcgcacagagaaaagagcggccaagctgaccccctcttttgaacggttcagactcctggctcgccttctgaatctccggatcacaacccctgacggcgagagacccctgacggtggatgaaattgcccttgttacacgcgacctgggcaagaccgccaaactctccatcaagagagtgcggacactgattgggctggaggataaccaacgcttcaccaccatcagaccggaagacgaggatcgggacattgtcgctcgcacaggaggcgccatgacggggaccgcgacactcagaaaagctctgggagaagccctttggaccgatatgcaggagcggcctgagcagctggacgccatcgtccaggtgctcagctttttcgaagctaatgagacaatcaccgaaaagctgcgcgagattggccttacgctggccgtgctcgatgttctgctgacagctctcgacgccggggtgtttgcgaaattcaagggagccgctcacatctctaccaaagccgctagaaacctgcttccccacctggaacaaggccggcgctacgatgaggcctgtaccatggcgggctatgaccatgccgcttccagactcagccaccatgggcagattgtggccaagacacagtttaatgctctggtcaccgagatcggagaatccattgccaaccctatcgcccggaaggctctgatcgagggccttaaacagatttgggcgatgagaaatcactgggggctccccggatctatccacgtggaactggcccgcgacgttggcaacagcattgagaagcggagagagatcgaaaaacatattgagaagaatacagctctgcgcgcccgggaaagacgcgaggtgcacgatctcctggaccttgaagatgtcaacggggacacgctgctccggtacagactgtggaaagagcaaggcggaaagtgcctgtataccggcaaggccatccatatccgccagattgctgccacagataattccgtgcaggttgaccacatccttccctggagccggttcggggatgactcttttaacaacaaaaccctctgtctggcgtccgctaatcaacagaagaaaagaagcacaccttacgagtggctgtctggacagaccggcgatgcctggaacgccttcgtgcagcggattgaaacgaataaggagctccgcgggtttaaaaagagaaactatctgcttaagaatgctaaagaagccgaggaaaagttccggagccgcaacctgaatgacaccagatacgcggctcggctctttgccgaggccgtcaaactgctgtacgctttcggagagagacaagaaaagggcgggaaccgccgggtgtttacaagaccgggcgcccttaccgctgccctccgccaggcgtggggagtcgagtccctgaaaaagcaggatggcaagcggatcaatgacgatagacatcacgccctggacgctctcacagtggccgctgttgacgaagccgagattcagcgcctgaccaaatctttccacgaatgggagcaacaggggcttggacggcccctgagacgcgtggagcctccctgggagagcttcagagccgatgtcgaagctacgtatcctgaagtgtttgttgcgcggcccgagcgcagacgggcccgcggcgaggggcatgctgccacaatcagacaggtgaaggaacgggagtgcaccccgattgtcttcgaaagaaaagccgtgtccagcctcaaggaggctgacctggaacgcatcaaagatggagagcggaacgaggccatcgtggaagcgattagatcttggatcgctacaggccgccctgccgacgctccccctcggtcccccagaggggatattatcaccaagattcggctggccaccacaatcaaagccgcggttcctgtccgcggcggaacggctggcagaggggagatggtgcgggccgacgtgtttagcaagcccaatcgcagaggaaaggatgaatggtaccttgtcccggtgtatcctcaccagatcatgaaccggaaagcctggcccaagccccctatgcgctctattgttgctaataaagacgaggatgaatggaccgaggtgggcccggagcatcaattcagattttccctctacccccggagcaacatcgaaattatccgcccttccggggaggtcattgaaggatatttcgtgggcctgcacagaaatacaggggccctgatccccacccctgttggccccgactcttacgtgatcgcttga

SEQ ID NO: 3748 - RNA, 3024 nt, synthetic construct
  misc_feature 1..3024: note = Cas9 variant
  source 1..3024: mol_type = other RNA
atgaaggtgctgggcttcgacatcgggattaacagcatcggatgggcctttgtcgagaataacgaactcaaagattgcggcgttagactgttcaccaaggctgagaatcccaaaacaaaggaatcccttgccctgcctcggcgcaacgcgagatctagccgggtgcgcctcagacggcgcagatcccggctgctttctctgaaacacattatcagcaaggagtttgggctccattacgaagactatattgctctggatggaaatctgccgaaggcctacacgggcaaaatcgagtccatctataagctccgctacgaggccctgtctcaggctattagcaaagaagaccttgccagagtgatcctgcacattgctaagcatcgggggtatatgaacaaaaatcaaaagacctcccaggatagcgagaagggagccatcctctctgcgattaaagaaaactccaataagatcaaacactaccagacagccggcgagtatttctacaaggagctgtttgaaaaccttcgcgacggcaccaaagagttcaagaatattagaaacaaagctatgaagaatgaaaagacagggaacatggagagcacctactataatacaatcctggcctctgatctcgaaaaagagctgaagctgatcctcgagaaacagcaggcttaccataactattccgacacctttattaaggaagtcctggagatcgccttctaccaacggccccttaaagattttagccacctggtgggatcttgtacgttctatgaaaacgagaagcgcgcgtgcaaaaattcctacagcgcctgggaatttattgctctcggcaaaatcattaacaccctggagtccatcaagaaagacacaggggagatcttctctaatgaaattatcacccagattcttaaggaggttctggataaaggaagcctctcctatacaaagctgagaaagatgatcaacctggacgaaaaagtgaagtttaaaggcctcaagtacgataaagagggggtcgaaaagaccaatctgattgagttcaagaaacttaaggagttcaaaaaggccctgggagaacacaacctcgagcggaaaacgctggacgaaatcgctacacatatcacccttacaaaggacgagaatcagctgaaaaagcaactcgagcagtacgccctgagccagaaccagattgatgccctggctgaactcgactttaatgatcacatcaacctgtctttcaaggcgctttatgagattctgcctctcatggaaaaaggcaagagatacgacgaggcctgtaatgaactgggcctgaaagctaagacctccaaccaaaagagcgagtttcttcccgccttctgcgattctatctttgcccaggagctcaccaatcctattgtgaaccgcgctatcagcgaatatcggaaggttctgaatagactgctcaagaaatacgggaagatgcataaaattcacatcgagctggcccgcgacgcgggactttccaaggaagctcggaacaaaatcgagaaggaacagaaggagaacaaagatattaatgacaaggccgagaaaacatgtaaggagttcggcctgaaacccaacgccaagaatatcctcaagattaaactgtggagagaacaaggggaaatctgcgcttattctggaaagaaaattacgatcgatgacctgaaggaggataaagcccttgaagtggaccacatctacccttatagccgctcctacgacgatagctacaacaataaggtcctcgtgtttattaaagagaaccagctgaagctgaatcagaccccgtatgaggctttcggctctaaccaggaaaagtggtccaaaatccaagtgctcgcccagaagctgccctacaaaaagaaaaatcggattcttgacgagaactttaagaataaggatcagatcgagttcattagcagaaacctgaatgacacacgctatgcgacctctctcatcgccaaatacacaaaggaatatctggagtttctgcctctttccgatgacgaagatatcagcctcaaatccggggagaagggatctaaaacccatgtccagacgatgaacggcatgctgacaagcgttctgcggcacgcttggggcttctcccaaaaggacagaaataaccatctccaccatgccctggatgctattatcattgcctactctaccaacagcatcattaaggcgttttccgacttcaaaaagaatcaggaaatccttaaagccaagctgtatgctaaaaagctcaccagcgaggaatacaagaaccagtctaaattcacagggtttgagaagtaccgctccaaaatcctggagaagctggatagcattttcgtgtctaaaccccctaataagaacaccaagggagcccttcacgaacagacattttattcctaccaagacatcctcgaggaatataaaacgcaggagggcctgaagcgggctctggaatgtgggaaagtgagaaagattggaaccaaatacgtcgtgaatgatcggatggttcgcctcgacatcttcaagaaagacaacaagttttatggcattcccatctacacaatggatttcgccctgggggtgcttccgaataaggtcgtgaccattggcacagacaaagataagatcaaaaaggagtggaaaaccatcgacgagacgtatgaattttgcttcagcctgtacaagggagatctcgttctgattcagaagaaagagatgcaggaatctgagtttgcctactataacggcttcgacatcagctccgctagcatttctctggaaaagcacgataataaatttgagaaccttaccgagaatcaaaagctcctgttccctaaagcgaaggaaggggacgtggaggtcagaggaatcggcattcaggggctgaaggtgtttaaaaagtacatggtcacacccctcggagaaatccaggagacccggacagaggccagacaaaacatccagcctcgcaaaaagcatggcctgcggtga

SEQ ID NO: 3749 - RNA, 3033 nt, synthetic construct
  misc_feature 1..3033: note = Cas9 variant
  source 1..3033: mol_type = other RNA
atgagcgactcctcttacgtgctgggcctcgatctggggaccaacagcatcggatgggcctgcgtcagacttaataagggcaaacccgacgggctgctcgctcagggagttcggattttcgaggccggcctggaaatcgatgcgtatgggcgcggaacacctcttaacacggagagacggaatgctcgccaaagacggcgcctgcacgacagacggaagcgccgcattctcaaagtgcggcgcatcctgcaggaagccggcatgctgccggccaacaagcccgatcataaagacgctgagtggaagatgctcctggccagaaatccttaccggcttcgcgctaaggccctggatgaacagattgacctcaaagagatcggcctgtgtatctatcagtttgcgcacagacgggggttcctttccaactctaagattctgaaaaaggatgacgatagaggaaaactcaaggacgccaccaaggcttttgccgaggatatggaacaaaaaggcgctcgcacatggggagagtacctgagccatctggacccccacgaacagcggatcagaaccaattatacactccgcgagtggtacacctccgagttcgacctgatttgggaaaagcagcagtctttttatcctcatgtgcttacagatgacctgtacaaacgggtcaaggaggccctcttctaccaaagacccctgaaaagccaggcgcaccttctggggcagtgcgaactcgagcctggccgcaagcgggccccgtttgctctgctgatggcccaggagttcagactcctgcaatcccttaaccatctgcgcgtggttagctctaccggggatgaacggctcctgacggacgaggaaagaaaacaggctcttgccctgctccgctcccggggaaatcagaagtttaccacactgagaaaggtgctgaacctccggggcaccaaattcaatctggagcgcggcggggaaaagacaatccaaggaaacaataccgccgctgcgcttggcaacctgtttggggaggcctgggatcacttcagctctgaacagaaaaatcagattgtcgaggacagactcacgatcggagatacagacgctctgattcggagaatgaagaaaacctggggcctggattccgtgacagccgagatgtttagcgaaaccgagcttgaagacgggtattgtggattctctcgcaaggccctcgagaagctgctgcccctcctggaacggggccacgctcttatggaggccgttcaggcggcttaccctgattatcaaaagaacctgcccagaaccgacacactccctcccctggagaacctgcgcaatccgatcgtgcagagaacgctttccgaactccggcgcgtcgtgaacgccatcattaaggagtacggcaaaagcgacaagatcagaattgaactggcccgggatatgaaacagaccgctaagaatcgcgagaagtcctgggacagaatgcgggtgcgcgagagacagcggaaagaagccgctaagaaaatcctggaggaaacagggaaccctgcccccagaagacatgagattgaaaaggtcctcctggcggaggagtgcaattgggaatgtccttataccggaaaacggatctgcatgaacacacttctgggcgatgctccccaattcgacatcgagcacattatccccttttctcgcagcttcgataattcctttagcaacaagaccctctgtgacgttaattacaacagaaatgtgaaggggaacaaaacgccttatgaatctgcctccgagacagaacacgaggagatggtgtgccgggtcaagagattcaccggagattacaaagaaattaagctggaccgctttaatacccgggagacagatagcagagccgacttcatcgaagagttttctaccagccagctgaacgatacacgctacgcttcccggcttgccggcgaatatctcgggaaactgtacggctctgagtggagaaagcatattcagatcgcgaaaggaggcacgaccaagtatctgcgcgacgcctgggatctcaatcggatcctgagcgacgggggaacaaagtccagagacgatcaccggcatcacgctgtggacgccgttgtggtcgctcttaccacaccgcagaccgtgaaagccctgagcgatgccaaccaacgcgctcccgagcatagacggtacgcgttctctgacatgcctctcccctgggaaacgtttcgccaggatgttgagcaggccattaactccatcaccgtgagccacaaggtctgtagaaaagctaatggccagctgcacaaggaaacattctatgggctgattaaagaccggaagaccggagatacaagaaccgtgcttcgcaagcctctccatgagctgacggacaaagagatcaagcgggccgaaattgtcgattcttccatcagaaaactgattgagcaaaagctcaaagacctggatcagcccccgaagacagcctttaaggaccgcaacaatcaccctttcatcatcgataaaaacggcaataagcggtttattcataaagtgagagtttaccaggacgctaagcccgtgaaaatcgccgaaaaccgccacgtcaaacttgggggcaatcaccatctggagattttcgaagtgatcgacaagaaaggaaaccctacctggaagtgcgaggttattagcctcttcgatacacggcaaagagtgaaagagaagcgccccgtcatcgtgagacaggaccagaatggcaaccctctgaaattttccctgtctatcggggaagcggtgcagcttgattggaatggaggccgggagaccgctgttgtccaaaagatgagcaaaacccccaacacagtggaatatgtgttccgcaagcacaatgacgccagaaaggccgctgatattccgtacaaagagacgatcaccgtcaagtccgactctgccctgtttgcgagcaacctccagaaaattgtgatcacacctaccgggctgattcggcgcgctaatgattga

SEQ ID NO: 3750 - RNA, 3033 nt, synthetic construct
  misc_feature 1..3033: note = Cas9 variant
  source 1..3033: mol_type = other RNA
atgaagaacagaaatgtgatcggcattgacgtcgggaccaacagcatcggatgggccctggttgaggaaaatgagaacggcctcccccagtccctgaaagctgccggggtgcggattttccaagaagcggtggaggctaagacacgcacgcctaaaaatcacaagagacggcaggcccgccttgccagacgggtcctggctcgcagagcccggcgcaaacagagactccagaacctgcttctgaagcatggactcctgccgggcggggtgaccgatcccgttcaacgggaagctgcctttacaaccctgggagacccttaccagctccgcgcgaagggcctgaatcttcccctgggcctccacgagttcgggagagtgctgtttcagcttggagcccggcgcggcttcctgtctaacagaaaaacacggtatgggcatctcaataagctggatgagctggctgacctcatcgaagccgaggatgctgcccctaaaaccggagacgcggaagagggcattatcagaaaggagatcggggaactgcgccaggccatgagcgctgccggatcccggacacttggcgagtacctggctggcctcgccaaagaagagagaaagcgctgccggcacaccgaaagagccatgctggaggaggaatttgagcgcctttggatggtccaagctcggttccatcccgaactgtctgatgagctcaaggtgcaggttcacacggtgatctttttccagagacctctgaaaagcaaccgcgcgtccctggggaagtgttctctcgaaccgagccggagaaaagccgctcgcgcctggcccgaggcccagcggtttagactgcttcaagacctgaataacctcgagattctggatcctcggaccggagaacttcgcagactgcgggacacagagagagctattctcctgaatgccctggaacagcagaagtccatgacctggaacgcggtccgcaaaaagctcggcctgcaccaaggggagaaattcaatcttgaaacaggagctaaggccgagaccggcctgaaggggctccagacgctggccagcctgcatgctatccttcagggatggtttgatgagctcggcgacaaacgggatctgctgattgaagacctcatcacaattgaggactctgccggcctgtatagacgccttagagaacactgggggttcgatcgggagaccgcttttcgcctggccacactcgagctggaacccggatacgcgtccctgagccttaaggccatcagaaaactcctgcctcatatgggcgctgggcaccggtattctgaggcccgccagcaagtgggatacggctatgaaaccgggcagagagacctgcaggagcggctcggcgaacccccggatcctcgcaaccccgtggtcgacaaggctctgcacgagcttagacgggttatcaacgccctgattcatcgcttcggaagacctgatgtggtgcgggtcgagctcgcgagagacctgaaactggccaagcgcgataaggaacggcttgagaaacagaatagagaaaaccaacgcctcaatcggaaggctgaggccgctctggccgaactgggcctcgggcagccctccagagacgatctgatcaaataccgcctttgggaggagagcaagggactgtgcccctacaccggccgggaaattgggctctctacactgttctcccctgaggtggacgttgaacacatcattccgtatagcagatgtctggatgactcctacatgaacaaaacgctttgcatgaccgaggaaaatcgcatgcagaagggaaaccggacaccctgggaggcctatggcggggaccctgctagatacgagcagatcctccaatgtgcgcggtattttcccatggccaagcgcaaaagattcctggaacagggctctgattttgtggaccagttcatccagcggcaactgaatgatacccgctacattgctaagctcgccaaagagtatctggccgctgtctgcacaaacgtgcaggttaccaagggaggcacgacagccatgcttagacatcactgggggctgaatcggctcctgggagaagacgatggccagaaagagagaggggaccatcgccaccacgcgctggatgctgccgtgatcgccgtcaccagccggtccctttaccaaagactggctcgcattgcccatcagcggggacacgcgcctagccagagaggcttttacatcgatcccccgtggcaggggtatcaagctgacctcgcccagaccctggccggcattgtggtctctcatgctacaaaccgcaagctcaccggagccctgcacgaggaaacagcttacggccacatccctcatgtggggttcgtttatcggaagacgcttaataaagactttaagctgggagatatcgaggccatttacgacccctccctccaggaactggtgaaagcgcacctggagcatcacggcaacgatcctaagagagccttcgctgaagggatccagtgttatcataaagacggacacacccccattaagcgcgtcagaatccgggccaaacaagtgagcgagaagggcacattttctattagcgaccgcgctgggagagcctacaagcaccataaaaccggctccaatcaccatgttgagatccttcggcaccgcgccacaggaaagattgaacctgtgtatctgaccacgaaagaggctaccgaaagagcgcggagaggcggggagcccgtcatccagcgcgatcatggaccggaatgggagttcatcatttctctctgcatcaacgacatggtgcggctgggcgaagggggacaggtggcctactttagagttcagaagattgaggctacaaataaccgcgtcaccctccggagccacctggccgccacacttgatgacgaggatatgaaagtgaccacgtccgtgcctaagctggctgtcatgcccggcttccaaaaggtgctcgttacagccgtgggcgaagtcctggagctgcacgactga

SEQ ID NO: 3751 - RNA, 3033 nt, synthetic construct
  misc_feature 1..3033: note = Cas9 variant
  source 1..3033: mol_type = other RNA
atgaagagaatggccgctgtgggcctgatgcccgccgaccctaccgaggcgaaagctctcgaactgcttgatccgtacgccctgcgggccgctgggctcgaccaggccctgccccttacacacttcggacgcgctctgtttcatctcaaccaaagacggggcttcaagagcaatcgcaaaacggataagggggacaacgagtccggaaaaatcaaggatgccaccaagagactggacgaagagatggcgattaaaaatgcccggacatatggcgaatttctgcacatgcgcagaacctctgctacagatcctaagaacgtccccaccgttcggacacgcctcagcatcgccagacgggacaatgctgagaaagaggaagccgggtacgatttctatcctgaccgcagacatctggcggaggaatttgataagctgtggaaagcccaggctggatactcccccgacgtgctgaccgatgagctccgggacgagatttctgtgatcattttccaccagcgccctctgaagacgccggaagtcggcctttgcctgtttagcggctcccatggggtgcccaagaaagacaagagaatcccttctgcccaccccctcaaccagcggagaatcctgttcgagaccattaataacctgcgcgttgctgcccggggagaacctgccagaggcctcacacgcgatgagcgggacgctatcgtgcacgcgctggataataaagcccataccaagagcctttccgggatgagcatgaaactgaaggctctcggaaaagtcattaagctgagacccgaacaatcttttacacttcagaccgccaaccgcgagacgatcgcctgtgacccggtgcgggcttccctgagccaccctgatagattcggcccccgctggtctatgctcgacgccgatgcgcagtgggacgttgtgcagcggattagagctgtccaatccgaggccgaacatgatgccctggtgaagtggctgatggctacacacgggctcgaccgcgatcacgccgagagcaccgctaaagcccctctgcccgaaggatatggccggcttggcctgacagcgaccaagagaatcctcgccgctctggaggccgacgtgattccctactctgacgctgtcaaagcctgcgggtggcatcactccgatggacggaccggcgaagttcttacagagctgccttattacgggcagatcctcgaccgccatgtgatcccgggaacgtacaatgagagcgatgacgatgtgaccagatatggccggattacaaaccccaccgtccacatcgggctgaatcagctgagacgcctcgtgaacaagattatcacagtttacggaaaacctgacgaaattgtggtcgagctggcgcgggatcttaagctgtccgaagaccagaagagagatgtgcaacgcgacatcaaaaagaataccgatgccgctatcgccagaggcgctaaactctctgagatgggcgttcccgacacgggggccaaccggatggtgctgcgcctgtgggaaagccttggagatgacgtcatgacaagaaactgtccttattccggcaagcggattagcgccaccatgctctttgacgggtcttgcgatgtggaccatatcctgccctactcccgcaccctggatgacggattcgctaatagaacactctgtctgaaagagtttaaccggcagaagaccgataagacaccgtgggaggcgtggggcgacacgcctgcctgggctaccattgaagccaatcttaaaaacctgcccgccaataaggcttggcgcttcgcccctgatgcgatggagagattcgaaggggagaacgactttacaagccgggctctcaaagatgcccagtatctgtctcgcatcgccagaacctacctggacgctctttatgatggcgccgacggaaagagccacgtctgggtggttcccggccggctcacagagatgctgagacgccactgggggcttaattccctcctgcctgataaagacggagcggtgaaggctaagaaccggaccgaccatagacaccatgccattgatgccgctgtcgtggccgctacggaccgctctcttatccaacggatcagcaaaatggccagaaaggatgaagttaatggcgcggaggaagtggcccgctccgtgcccccgccttgggaggggttccggaccgacattgaaacacagctggatagaatcattatcagccaccgcgctgaccacggacggattgatcccgccgctagaaaagacggccatgattctacctccgggcagctccacaacgacacagcctacggcctgggagagggcaatagcgtcgtgtctcggaagcccctgctttccctcaaaagcaacgatatcgaggttaccacgaagggggccaatattcgcgacgtcgacctgcagagacatctggaacggatcacacgcggactcgatggcaaagctctggaggcggcccttgctgaatttgccgccaccgctaagctgcctgacgggacagataacccgtactatggactcagacgggtgagactggaggaaaccctgcaacagggcgcccgcgtggaggtcaaggaccggaatgggaaacccttcaaggcgtacaaaggcgattccaaccactgctatgagatctggagaatgcctgacggaaaggtggttccccaggtgattaccacatacgaagctcatcagatcgatgtcgagaaaaagcctcaccccgccgccaagcgccttctccggatttttaaaagagacatggtggctatcgaacaagatgacaaggccattatcggctatgttcagtctatgcacgtggcgaacgggctgttcatcgctcctcatacggaggccaatgccgatgctcgcagccgggacaaatccgattcttttagactgattcagatgagcgccggacccctcgtcaaggctaacgcccgcagagtgtacgttgacgaaatgggccggctgcgcgacccgggggcgccttcctga

SEQ ID NO: 3752 - RNA, 3039 nt, synthetic construct
  misc_feature 1..3039: note = Cas9 variant
  source 1..3039: mol_type = other RNA
atggccaacatgagataccggctggctctcgacctgggcagcacctcccttgggtgggccatggtgcgcctggatgcgcagaatgagacatgcgctgtcatcaaggccggagttagaattttctctgacggccggaaccccaaagatgggagctccctcgccgtgtctcgcagagaagctcgggccatgcgcagacggcgcgacagactgcttaagcggaaaacgcgcatgatggctaccctgatgaagcacggatttttccctcaagatgaggccgcgagacaggccctcgtgaataaagaaccgtttgctctgcgggccaagggcctggaccatgctctcctgcccgaggagttcgcccgcgcgctttttcacatcaaccagagacgggggttcaagagcaatagaaaaacagataagaaagagaccgactcctctgccctgaagaaagctattggacagctccgcgaggccatgcaagctagcggctgtcggacagtcggcgaatggctgtgcgccagacatcagcaggggctttccgtgcgcgcccggtatagagagaaccgcatcaccaaggatgacggaaagacaaaaattgaaaagagctacgatctgtatatcgaccgggctatgatcgaggcggagtttgatgccctctgggctaaacagtctgaactgaatcctgagctgttccacgaaaccgccagagccgagctcaaggactgtctgcttcatcaacgccccctgaaacctgttaagcccggccggtgcacgctcctgcctgacgaagagagagctccgcttgccctgccctcccagcagcgctttcggatttaccaggaggtgaacaatctcagactgctgcgggaagggctcaacgaggaacctctgacccttacacaacgcgatcagctgatccaggcgctcgagaccaatcccaaaagatccttcacacaaattcagaagctgcttggattttctggccagttcaacctgcaggacgataagcggaccgaactcaaagggaatagcacgagcgctatgctgtctaagaaagagtttttcggatcccaatggctgagcttcgacgagacacaccaggatgaaatcgtcatgcagctcgtgtccgaggaaaacgaggccagactgattgcctggcttcaggctgaaaccggcgttgacgagatcacagccgagcgcattgctaatacccctctggccgaaggctatgggtctctcagcgcgaaggccctggagaaaatcctgcccgcccttcgggctgatgtgatcacctacgacaaggctgtcctcgccgcgggatttgatcaccattcccacattagccatgccgctacaggcgaaatcctgccggacctgccttattacgggcaatacctccagagacacgtgggattcggcacggggaagcccgaggatcctgccgagaaacgctatggaaagattgctaaccccaccgtgcacatcggcctgaaccaggtcagaacagttgtgaatgcccttattaaacggtacggccatccctctgaagtggtcgtggagctggcccgcgacctcaagcagtcccaagaacagagaaaagaggaacaggctcagcaagcgaagaaccagcggcgcaatgagagaatgcggcaggacatcgccgggctgctgaacaccagcacagagcgcgttagagctcttgatctccaaaagatgatcctgtgggaagaactgtcttttaatgtggccgaccggcgctgtccttatagcggagtccagatttccgcccagatgcttttctctgatcaggtggaaatcgagcacattctgccgtttagccaaacccttgacgattccctgaacaataaaacggttgctatgagacaggccaaccggatcaagggcaatagaacacccgcggaagctgccgccgacttcgctgcccaggggtggcctgtggaggatatgctccatcgcgcgagcctgatgcccaaaggaaagcggtacagatttgctcaggacggcatggcccaatggctgcgcgaggataaagggttccttgcccgggctctcaacgacaccagacacctgtctcgcgtcgcccgggaatatctgtccctcgtgtgccctcagggcaccagagtcattcccggacgcatgacagctatgctgcgggccaagtttggccttaatgatatcctggggctcaacggagagaagaatagaaacgaccatcggcaccacgcggtggatgcctgtgttatcgctgtgaccgaccagagcatgctgcagaaattcgccaaggcttctgcctccgcccgcgaaaaacaactgaataagctcgtcgagagcatgccgctcccttgggactcctacagagatcatgtgcagcgggctgttgaacgcatttgggtgtctcacaaacccgaccatggccacgagggggcgatgcacaacgatacagcctatggactgctgggcgggggccatgtccaggtgagaaagcggatggacggagtgagaacgcgcgagaccgctgccctcaaagttatcgaatttgccgatcggcaagctcaccctagacatggcctgcttcccaacggggagcctatgccctacaagggatacaagggcgacagcaattattgcatggaaattgtccgcaacgataaagggaagtgggagggagaggtggtgtccacattcgaagcctaccagctggtccggcagcacggcctcgcgagactgcgccatccggctctgtctgtgagcgggcggcctcttgttatgagactgctccgcaatgacaccctgagagtgatccacaacggcgagcagcggacagtccgcatttgtaaaatgaccgccgaaggagtgatcgccctcgctgatacgaccgagtccaatgttgacgccagaacacggaccaaggatctgagctatatttttaaaacagcgggctctcttcaaaagtccaaggggcgcagagtggctatcagcccctctggagaaatgaaagaccccggcttcttcgattga

SEQ ID NO: 3753 - RNA, 3051 nt, synthetic construct
  misc_feature 1..3051: note = Cas9 variant
  source 1..3051: mol_type = other RNA
atggaggtgttcgtcgacgttagcgccagacagctgggcatcgatctcgggattggaacctgcggctgggctctgcttgccgaagactccctgatcgcgctcgggacacggacgtttgatgtgcccgagaccgacaaggaacgcattcctacaaaccaaatcagacggcaggctcgcggaatgagacgggtgattgatcgcagacggcagcgcatgaatgccgtcagacggctgcttgccgaccacggcctgctcgctgatgggggaaaactgggcctggccaccgtgcgcctcgacccgtggcaggctagagccgagggcctggatcggcttctgtctgcgggggaactcgccgttgctctgggacatatcgccaagcaccgcggcttcagaagcaactccaaacgggacagaggggctaatgcccccaaggagtctagcgcgatgcttggagccatcgctcaaacaggcgagcgcctgcagcattggcggaccgtgggggaaatgttttggaaagatgagttctaccagacaagacgccggaacagagacggagattattcccgcaccgtccagcggctcgacctggaaacggaggtgcacagactgctcgccgctcaacgccggctgggcaatcctcttgccacctttgacctggagcagtctttcattgatgttgcctttttccagagacccctcgctgacagcgatgacaaggtgggcccttgtccctttgaaccttccgagaagcgcgcggcccggcatagcccgtctttcgaaagatttcggctgctttcccgcctggctgccctcagactgagctctggggccggagagcggcccctgtccgatgctgagttcgccgcggcttgcgccgactttggcagactccaggggttcagcttcaaacgcctgcggcaacaccttaagctggatccttctatcagatttgccggaattgctcccgacgaggagggcaaacgcgatgtcgtggccagatccggggaagctacacctggaagcgccgcgctccggcactgtctgggcgacaccgtgtgggataacatgcttggcacacgccccgccctgctcgacgctatcgccgctattctgaccttcagagacgatgccgaccggatcgcggaggggctggccggactcggcattgaggaaccgatcctggatgctcttatggacggggtccgcaatggatcctttggcaagttcaaagggcctggccatatctctgccaaggcttgcagagccctgctcccccacctggcccggggacgcgtttacagcgatgcttgtgcggacgccggctatgatcattccagacagacggaaacaaacctggacgatattcggaatcctgtggctcgcaaggcccttggggaggccctcaaacagatcaagattatcattcacacccacggaagacccacagctatccatgtggagatggcccgggacatcggcaaaagcgcggatgaaagagacgagattaagaaagggatcgataagcgcaactctgaaaaagaccgggctagacaacagtttcacgagatggtcggaacccccgccgccggcgctgaagacctgctgcgcttcgagctctggaaggagcagaatgggtggtgcctgtacaccggccgggaaattcctatcgatgcccttgtgtccagcgacaaccgcattcaggttgatcatatcctgccgtggtctagaagcggagacgattcctatatcaataagacactctgttttacggaggcgaaccaacacaaaaagggcatgaccccctgggaatggctgcatgacgatcctgagcggtgggagaaattcgctagaacagtggaagggtgcaagaccatgaaaggacgcaagaagcggaatctgcttctcagagactctagccggctggagaaagaatttcgctccagaaacctgaacgatacacggtacgcctgtcgcctcctgcttggcattctgaagcacacctatcccgacatcgtcgtggccgctagacctgggcccctcacggatcggctgagacgcgcctggggactgcagagccttaaaaagcacgaggacggcacacggaaagatgacgacagacatcacgctctcgatgccgcggttgtggccgctacctctcagtccatgctgcagcgcctgaccacactcttccaaaaggccgaacgggaagggggcagacgcgactttgtcggactggagccgccttggcccggcttccgggctgatcttgaagccaagctggagggggtggtcgtgagcagagccgaacgcagacgggctcgcggagcgggccataaagacaccattagagccatcggggagggagatgctggccctgttgtgtacgaacggaagcccgtcgccgccctcacagagaaagacctggatcgcgtgaaggaccctgagagaaataaagttctgattgaaaaccttcggcagtggatcgctgccgggaagcccaaggatccggacaaagcgcctagatctcccaagggcgatcccatgacgaaagtgaagctcgtcaccacagacgacgtgcgcattctggtgcggggaggcaccgctgatagaggggacatggcccgcgttgatgtctttcggcaggccgaccctaaaggaagatggcggttcttcctggtgccggtgtacccccaccaggtctttgatcctacagactggccccaacctcccaatcgcgctgtggttgcctataagcctgagaaagaatggaccgtgatgggccccgatcacgagttcctctggtccctgtacccgtttagctggatcgcggtcgaaaaggctgacgggacgagaatcgagggatatttccggggcatgcatcgctccaccggcgccatttctatcagccctcaccattccaagtctcttgccagcacagggattggagctaaaaccctggcctcctttagaaagttcgctatggatcggatgggcaacctcagcgagatcgaacgcgaggtgagaacatggcacggggttgcctgcacctga

SEQ ID NO: 3754 - RNA, 3054 nt, synthetic construct
  misc_feature 1..3054: note = Cas9 variant
  source 1..3054: mol_type = other RNA
atgagagtggacagcctgggccggtgcctctccgatgaggaatgggcccgcgtcatctaccacctgtgtaagcatagagggttccactggatttctcgggctgaggccaaacagaccgaaggagacagcaagtccgagggcgggaaagttaagcaaggacttgcgggcacagctaaactgatggatgaaaaggggtatcgctctgccgccgagatggtgctcgctgagtttcccgaagcccagagaaacaagcagggagagtaccggaaagctctgagccgcgaacttctggccaaggagctcgcgctgctgttcgccagacagcgggtgtttggcaatcgccatgctacggacaccctcgagacagccatcctgggcaactccgataaaaagtctgggcttttctggcaacagaaacctgctctggccggagcggacctcctgaagatgcttgggacctgcacatttgaaaagaatgagtatagagccccgaaagctagcttcaccgccgaacggcacgtctggctgacacgcctcaacaatctgagaattgtgaccgatgggatcacgcggcagctgaccgagcaggaacgccaactcgttctgccccttccttacagacaggctggagacctgacatataagcagctcggcatggccctgaccaaagccgggcttctggaggctggatgttttaagttcattggcctcgcgtaccccacagaggcccagaaagctgaaggcaagaccaaagatcctgagtccgccacgctggtgaagatccccgcctggcaagaactgcggcagacactcaacaaggctagcctgaatgacgagtgggaaaaactttctggggatgccctgtgcggacagcctgagatctttgacaagattgcgtggatcctctccgtctataaagatgacgacgaggtgagaaccgaactggctaaacttgttctgccgaaccccgagggcctcacagaagccctgctgaatattcgcttcgataagtttcatgccctcagcctgaaggcccttcgggctatcgtgcctcacatggagaaggggctgagatacgacgaggcttgtgtccaagccggataccaccattctcagctccacaaaattggcgagggggagcataagtatctgccccctctgtacgatggacgcgacggcgatggccggatgatcttcgcggaagacgccgatattcccagaaacccggtggtgcttcgctccctcaatcaggctcggaaagtcgttaacgccatcatcagacgctatgggagcccttctgctgtgcacattgagatggcccgggacctgtccagaccctttgatgaacgcaataagatcaaaaaggaccaggatgagtaccaagcgcggaaccagagagaccgggagcagttcattgaactgttcggacaccctcccaagggcctcgagtttgaaaaatggcgcctgtatagagagcagaatgggcaatgcgcctacagccagaagccccttgcttcctctggagacgtggccgaaatcttcctggatggcagcaccgagattgaccatgctctcccttattcccggagctttgatgactctaaaaacaacaaggtcctggtgctgaccagagagaatcgcgataaagggaaccggacaccgtacgaataccttggcggagccgaaaattccgaaagatggcagcgcttctttagcttcgttgagtctaacaaggcctatagactcgctaagcggacgcgcctgctgagaaaagactttggcgcgaaggaaagcgaggagttccgggaacgcaatctcaacgataccagatacgtgtgtcggtttttcaaaaattatgtcgagcagcacctgaaacttgccgaagggtccgaggctaagcgctgcgtggttgtgtctggacaactgacaaactttctcagaacccggtggggcctgctgaagatccgcagcgactccgatagacatcacgcccttgacgccgctgtcgtggccgcgtgtagccattctatggtccagcggctctccaattacagcagaacacgcgaactggaacaggtgcgggatgggttcgttaacatcgagaccggagaaattgtgaatcccgctatgcaccagcaactgagagagcactttcctgacccctggccttatttccgccatgaactcgaggcccggctgaaaatcgattctcccgcccttctgagagaggaaatggctcgcctctccagctacacggaggaggagctggccgcgctgaagccgcttttcgtctcccgggctcctcagagacgcaacggcggggccgcccacaaggacacaatttatggccagcccgaaaaactcaagaaaaatggatctgtgagccaaaaggttgctctggcctccctggctctcaaagacatcgatctgcttgccgaccctcatcggaacgcgaagctgtacggcgccattagagagcggctcgaggctcacgggggaaagggcgataaagcctttcccgctaccaatcctctgcgcaagcccgacaaagaagggaacccgaccggacctatcgtgagaacagtcaccaaggtgatcgataaactgtctggcattcccgtgcggggcggcatcgccaagaacgacacaatgcttcgcgttgatgtcttcacgaaggccggaagatttcacctggtgcccgtgtacgtccatcaccgggtgaccggcctccctaatcaggctattacaagagggaaagacgagaaccagtgggcgatcattgatgacaccttcgaatggcgctttagcctgtatccgaatgatctcgttcagatccggctgaaggacgagacacatcttggatactatgcctccaccgatagaagcacgtcttccattagcatctgggctcacgaccgcaaccaatctgtgggcaaagacgggctgatccggtccattggagtcaccacagccaaggatatcgaaaaattccatgtggacaccctcggcaatgtttaccccgcccctcccgagaagagacgcgggctggcttga

SEQ ID NO: 3755 - RNA, 3066 nt, synthetic construct
  misc_feature 1..3066: note = Cas9 variant
  source 1..3066: mol_type = other RNA
atgagacggcgcagagaccggttcaagcagcgccaagccgctctgctcaaacacctggccggcgtggggctttttcccgcggatgaggctgccagacgggaactggccggactcgacccttacgagctgcgcgctagagcccttcatgaagctctgccgctcaaccacatcggccgggccctgttccatctgaatcagcgcagagggtttaagagcaaccggaaaaccgatcgcggaaaggcggacgatgagggcaaaattagactcggggtcgcccggctgcaggaagctatgcacgagaagggatccgccacacttggcgagttcctgcatggccgcagagctgccgcgacggaccccaatcagatcccttctgttcggaccagactccgcgccgaaagcggggagggagctcggggcgatgggtatgacttttaccccgatagacgcatgctggaagacgagttcgaggccatttgggaatcccaacaggtgcaccaccctgctgtgcttacagatgagatcaagcagcggtttttcgaagtcatcttttatcagagacccctgaaacaacctgagattggaacctgcacactcgtggccggcgaacgccggctgccgaaggcccatcccctgttccagaaaagacgcctcctggaggagcttaacgctctgcggatcgtttggcctggggtgcaggcggaactcctgtctagagagcagcgcgaccttgcctacctgaagctcaaagataagcgggctgtcagatttgaaagcctgcggaaggccctgaaactcgaccccgacgcccgcttcaataaggagtccgaaaacagatctgagctgaaaggagatgaggtggctgccgaacttggcgctaagagccggtttggcgggagatggggacacaccgcgcctgccgaccaatgggagattgtttcccgcatccaggccctggaaagcgatgacgatgaggctcagttctgtgtgtggctctctgaacggtatggcctggactccgagcaagccagagctgtcgccgcggcccgccttccccaggggttcggaagatttggcctgacagctaccacgcggctcattaaagccctgcaggatgaggtgatcgtgtacagcgaagctgtccagaagaccgggctgggacatcactctgacttccgcaatggcgaggttctcgccgaactgccgtattacggcattgcgcttgagagacacatcatgcctgggacaggagatcccggcgactccgatgagatgcgggtggggcgcgtgaccaaccctacagtccatattggactgaatcaactcagacgggtggttaaccgcctgatcaaaagatacggccctccccggcagatcgccgtggaactggctcgcgagcttaagctcgacgaccagcacaagagagaaattaatgggcggaacagacagaatcgcgaggccgctgaacggagaagccaaaaactggtcgatatcggcattgccgacaagggagccaaccgcgctctgctcaaactgtgggaggagcttaatcccgataacgcgctggaccggagatgcgtgtataccggccgccagatctctattgaaatgctcttttccggggccgttgaggtggatcatatcctgccgttcgctgccacgctggacgatagcaacgccaataagctgctctgtctgcgggaagctaacagaaataaacgccggagatccccctttgaggccttcggacagggcgcggactgggaagagatcgctgcccgggccgctcgcctgcctagagagaagcggtggcgctttgaacccgatgccatggcgagattcgacacagaggaaaagtttctcgctcggcagctggtcgatacccaatacctttctagactggcccgcgagtatctcggggtgctgttccctgacaaaggagaaggcagcgggcgggtctgggtgtcccccggcagactgacagagatgcttcgccggagctggggactcaaccaccttctgccggatcataatctcggcgggggagccgaccagcctaagaacagacgcgaccaccggcaccatgctattgatgccatcgttgtggctgtcaccgacagacatctgcttcaggccattgcgcgcgaggccggccagagagggcacgaagctgccaatcggatgaccgctgatctgcccgtgccttggcccgactttgatcgcgacgttggacaagtgatcagacaggtcgtggtgtctcaccgggccgatcacggcacagtttccaaagccggggctgcgaagggccaggacagcacggccggacgcctccataacgataccgcttacggcctgacagggcaaaccgacgagaaaggaaatacaattgtcgtgagacgggtgcctctgaccgcccttaagaagcccacgtctatcgaagccgtcagagatgacgagctccgcaaagctctgagcgtgtggacacggggctatgatgggaaggccttcgaggcgagactgtcccgctttccggaactcggacctctgcagttccggggcatcagacgggttcgcgtggtcgagccccttaccgtgattcccatcagagactctagcgggcgggtttacaaaggctataagggagactccaactaccgctacgatgtgtgggaactgaaagacggcaagtgggtcgctgaggtggttagcatgttcgatgcccaccagtcttcctggaccagccctgtgagacgggaaaatccgacagcccgcaaggtcctctctctgcagcaaaacgacattgtggctatcgagcccgaggggaaagaaagagagctgatgcgggtggcccagcttcgccagggaggccagattaccctggcggcttgccatgaagccggggatctcaagagacgggacgccgagtccaatgaagtcgatccttttaaatatttcagccccacagctggaggcctgaagagagttcgcgcccggcaagtgagagtggacgagctcggccgcgtcctggatcctgggtcccgggacagagagcgcggagctgcctga

SEQ ID NO: 3756 - RNA, 3066 nt, synthetic construct
  misc_feature 1..3066: note = Cas9 variant
  source 1..3066: mol_type = other RNA
atgaagtacaccctgggcctcgacgtggggatcgccagcgtcggatgggctgttattgataaagacaacaataagatcattgatctgggcgtgagatgcttcgacaaagccgaggaatccaagacaggggagtctcttgcgacggctcggcgcatcgccagaggaatgcggcgcagaattagccggcgctcccagagactgcggctcgtgaaaaagctgtttgtccaatatgaaatcatcaaggattctagcgagttcaaccgcatttttgacacctccagagatggctggaaagacccctgggaacttcggtacaatgccctgtctcgcatcctcaagccttatgagctggtgcaggttctgacacacattaccaaaagacgggggttcaagagcaaccgcaaagaggatctctccacaaccaaggaaggagtggtcatcacaagcattaagaataactctgagatgctgagaaccaaaaattaccggacgatcggcgaaatgatttttatggagaccccggagaactccaataagagaaacaaagtggacgaatatatccatacaatcgctcgcgaggatcttctgaatgaaattaagtacatcttcagcattcagcggaaactcggctctccctttgttaccgagaagctggaacacgacttccttaacatctgggagtttcagagacctttcgcctccggggatagcattctgtctaaagtgggaaagtgtacactcctgaaggaggaactgcgcgctcccacctcctgctatacgagcgagtactttggcctcctgcaatccatcaataaccttgtcctggtggaagacaataacacactcaccctgaacaatgaccagcgggccaaaatcattgagtacgcgcatttcaagaacgaaatcaaatattctgagattagaaagctgctggatatcgagcctgaaattctctttaaagcccacaatctgacacataagaaccccagcgggaataacgagtccaagaaattctacgaaatgaaaagctatcacaagctgaagtctaccctccctaccgacatctggggaaaactgcactccaataaggagagccttgataacctgttctactgtctcacagtgtataagaatgacaacgaaatcaaagattacctgcaggctaataaccttgactatctgattgagtacatcgccaagctcccgacgtttaataaattcaagcatctgtctctggtcgctatgaaacgcattatcccctttatggagaagggctacaagtatagcgatgcctgcaacatggcggaactcgacttcaccgggtcctctaaactggagaagtgtaataaacttacagttgaacctattatcgagaacgtgaccaaccccgtggtcattcgggccctgacacaggctagaaaggtgatcaatgccatcattcaaaaatacggactcccttatatggttaacatcgagctggctcgcgaagccggcatgacccggcaggatagagacaatctgaagaaagagcacgaaaacaatcgcaaggcccgggagaagattagcgatcttatcagacagaacggccgggtggcttccgggctcgacattctgaaatggcgcctgtgggaagaccagggaggcagatgcgcgtacagcgggaagcccatcccggtctgtgatctcctgaatgactctcttacgcaaatcgatcatatttatccttactcccggagcatggacgattcttatatgaacaaagtgctggttctcacagacgagaatcagaacaagagatcctacaccccctacgaggtgtggggaagcaccgaaaaatgggaggattttgaagcccgcatctattccatgcaccttcctcagtctaaggagaagcggctgcttaatagaaacttcattacaaaagacctcgatagctttatctcccgcaatctgaacgacaccagatacatttctcggttcctgaagaattatatcgaaagctacctccaattttccaacgatagccccaaatcttgcgtcgtgtgtgtcaacggccagtgcacagctcagctgcgctccagatgggggcttaataagaaccgggaggagagcgacctgcaccatgccctcgatgccgctgtgatcgcctgtgcggaccgcaaaattatcaaggaaattacgaattattacaacgagagagaaaatcacaactataaggttaaataccccctgccttggcattctttccggcaggacctgatggagacccttgctggagtgtttatctcccgcgccccgagacggaagattacaggccccgcccacgatgaaaccatccgcagccctaaacatttcaataagggcctcacatctgtcaaaatccccctgaccacggtgaccctggagaagctcgagacaatggttaagaacaccaaagggggaattagcgacaaggctgtgtacaatgtcctgaaaaacagacttatcgaacacaataacaagcctctgaaagcctttgctgagaagatttataaacccctcaagaatggcacaaacggggccatcattcggtccatcagagtggaaaccccgagctacacgggagtgttccgcaatgagggcaaggggatttctgataactccctgatggttcgggtcgacgtgttcaaaaagaaagataagtattacctggtgcctatctatgtcgcgcacatgatcaaaaaggagcttcccagcaaggccattgtgcctctcaaacccgaatcccaatgggagctgatcgactctacacatgaatttctgttcagcctctaccagaacgattatctggttattaagaccaaaaagggcatcacagagggatactacagatcctgccaccgcggcaccgggtctcttagcctgatgcctcattttgctaataacaaaaatgtgaagattgacatcggagtccggaccgccatctccattgaaaagtataacgtggatatcctcggcaataaatctattgttaagggggagcccagacgcggaatggagaaatacaacagcttcaagtccaattga

SEQ ID NO: 3757 - RNA, 3072 nt, synthetic construct
  misc_feature 1..3072: note = Cas9 variant
  source 1..3072: mol_type = other RNA
atgaagatcctgggcttcgacattggggtggccagcatcggatgggcttttgtcgagggcgatgaaattagagactgcggggttcggatcttcaccaaagccgagaaccccaagacaggagaatccctcgcgctgcctcgcagagaggctcggggcgtgcgcagacggcttgcccgcagacgggtgcgcctgaatacgattaaaaagatcatctgtaaagaatttgatctcagactgtctgactacattgccgatgacggggagcttccgaaggcttatcagaccaacaaggatacaaaaagcccctacgagctgcggtataaggccctcaatgaacgcctgtccaaagaggaactggctagagtcatcctccacattgccaagcatcggggatacggcaacaaacacgcgaaggacggcgatgacaaggattctgggaaagtgaagaaagccatcggagagaataagaccctgcttgagcaaaaaggctatgaaagcgttggggagtactgcttccgcgaatttttcaagtccattaaagacaaggatggagagacacataacatcccttctcagaatattagaaacaagaaaggcaattatgaccggtgtgtgagccagaagcagctggaagacgagctcaaactgatctttgctaagcaaagaaaacttgggttcaacaaggagtttgaagatgccatcctggaggtcgctttctaccagcgccccctcaaggactttgatgacaaaattggagattgcatcttctttgacaatgaaaagcgggcccctaaagagtccattagcgcgatcgagttcgtggccctgaccagaattatcaacacactgaagtacctctctaaaaccacgggcgaagtttatgagaaggaaatcattaataagatctggcagaaaattctggagaacggcaagatgacctacgctgaacttcgcaaaatcctggccctcgattccagcgtgttctttaaggacaaagatctggactatacacttgggattaaggaggctgaaaagatcaaattcatcgagtttaagaaactgattaagttcaaaaaggccctcggatcttttgatggcctgtcccgggagatcctggacaatattgccatgcagatcgctattaccaaagacagacaacgcctcctggaaaaacttgaggtcttccccctgaacaaggaacagaaagagaacctcagccagctgaatttttctaagtacatcgatctttccctgaaagcgctcaaccagattctgcctttcatgcgggaggggagacgctatgacgaagccaaggatgacgctaaactgcaagagaaggccaagaatacaaagaaggaagagtttctcccgcccctgaaagagttcgatcttaacctgaccaatcctgtggtggcccgggctctcgccgaatttagaaaggtcctgaacgcgctgcttaaaaagtacggaaaggttcacaaaatccatctcgagttcgctcgcgacatgcggctggattttgacgaaagagagcggctgatcagcattcagaatgataacttcaataagcgccagctcgccgaagacttctgtaaagagcacggcctggaaccctccaacgccaatatccttaagattaaactgtggcaagagcagcagtggcactgcatgtattctggggagctcatcggcattcctgatctgaaggaccccacgaagctgcaagtggatcatatctacccgtacagcagatcctttgacgacagctatacaaacaaagtgcttgtccgggctgaatggaatcaggagaagggaaaccacacccctttcgaagcctttggcggggataaaaataagtgggacaaaatcgtggctctcgccgagaagctgcccccttctaaaaagctgaacagatccgaaaagagcaaaaaggataaactcctggacgagaagttcaacgataaagagcttggatttctggcgcgcaatattgttgacacaggctacatcgcccggctcgtggctaagtatattgatatgtacctggagttcctgccccttgaagaaaacgagaatacctctctcgccagaggggagaagggaagcaaaaagcatatcggcattgtcaacgggcgcctgacctccgaagtgagacacaattggggcctggaccccaaagatcgggacaaccacctccatcacgctatcgatgccatcgttattgcgtatatgaatgacaagcgcatcaaagcctttgctgatttcagacggctgaaggagcttaagattaaacgctacggaagagaaatcacagaggacgaatatcaggagaagaaaaaggagctgtcttgtgccccttttgacgatttccggaaccgcacgctcgaaaatattgacaaaatctttgtgagcagaccgccccggaagcgcgctagaggcaccctgcatgaggaaacattctactccatcgatgacaagaaactgcttaaggcctacgggggaaaagagggcatgcagcgggccctcagcctggggaagattagacagatcggaaccaaaattgtcaagaacggcacaatggtgcgcgtcgatatctttaaggacaaacgggggagattctatggcgtgcctatttacaccatggatttcgctctgggagttctccccaataaggcggccgtgtctggcaaagacaagaacgggctgatcaaagaatgggctgagatggattccggatatgagttttgcttcagcctttttaaggacgatctgattctcgtccaacgcaaagaaatgcaggagcctgaactgtgttacttcgtgtcttttgactccagcaatgcccagatcgacgttcggtcccacaacaatcatttctctgtgctgaacgagaaccagaaacttctgtttaagagcgccacgcaagctgaagtcatcggcgagtccattgggatccagaatctcaaggtgttcgagaagtggcacgtgtctcccctgggagaagttagaaaagccgagtttagcccgcgcggcgaagcgaagctcaaaacatccaagaagcggaaaaagtga

SEQ ID NO: 3758 - RNA, 3072 nt, synthetic construct
  misc_feature 1..3072: note = Cas9 variant
  source 1..3072: mol_type = other RNA
atgaagatctacagcttcgacattggcgtggcctccatcgggtgggcttttattgagaacgaagtcctgcaggattgcggaatcagaattttcaccaaagccgagaatcccaagaacggcgcgtctctcgctctgcctcggcgcgaagccagaggggttcggaaacgccttgccagacggcgcggaagactgaatacaatcaagcaactcctgtgtaaagagtttggccttcagctggaagactatctcagcaacgatggggagctgccgaaggcttacacggcctccaaggctaatcccctgaaatctccttatgagctccggaccctggcccttagccagaagctggactccaaagatctcgtgcgcgtgatcctgcacattgcgaagcatagaggatacggcaacaaacacgccaaggactctaaggatacagaaagcggcaaagtcaagaaagctatcgagttcaatcggaagacccttgccgaaaaagggtatcgctccgtgggagagtacctgtatagagagtttttccagcaaagccggatttctcagaacaatggcgctacagaatttatcaacgttcgcaataaggccgggaactacgagcattgcgtggcgcaggacatgctcaaagaagaactggaatccattctgaatgcccagagacaattcggatttagcctcaagcaggatttcgagtctaagctgcttaccaaaatctttgagcagcggcccctgaagtccttcgctgacaaagtcggcaactgttgctttattgccggggaaaagagagctcctaaagatagcccctctgccatcgagttcatcgccctctcccgcacaattaataccctgatcaaccttagcaaggaatccggagagatttacaaccgggctatcattctgcagatcgtggaatctacgctcaagaaaggcgagatcagctataaggagctgagagaaattatccgcctggacgagcggctcagattcaaagatcctcgcctggactactcccgggaaattaaggaggcggaaaaagttaagtttcttgagttcaagcaactgaaaggctttaagaaagccctcggggagagcttcaccacactggctatctctcagcttgacgaaattgccgagcacatcgccctgatcaaggatagagtgaaactcaatgaaaagctggagtcctatgctctgaccaaggagcagcgcgaagccctcagcaacctgtcttttagcgcgcatattaatctttccctgcaagctctcaaacagatcctgccgttcatgcggggagacaacggcgagcagtgtctggattacgacgaatctgtcgagaaggccgggcttaaagccctcagcaaggatacactgaaaggacagatgctgccccctctcaatgaatttgagccctatctgtccaaccctgtggtggctagagcccttgctgagtaccgcaaggtcctgaatgttctcctgaaacaatatggcagcccccacaagattcacatcgaatacgcccgggaggcgaagctgtcttccaccgaaagacagaaatacgagaaggaacagaaagacaactatgccgctaatcaggccgctcataagaaatgccaagagcttgggctcgagccgagctctacgaacctgctgaagctcaagctgtggcaggaacagggaggcctttgtctgtactccggcgccaaaattacaatcagctatctccaggatcctaccgcgctgcaagtggaccacatttacccctattcccggtctttcgatgacagctacatgaataagtgcctggtgcttacaaaagccaaccaggagaaggggaatcgcaccccttttgaggctttcggaaccgattccgccaaatggggcgtcatcacaacgctcgctcagaagctgccccataagaaaagacggagaatcctgaacaccgcctttaatgacaaggaggccgggttcaaactccgcaacctgaacgacacatcttatattgctcggcttgtggcggattacaccgaaacatacctggagtttctccccctggttgagagcgaaaataccacgctgtccaagggacagaaaggcagcaagaagcacatcgccattgtgaacggggtccttacatctaccatgagatattacctcggcttcgcttccaaagaccgcgataatcatctgcaccacgccctggacgccgtgatcattggattcatgaacgatagcgttatcaaggctttttctgacttcaaaaagacccaagagacatccaaagccgcgtattacgctcataccctcagcaagcaggaatataaaaagcagagagcctttatccaactgccttctggcgagaatttccgggtgagcgtccttgagaaggtggaatccgtctttgtgagcaaaccgccccgcaagagagttcgcggggccctgcacgaggctacattctactctcctaacgatcccaaactcctgaagaattatggaggcacgaaaggggtggaacgggccctggcgcttggaaagatgagaaaggtcggcgctaaaattgtgtccaacggggccatggttcgggtggacatctttcgccataagagctccggcaaattctacggagtccctgtgtacaccatggattttgccctgggcattctccccaataaggctgtggttgtcgggaaagaccagaacggagtgatcaaggattggctggagatggactctagctatgaatttattttctccctctacaaggatgacgtgatcctggtccagaaaaaggagatgcagagaccggagctttgttatttcgtgtcttttgacacaagcggcgcctccatcaaagttgctaagcacgataataacttctctaccctgacagaaaatcaaaaactcctgttcagcaacgccaccaaggaggaagtggtcgggaagtccattggaatccagaatctgaaagtgtttgagaagtggcaggttagcgtgcttggcgaagtcaaacggacgcagtcttaccctcgcgagaacatttccctggcgagcaaggccaaaaagtga

SEQ ID NO: 3759 - RNA, 3075 nt, synthetic construct
  misc_feature 1..3075: note = Cas9 variant
  source 1..3075: mol_type = other RNA
atgatcagaaccctgggcattgacatcgggattgccagcatcggatgggctgtgattgagggcgaatacacagataaggggctcgagaacaaagaaatcgtcgcctccggagttcgggtgttcacgaaggcggagaatcccaaaaacaaggaatctctggcccttcctcgcaccctggctagaagcgcccggcgcagaaatgctcggaaaaagggccgcatccagcaagtgaagcactatctctccaaagccctggggcttgacctggagtgctttgtccagggagagaagctcgctacactgttccagacctctaaagattttctgagcccgtgggaactcagagagcgggccctgtaccgcgtgcttgacaaggaagaactggcgagagttattctccatatcgccaaacggcgcggctatgatgacattacatacggcgtggaggataacgactccgggaagatcaagaaagctattgccgaaaattctaagagaatcaaagaggaacagtgtaagaccattggagagatgatgtataaactgtacttccaaaagagccttaacgtccggaataaaaaggaatcctataaccgctgcgtgggcagaagcgagctgcgggaggaactcaagacaatctttcagatccagcaggagctgaaatctccctgggttaatgaggagctgatttacaagctcctggggaaccctgatgctcaatccaaacaggaaagagagggacttatcttctaccagcgccccctgaagggctttggggacaaaattggaaagtgtagccacatcaagaaaggcgaaaattctccttatcgggcctgcaagcatgcgccctccgccgaagagttcgtggctctcaccaaaagcattaactttctgaagaatcttacgaacagacacggcctgtgtttctctcaggaagatatgtgcgtctacctcgggaaaatcctgcaagaggcccagaagaatgaaaagggactgacctattccaaactcaagctgcttctggacctccctagcgattttgagttcctgggccttgactactccgggaaaaacccggagaaggctgtgtttctgtctctccccagcacattcaaactgaacaagatcacccaggaccgcaagacacaagataaaattgccaatatcctgggagccaacaaggactgggaagctattctcaaagagctggaatcccttcagctgagcaaggagcagatccagaccattaaagatgcgaagctcaatttctctaaacatatcaacctgtccctggaggccctttatcacctcctgcctctgatgcgggaaggcaagagatacgacgagggggtggaaatcctccaagagcgcggaatttttagcaagccccagcctaaaaatcggcagctgcttcccccgctgtctgaactcgctaaggaggagagctatttcgatatccctaaccccgtcctgagacgcgccctgtccgaatttcggaaagttgtgaatgcccttctcgagaagtacggcggcttccactactttcatattgaactgacgagagacgtgtgtaaagctaagtctgcccgcatgcagctggagaagatcaacaaaaagaataaaagcgaaaacgatgcggcttcccaactcctggaggtccttgggctgcctaatacatataacaatcggctcaagtgcaaactgtggaagcagcaggaggaatactgtctgtatagcggagagaagattaccatcgaccaccttaaagatcagagagccctccaaattgaccatgccttccccctgtctcggtccctggatgacagccagtctaacaaggtgctctgcctgacatccagcaatcaggaaaaatccaacaagaccccctacgagtggcttggctctgacgagaaaaagtgggatatgtatgttgggcgcgtgtacagctccaacttttctcctagcaagaaaagaaagctgacccagaaaaatttcaaggagcggaacgaggaagactttctcgctagaaatctggtcgatacaggatatatcggccgcgtgacgaaagagtacatcaagcactccctgagcttccttccgctccccgacgggaaaaaggaacacattcggatcatttctggctccatgaccagcacaatgagatctttttggggagttcaagagaagaaccgcgatcatcatctgcaccacgcccaggacgctatcattatcgcctgtatcgagccttccatgattcagaaatacaccacatatctgaaggataaagaaacccatagactcaagagccaccaaaaagcgcagatcctgcgggagggcgaccacaaactttctctgcgctggcccatgagcaatttcaaggataaaattcaggaatccatccagaacattatccctagccatcacgtgtctcataaggtcacgggggagctccaccaagaaacagtgagaaccaaagagttttactatcaggccttcggaggcgaggaaggggtcaagaaagctctgaagttcggaaagatccgggagattaatcagggcatcgtggacaacggggccatggttcgcgtggatatttttaaatccaaggacaaaggcaagttctacgctgtccccatctatacctacgattttgccattggaaaactgccgaataaggcgatcgtgcagggcaagaaaaacgggatcattaaggactggcttgaaatggacgagaattatgagttctgctttagcctgttcaaaaacgattgcatcaagattcaaacaaaagaaatgcaggaggccgttctcgctatctacaagtccaccaattctgccaaggctacaattgaactggagcacctcagcaaatacgccctgaagaacgaagacgaggaaaagatgtttacggataccgacaaggagaaaaataagacaatgaccagagagtcctgtggaatccagggccttaaagtgttccagaaggtcaagctgtctgtgctcggggaagtgctggagcataaacctcggaaccgccaaaacattgccctgaagacaacccccaaacacgtttga

SEQ ID NO: 3760 - RNA, 3078 nt, synthetic construct
  misc_feature 1..3078: note = Cas9 variant
  source 1..3078: mol_type = other RNA
atgggcgggtacatgccccagctgatgagatatcggctcgccctggacatcggaagcacctccattggctgggctatgatccgcctttctatgcaaaacgagcctattgccatcattagaatgggggtgcggatcttcagcgatggacgcaatccgaaggacggctcctctctggcggtcacaagacgggttgctcgccagatgagacggcgcagagatcggctcctgaaacgcaagacgagacttctgaacgccctcgtgcagaaaaagtttttccccgaagacgccgatgctcggaaagccctggtggtcctgaatccttacgagctccgcaaggaagggctgtatagacagcttagcggacccgagtttggccgggctctgttccacatctcccaaagacgcggctttctctctaaccggaagaccgacaaaaaggataatgacagctccgtgctgaaaaaggccattgttgatcttagacagcagctggaagtggagaactgccagacaatcggggagtggctgttcaaacaacagcagagcggaaagtctgtccgcgcgcggctcagaggcaagacccagaaagacaaggcctacgatttttatattgaccgcgctatgatcgcccatgagttcgatacactgtgggtgtcccaagctaaatacgaccctctcctgtttaatgaagacgcccgggcgattcttagagatatcctgctctatcagcgccccctgaagcctgttaaaccggggcggtgtacccttattcccgacgaaagcagagcccctctggctctccccctgacacagcaagcccgcatctaccaggagctgaaccacctccggatcaccacgcctgctctgggagcccaggcccttaccgtggctcagagaaatacaattgcggccctgctcgagaagtctgatgtcaccttcgtgaaaatcgctaaggccctgggccttacatccaccacggaatttaacctgcaagacattaagcgggatcgcctcaaagggaatgccacagctatcattctggccagaaaccagtacttcggacggagatggcatgactttaatgcggatctgcagaacctcatcgtggacaagctggtcaatgagggcagcgaaaccgctcttatcgagtggctgaaagccaacacagatgttgacgaatctgccgctgagcgcgtgtccggcgtgaccctccccgaggggtatggaagcctgtccgtcgccgctctgcggagacttctcccggccctgaaggaagatgtggttgtgtactctgaggcggtcaaacgcgccggcttcgacagccactccgctctgagcctcattgaacagaccggggagctgtatcaagaacttccttactatggagaggtgctgcagagacatgttggcttcgggtctggagaccccaacgattcccctgagcggcgctttggcaagatcgccaatcccacagtgcacattggcctcaacgaactgagaaagatcattaatgctctgatcaaacggtacgggaaccccgccgaggtcgtggtcgaacttgcgcgcgacctcaagctgagcagagagaaacggaaggaaatccaggaggagcagaaacaacgccaggatagaaatgaaaagcggattaaggacgcctgcgagatcctgggaattgatcctctcgtgatcgaccgcggcaaaagacgggaaatttctcagaagatgcagctgtgggatgagcttaacccgaaagacgctgccaatagacgctgtccctatacgggggatcaaatcagcattgagaagctgctctccgctgaagttgagatcgaacacatcctgcctttctctaaaaccctggacgatagccttaacaataagacagtggccatgcggagagccaaccgcgacaagggaaatcggaccccctacgaggcttttggcgaatccctcaaccctgattacgactatgacgcgattctgcagagagccagcctgatgccccgcgagaaacggaagagattcgcttctgatgggtaccagcaatggctccgcgacgataaagactttctgtcccgggcccttaatgatacagcctatctgagcagaatcgctaaggagtacctcaccctgatttgcccgcctaactctgtccgggccatccccggccgcatgacggcgcagctgagagctatgttcggacttaatcggctcctgtccgaaggcgggattaaaaaccgcgaggaccatagacaccatgccatcgatgccgctgtgatcggagttacagaccagggcctgctccagaagtttagccgggcctccgcgagaacccgcgaactgcaactttctcggctggtggatgacatgcctctcccctgggatacctatagagagcacgtcacacgcgctctggaacacctggtggtgagccataaacctgaccacgggtaccagggaaagatgcatgaggataccgcctggggccttcgggacaacgggcaggttacaagacgcgtccggtccgaggacggcggacccagacagcgcctgctcgaaaataagaacgtggtgaaaattaattctacgagagatttcagccggcacggcatcgacgagcaagggcaggtcaacgcctataagggatacgtgggcgggtccaattactgtattgaaatctggattgatgagaaaggaaagtggaacagcgacgttgtgtctacctttcaggcttatcagatcgtccgcgaactgggcgagaaagccgcttggcaaaagctcagaaatccgctgctttccctgagcgccaagcctctcgtgatgcggctgatcattgatgacgttgtgaaaatgcagatcgcggggcagaacaagattatgcgcgtcgtgaaaatcgcccaaaatggccagattttctttgctgagcataacgaagccaatgttgatgctagagacaaggataaaaacaatcccttcaagtacatctctaagacagccggatccctgcagaaagccggcgggatccacatggctattagccccatcggagacgcgcggcctgtgagatatggccgctga

SEQ ID NO: 3761 - RNA, 3084 nt, synthetic construct
  misc_feature 1..3084: note = Cas9 variant
  source 1..3084: mol_type = other RNA
atgaagtacaccctgggcctcgacgtggggacaaacagcatcggatgggccgtcctggagcttaatacgaacggcgaaccccagagaattgagaaactggggtcccggatcttcaccgatggacgccaccctaaggacggcacaaccctcgcttctaaaagacggcaaaagcgccatgaaagacggcgcagagatcggctgcaccagcgcaaaaagctggttcttaatcagctcgtgagcatggggctgtttccgcagtccgagcaagaacagcaggacctgaagtctctcgatgtgctgacacttagagccaacggagtcagcaaacagctgtccgcgtatgagctcggccgggtgttctactatctgaatcttaagcgcggctttaaatctaacagaaaagggggaagcgaggaagacaaagctaataagatttccgagcggatcaagaaactgcaagaacagctcaaggagaacgatttcaaaaccgttggccagtacctgcatgaccgctatattaaggggctgagcacaaaagccaccatcgagaatgattttcacctcctgagacagcttatcgaagacgagttcgattttattgtggaaacgcaatctaagttctttcccgagatctccgacgaacagtggaacaccctgcggaatagaatgttccatcagcgccctctcaaacccgtcgagacaggaacctgcagcctgtttgaggataagaagcggacatacaaatatatgccttctttcgaagagtacagatttcttaccgaactgttcaacctctcctaccaagacgagaatttccacagccactctctgtccagcgaacagatttttaaggtgttccatgagctgaaaaacacgcgcgaggccacatataccaagatcaaaaagctcctgaaacttccctccgacctgtcttttagcattgaacggtccaagagcaaggataaaatcaagatttctacaaccaatcacttcttttccaaaagcctcctgttcgctgaggaatgggcctctcttgacctgaagctcaaggatgaggttgctgaaatctactttagcgacatgtccgtggaggagatcaaaaagggcctgctgcagctcaaaattgattctgaaatcattgagaacctgcttgaagagaaggtccctaacgtgcaggaggccacctgtagctattccaaagaagcgctgcaaaagatcgtgagcctcattctggaggaagagagacatccgacactgatcgtcgacgatcttttcaagaatgaaaaagaggagacgtctctcatcgaccgcctggattactatggggcctccattcccgacagcatgcagcctatcccccagcacattaaggataacaatctgaccctcaacgaagacgagaaacggtacggaaagatcgctaatcctacagttcacgccgctctgaaccagattagacaagtggtgaatgaccttatcgaacagtatggcaaacccaccaacatccatattgagtttgcccgcgatctgaagaaatctaaggaggaacgggacttcgataatagaaagaaaaagaaaaacgaggaactcaatgagcaggtccgcgactttatcgaaaagcacaaccagaaaccgtccgcgttcaattttgagcgggtgaagctgtggttcgaactggatgccatgaacaatcaagtttgcgcttacagcggcaagacaatttccgccagaatggtgctttctgacgaggtccaggtggatcatatcctccctttcagccggaccctggacgattccctggctaacaaagttctcgtgctggcctctgagaacgtcaagaaacgcaatagaacgccctacgaagcctttgggcaggacacagagaagtgggctagcattcaggaacttgcgaaacggctgccttatcacaagcaatggagattcgccgaggatgctatcaagaaatttgaggaaaaggaccagttcctccagcgccatctgaacgatacccggtacatttccaaaatcgccaagaaatatctgggaagcatcaccgacccctacaagattgtggcctctagaggccaaatgacatccatcattcgcgggaaacttggactcaatcagtttatccagaagcccgacggcaccaagaacagagaggatcaccggcaccatgctattgacgccctgacagtcgcgctgacgagccgctcttatctcaaaagaatctccgatgctagcgcccggaatcaggaccctaaccgcatcccgattcccgaaccttggaaggggttcatcaaagatgccgacgtgaagtttaatgagattatcgtttctcacaaagtggatcatggaaagaacggccccttcatggaagagacctgttttggcctgattaagaatcctaacaaatacgaggaagagaatgacttcaaacttatcacaaccaagagcctggattccgtcaaggaccccagcacaatcagatctcaatccctccagaacctggctgaaaagagcggggtgatttccctggccaagtctggagttaagaaacttcgggtgtatgatgtcaccaaggagaatccggctgacatcggcctcattgaaagcgggctggccaaaatcacgcacggaaaggataaacagcacgtgaagcattaccagaagggcgacattaactacctggcgatctggtgcctccctcaaaatatcaccctgaaatccgacaaccacaagaaacgcaagacagattatatttttaccgccatcaaaacattcgaccttaactctaagaatcccaacgatctgagacctcatcccgctgccaagctcgtgaccaaagtttacaagggggacacggtcgctctggaggtgaataaccagctgaattattacattgtgaaaagcatccgggccgcgaacaagaaactttattttctgaagattaatcagtcctctgagctcgccaacgaaacacagttcatccctgcttacaccaagctggtcgattataaattccgcaaggtgagcgtttcccccacaggcgtgattaccgacaatggaccgctcctgaaatga

SEQ ID NO: 3762 - RNA, 3090 nt, synthetic construct
  misc_feature 1..3090: note = Cas9 variant
  source 1..3090: mol_type = other RNA
atgagaagcctgcggtaccgcctcgccctggaccttggctccacctctctggggtgggctctcttcagactggatgcctgcaaccggcccacagcggtgatcaaggctggagtccgcatttttagcgacggcagaaatcctaaagatgggtcctctcttgccgttacgcggcgcgccgctagagccatgcggcgcagacgggaccgcctgctcaagagaaaaacccggatgcaggctaagctggtggagcacggattctttccggccgatgcgggcaaacgcaaggccctggaacaactcaacccctatgctctgagagccaaggggcttcaggaggctctgctccctggagagttcgcccgggcgctgtttcatatcaatcagagacgcggcttcaaaagcaaccggaagacagacaaaaaggataatgactccggcgtgcttaaaaaggccattgggcagctgagacaacagatggctgaacagggatctcgcaccgtcggcgaatacctctggacacggctgcagcaagggcagggagtgagagcccgctatcgggagaagccctacaccacagaggaaggcaaaaagagaatcgataaaagctatgacctgtacattgatcgcgctatgatcgagcaggaatttgacgccctctgggccgctcaggcggccttcaaccctaccctgtttcacgaggctgcccgggccgatcttaaggacacgctgctccatcaaagacccctgcgccctgttaaaccggggcggtgtacccttctgcccgaggaagagagagctcctctcgccctgccctccacacagcggttccgcatccaccaggaagtgaatcatctgagactcctggacgagaaccttcgggaagtcgcgctgaccctcgctcaaagagatgccgtggttacagccctggagaccaaggctaaacttagctttgagcagattcgcaagctgctcaagctgtctggatccgtgcagttcaatctggaagacgccaaacggacggagctcaagggcaacgctacaagcgccgcgctggccagaaaagaactttttggcgctgcctggtctgggttcgatgaggctctgcaggacgaaatcgtctggcaactcgtgaccgaggagggagaaggcgccctgattgcgtggctgcagacacacaccggggtggatgaggcccgcgctcaggccatcgtcgacgtttcccttcctgaaggatatggcaatctcagcagaaaggctctggcccggattgtgcccgccctgcgcgctgcggtgatcacctacgataaagccgtccaggctgccgggttcgaccaccattctcaactcggatttgagtacgatgcctccgaagtggaggacctggttcacccggagacaggcgaaattagaagcgtgttcaagcagcttccttattacggcaaggctctgcagcggcatgtcgcctttgggtccggaaaacccgaggatcctgacgaaaagcgctatggcaaaatcgcgaaccccacggtgcacatcgggctcaatcaggttagaatggtggtcaacgctctgattcggcgctacggaagacccaccgaggtggtcatcgagctggcccgggaccttaagcaatctcgcgaacagaaagtggaggcccagagacggcaggctgataatcaaagacgcaacgcccggattagacgcagcatcgcggaagttctcggcattggggaggaacgggtgagaggctccgacatccagaagtggatctgctgggaggagctgagcttcgatgctgccgaccgccggtgtccttattctggagtccagatttccgccgctatgctgctcagcgatgaagtggaggttgaacacatcctgccgttttctaagacacttgacgatagcctgaacaatagaaccgtggccatgcgccaagctaaccggattaaaagaaatcggacaccctgggacgcccgcgcggagttcgaagcccagggctggtcctacgaggatatcctccagagagctgagcggatgcctctgcgcaagagatatcggtttgcccccgacgggtacgaaagatggctgggagatgacaaagatttccttgctcgcgccctcaacgacacccggtacctgtctagagtcgccgctgagtatctgcgcctcgtgtgccctggcacgcgggtgattcccgggcagctgacagcgcttctgagaggaaagtttggcctcaatgacgttctggggctggatggcgagaaaaaccgcaatgaccatcggcaccatgccgtcgatgcttgtgtgatcggagtgaccgaccaaggccttatgcagagattcgccaccgccagcgctcaggcccgcggggatggactcacaagactggtcgacggcatgccgatgccttggcccacctaccgggatcacgtggaacgcgcggttagacatatctgggtgtcccaccggcctgaccacgggtttgaaggagctatgatggaggagacaagctatggcattcgcaaggatgggtctatcaagcagagacggaaagccgacggctccgccggaagagaaattagcaacctgatccgcattcatgaggctacgcaacccctccggcacggcgtctctgccgatgggcagcctctggcgtacaagggatatgtgggcgggtccaattactgcatcgaaattaccgttaacgacaaaggaaagtgggagggcgaggtgatcagcacattcagagcttatggggtcgtgcgcgccggcggaatgggccggcttagaaatccccatgaagggcagaacggacggaaactgatcatgcgcctcgttattggcgattccgtgagactggaggtcgacggggccgaacggaccatgcgcatcgtgaagatttctggaagcaatggccagatctttatggctccgattcacgaggccaacgtggacgctagaaatacagataaacaagacgccttcacctacacgtccaagtacgcgggctctctgcagaaggccaaaacccggcgcgtcacaatcagccctatcggggaagttagagatcccggattcaagggctga

SEQ ID NO: 3763 - RNA, 3090 nt, synthetic construct
  misc_feature 1..3090: note = Cas9 variant
  source 1..3090: mol_type = other RNA
atgaagtacagactggccctcgacctgggcagcacctcccttgggtgggctatcgtgcagctgaacgccaaagatgagccctgcgcgattgtccgggctggagttcgcatcttccctgacggcagaaatccgaaggatgggtctagcctcgccgtgacacggcgcaacgccagagctatgcggcgcagacgggaccgcctgcttaaaagaaaggcccggatgcaacgcctgctcattgaacacgatctgtttcccgctgacgaggccgcgagaaaagccctggaaacgctcaatccttatgagctgcgggctaagggacttgatgccgctctgacccccgccgagttcgcgcgcgccctctttcatctgaaccagagacggggcttcaagtccaatagacgcacagaccggaaagataacgactctggggctcttaaggccgctatcggaggcctgagagcccagctcgataccgccggcgctgacgggcgcgcgcggacagtgggagaactgctgtggagacgcatgagcgatcctaatgtcctcaccgtgcgggccagataccgcgagcagcggattacaaaagacgacggcaagaccagagttgataaatcctatgacctgtacgtggatcgcgctatggtcgaagccgagtttgacgccctttgggctaagcaagccgaactgtctcccacgcagttcggggaggcggctcgggccaccctcaaggattgtctgcttcaccagagaaacctgcggcctgtgcgcccgggaagatgcacactcgagcccgacgaacctcgggctcccctggctctgcctagccagcaaagatttcgcatcctccaggaggttaatcatctgcggcttctgggcgggagactcctggaagagtcccttagcgtggaacagcgcgataaactggtcgccgctctcgaggacggatctaagtccttcaaaaccgccatccccaagctgctgggcctcccgggcacagtgcagtttaacctggcggatgccaaaagaaccgagcttaaggggaatgctacgagcatgctgctcggcaaaaaggacttctttggacctgcctggcacgggttctctgaagctcggcaagatgagattgtgatgcgcatccaggaagaggaatccgaggccagactggtcgactggctggcgacaagcaccggagttgacgaggcccatgctcttaagattgccaacgctgccctccccgaaggctatgggtctctgtccgccaaagctctggcgaagatcctccctgccatgcgggctgaggtgattacatacgataaagccgtgctggccgctggatatgaccaccacagccatatctcccacgccgcgtctaccggcgaaattcttcccgagctgccctactacggcgaatatctccagcgccatgtcgggtttggaaccggcgagctgaatgatacacctgagaagagattcgggcggatcgctaacccgacggtgcacatcggactgaatcaagttcgcgtggtcgtgaacgcccttattaaaagatacggccaccccaccgaagttatcgtggaggtcgcccgggacctcaagcagagccaggatcagcgcagagaaacacaagagcagcaggctaagaaccagaaacggaatgagagactgcgcaaggacgccgcggctattctggggatcgccgatgaacgggtgagactcgccgacattcaaaaactgatcctttgggaggaactgtccttcgatatcgctgaccgccggtgtccttatagcggcgtccagctctctgccgctatggtgctgtccgagcaggttgaaattgagcatatcctgccctttagcatgacccttgatgactctctcaacaataagacagtggccatgagactggtcaaccgcctgaaaggaaatcggaccccttgggatgcgagagaggccttcgctggccaggggtgggactacgacggcattctcatgcgcgccgaacggatgcccagagctaagcggcaacgctttgccccggatggactggagaagtggcttaaagaagacaaggatttcctggccagagctctcaacgacacgcggcacctgagccgcgtggcgagagagtatctgtcccttgtttgccctgcctctacacgggtgatccccgggcagatgaccgctatgctcagagccaaatttggactgaatgatattctgggcctcaacggggaaaagaatcgcaacgaccatcggcaccatgccgtcgatgcttgtgtggtggccgttaccgaccagggcctgcttcagagattcgcgcaagctagcgccgatgcccgcggaaaaggcctggaccggctcgtcgagacaatgcctgatccctgggactcctacagagagcacgtgcagcgcgctgtgaatagcatctgggtctctcacaagcctgatcatgggtttgaaggagccatgcacgaggacaccacatatcggcccccgcatctggaccctaagaacatgtggagaacgcgcggcatcgggggaggcaaacccaatgaaaaggaggcggattccaaagctatggtggggttcaccggccccgaacatctgcagagacaccaccgggacaaggccggacaacagcttccttacaaaggctacgttgccagcccgaagttttgcatggatattgtgcgcaacgacaaagggagatgggagggagaggtcgtgtctacattcgaagcctatcggctggtttccgagtttggccgcgatgccgctctcgcccacatccagagcaagtccagatctattagcgggaagcccctggtgatgcggctccagggaggcgacatggtcagattcgatgacgatgaagggcgccctgtggttctgcgggtggtcaatatgaccggcaacggacaaatctttttcgcgccccataacgaggccaatggcgacgctagaaaccgcgataaacaggaccagttcgtgtacctttccaagtatgccgggtctctgcagaaagctcggggaagacgggtgacagtcagccctgccggcgagctccgcgaccccgggtttaaggaatga

SEQ ID NO: 3764 - RNA, 3090 nt, synthetic construct
  misc_feature 1..3090: note = Cas9 variant
  source 1..3090: mol_type = other RNA
atgagaagcctgcggtaccgcctcgccctggaccttggctccacctctctggggtgggctctcttcagactggatgcctgcaaccggcccacagcggtgatcaaggctggagtccgcatttttagcgacggcagaaatcctaaagatgggtcctctcttgccgttacgcggcgcgccgctagagccatgcggcgcagacgggaccgcctgctcaagagaaaaacccggatgcaggctaagctggtggagcacggattctttccggccgatgcgggcaaacgcaaggccctggaacaactcaacccctatgctctgagagccaaggggcttcaggaggctctgctccctggagagttcgcccgggcgctgtttcatatcaatcagagacgcggcttcaaaagcaaccggaagacagacaaaaaggataatgactccggcgcccttaaaaaggctattgggcagctgagacaacagatggccgaacagggatctcgcaccgtgggcgaatacctctggacacggctgcagcaagggcagggagtcagagctcgctatcgggagaagccctacaccacagaggaaggcaaaaagagaatcgataaaagctatgacctgtacattgatcgcgccatgatcgagcaggaatttgacgccctctgggctgcgcaggccgctttcaaccctaccctgtttcacgaggccgcccgggctgatcttaaggacacgctgctccatcaaagacccctgcgccctgtgaaaccggggcggtgtacccttctgcccgaggaagagagagcccctctcgcgctgccctccacacagcggttccgcatccaccaggaagttaatcatctgagactcctggacgagaaccttcgggaagtggctctgaccctcgcccaaagagatgccgtcgtgacagctctggagaccaaggccaaacttagctttgagcagattcgcaagctgctcaagctgtctggatccgttcagttcaatctggaagacgctaaacggacggagctcaagggcaacgccacaagcgcggccctggctagaaaagaactttttggcgccgcttggtctgggttcgatgaggccctgcaggacgaaatcgtgtggcaactcgtcaccgaggagggagaaggcgcgctgattgcctggctgcagacacacaccggggtggatgaggctcgcgcccaggctatcgtggacgtctcccttcctgaaggatatggcaatctcagcagaaaggccctggcccggattgttcccgctctgcgcgcggccgtgatcacctacgataaagctgtgcaggccgccgggttcgaccaccattctcaactcggatttgagtacgatgcttccgaagtcgaggacctggtgcacccggagacaggcgaaattagaagcgttttcaagcagcttccttattacggcaaggccctgcagcggcatgtggcgtttgggtccggaaaacccgaggatcctgacgaaaagcgctatggcaaaatcgctaaccccacggtccacatcgggctcaatcaggtgagaatggttgtgaacgccctgattcggcgctacggaagacccaccgaggtcgtgatcgagctggcccgggaccttaagcaatctcgcgaacagaaagtcgaggctcagagacggcaggccgataatcaaagacgcaacgcgcggattagacgcagcatcgctgaagtgctcggcattggggaggaacgggttagaggctccgacatccagaagtggatctgctgggaggagctgagcttcgatgccgccgaccgccggtgtccttattctggagtgcagatttccgctgccatgctgctcagcgatgaagtcgaggtggaacacatcctgccgttttctaagacacttgacgatagcctgaacaatagaaccgttgctatgcgccaagccaaccggattaaaagaaatcggacaccctgggacgcgcgcgccgagttcgaagctcagggctggtcctacgaggatatcctccagagagccgagcggatgcctctgcgcaagagatatcggtttgctcccgacgggtacgaaagatggctgggagatgacaaagatttccttgcccgcgccctcaacgacacccggtacctgtctagagtggctgcggagtatctgcgcctcgtctgccctggcacgcgggtgattcccgggcagctgacagcccttctgagaggaaagtttggcctcaatgacgtgctggggctggatggcgagaaaaaccgcaatgaccatcggcaccatgctgttgatgcctgtgtcatcggagtgaccgaccaaggccttatgcagagattcgccaccgctagcgcccaggcgcgcggggatggactcacaagactggtggacggcatgccgatgccttggcccacctaccgggatcacgtcgaacgcgctgtgagacatatctgggtttcccaccggcctgaccacgggtttgaaggagccatgatggaggagacaagctatggcattcgcaaggatgggtctatcaagcagagacggaaagccgacggctccgctggaagagaaattagcaacctgatccgcattcatgaggccacgcaacccctccggcacggcgtgtctgcggatgggcagcctctggcttacaagggatatgtcggcgggtccaattactgcatcgaaattaccgtgaacgacaaaggaaagtgggagggcgaggttatcagcacattcagagcctatgggatcgtgcgcgccggcggaatgggccggcttagaaatccccatgaagggcagaacggacggaaactgattatgcgcctcgtcatcggcgattccgtgagactggaggttgacggggctgaacggaccatgcgcattgtgaagatctctggaagcaatggccagatttttatggccccgatccacgaggctaacgtcgacgccagaaatacagataaacaagacgcgttcacctacacgtccaagtacgccggctctctgcagaaggctaaaacccggcgcgtgacaatcagccctattggggaagtgagagatcccggattcaagggctga

SEQ ID NO: 3765 - RNA, 3096 nt, synthetic construct
  misc_feature 1..3096: note = Cas9 variant
  source 1..3096: mol_type = other RNA
atgcccgccatctacagactggctctcgacctgggcagcacctcccttgggtgggccgtgctgcggctcgagcctgcggctctggaaccgattgccatcattaaggccggagtccgcatcttctctgatggcagaaaccccaaagacggggctagccttgccgttacacggcgcgctgccagagcgatgcggcgcagacgggatcgcctgctcaagagaaaagcccggatgcaggacaagctggtgaaacacggatttttcccttccgatatggacgagcgcaaggctctggaaagactcgatccctatgccctgcgggctaagggccttcgcgaggccctgacgcctggggaatttgcgagagccctcttccatattaatcaacggagaggatttaaatctaaccgcaagaccgacaaaaaggataatgacagcggcgctctgaaaaaggccatctcccaccttcggcagcagatggaggctggcgggcatagaacagtgggagatcacctgtggtctcgcctccagcaaggcctgggggtccgggccagataccgcgagacccccttcacaaacgacgaaggaaagaaacggatcgataagagctatgacctgtacattgacagagccatgatcgagcaggaatttgatgctctctgggcggcccaggctgccttcaatcctgccctgtttcatgaggtggctcgcgccgaccttaaagataccctgctccaccagcggagactgcgcccggttaagcccggccggtgcacacttctgcctgaggaagagagagcgcccctcgctctgccttccacccaacggttccgcatttatcaggaagtgaaccacctgagactcctgggggaggaccttcgggaagtcgccctgacgctcgcccagagagatgctgtggccaatgctctggagagcaaagcccgccttacctttgagcagatccggaagctgctcaaactgtctggatccgttcaattcaacctggaagacgcgaagagaacagagctcaagggcaatgccaccagcgctgccctggctcgcaaagaactttttggcgccgcgtggggagggttcggcgaggccctgcaggatgaaattgtgtggcagctcgtcacagaggagggggaaggagctctgatcgcctggctgcaagctcataccggcgtggacgaggccagagcccaggctattgcggatgcctctcttcccgaagggtacggatccctcagccggaaggctctggcccgcatcgtgccggccctgagagctggcgtcgttacgtatgacaaagccgtgcaggcggctggcttcgatcaccattctcagctcgggtttgagtacgacgccggagaagtggaggactgggtccaccctgatacaggcgagatccggcccgtgttcaagcaactgccttactatgggaaaccccttcagcgccacgttgcctttggatccggcaagcccgaagaccctgatgagagacggtacgggaagattgctaacccgaccgtgcatatcggcctgaatcaggtccgcacagtggttaacgccctcattagacggtatggacgccccaccgaagtggtcatcgagctggcgagagacctgaaacagagccgggagcaaaaggtggaagctcagagaaaacaggccgagaatcagcgccggaacgcccgcattagaaagtccatcgctgaagtccttggcatcggggaggaacaagtgcggggagccgatattcagaaatggatctgttgggaggagctctctttcgacgttgctgaaagacgctgcccttacagcggcgtgcagatttccgcccggatgctgctgagcgatgaggtcgaagtggagcacatcctccccttttctaagaccctggacgattcccttaataacagaacagttgcgatgcgccaggccaaccggattaagagaaatcggacgccttggaccgctcgcgacgatttcgaagcccaagggtggagctatgagggaatcctgcagagagctgagcggatgcccctccgcaaaagataccggtttgccccggacggctatgaaagatggctgggggatgacaaggacttcctggcccgcgctcttaacgatacacggtacctctctagagtggcggccgagtacctgcgcctggtctgtcctggcagcggaacccgggtgatccccggccagatgacagctagactccgcgggaaatttggactgaatggcgtgcttgggcctgacggagaaaagaaccggaatgatcatagacaccatgccgttgacgcctgcgtcattggcgtgaccgatcaagggctgatgcagcgcttcgctaacgcctccgcgcaggctagagaggacggcctcacgcggctggtggatgacatgccccgcccttggcccacatatagagcccacgtcgaacgggccgtgcgccacatctgggtttctcatagaccggatcacggatttgagggcgctatgatggaggaaaccagctacgggattggaaaagacggctccatcaagcagcggagaaaggccgatgggagccctggacgcgagattaccaatctgatccggattcatgaagcgacacaaccccagagacacggcgctgggcccgacggccagcctcttccgtataaaggatacgtgggcgggtctaactattgtatcgagatcacccgcaatgataagggaaaatgggagggcgaagtcatttccacattccgggcctacgggatcgtgagaacgagcggactcggccagctgcggcacccccgcgttggccaaaacgggagagagctggtgatgcggctcgtcattggagactctgtgcgcctggaaatcgacggcattgagagaaccatgcggatcgttaagatctccgggagcaatggacagatttttatggcccctatccatgaagctaacgtggatgcccgcaattccgacaaacaggatgctttcgcctatacatctaagtacgcgggcagccttcagaaaaccaaggccagattcgtcacaatttcccccatcggggaggtgcgggacctgggatttaagggctga

SEQ ID NO: 3766 - RNA, 3099 nt, synthetic construct
  misc_feature 1..3099: note = Cas9 variant
  source 1..3099: mol_type = other RNA
atgaagaaaagaatcctgggcctcgacattgggatcgccagcgtgggatgggctctggtcgagttcgatgacgaatttcaggataacaagaaaaagggcaccattatcaaatccggggttcggattttcacacgcgccgagacgcccaaggaaagagagtctcttgcgaagcctcggcgcgaagctagaagccaacggcgcagaatccggcgcagagtggagcggctgaatagcatccgcgagctctttgtgaaaaacggagtcgtggaagagtggtctgttagcaagaaaaatccgaacaatatttacatcaccctgaaccagattaagacaccctggcagcttagaatggaatccctggaccggaaactcaccaatgagcagttcgccgtggtcctgacacacctggccaagcatcgcggctataagtctctcagaaaagatgacaaggctgggaaagtgctggaggccatcagccaaaacaagaaacggcttaatgattccgactacagaaccctgggagaaatgttttgcaagaacgagagctataaagaacacaagcgcaataagggcggcgagtacattaactctgttgctcgggaactcatcgaggaggaagtggagaaaattttcgtcaagcagagagaaaaagggaataactttgccgatgtgaatacagagcgcgaatatctgaagatcgcgttctcccagaaacctgccggaagcatctctaagatggtgggcttttgtaccttcgagaacggggagaagcgggctcccagagactcctacagcgccgaactttttaaagtcctgtgcacgattaacaataccacattcaccgatatgaagacaggagagatccgctctttttccaaagaagagattggcaagaccctcgaaacggttaaaaacgtgaaggacgtgaagtatgctaaaatccggaaggatctggggctggaggacagcgtcaaattctccggagtggactacagagagaatgccaagtctaaaggcgaaggcgagattttcgttagcatgaagacataccatgaaatcaagtccaaaatcgagaagctcagcaaagagaagtgggataacctgaaagggaataccgaacttctggactctattgtgaacatcattgcgaatctcaaggatgacgagtccatcaaaaaggaatttcagaagctgaaaattgatgaggacatcatcgatgtccttctgaacttcgaatttaagaaattcattaatctcagctttaaggccctgcgcaaaatcattcctttccaatttcagggacagaagtatatcacagcttctaccagcgccggctactccctgaagcaggaggggattaaaaacaagctcgtgccccctgctaaagagaatatcaacgttgccgtggtcgcccgggctttcgcgcaaaccagaaaggtgattaatgccgtcatccgcaaatatggacagtttgaccagatcaacattgaactggctacagagcttaaaaattctaagttcgatcggagcaagatcgaagagggccaaaagaaatttcagtcccagaaggacaaaattttcaaggaagtgcaggagctgagagggggaatgacgccgtcctcttccctcctgcttaagtaccggctgtggcgcgagcaagatgaaagatgtgtttatagcggccggaaaatctcttttgaggacctcctggacaccggcttcctggatattgaccacatcatcccctactccaagagcatggatgactccttcaacaacaaagtgctctgcctggccgaagagaatagaaacaagaaaaatgatattccttttaactattaccagcgcatcgaccgggattggaatcttctgatttctatcattacaagcatgaagaacatgaaaatcgccaagaagtccagactcctgaaacaggaactgtctgacatcgaggggttcattgagcgcaatatcaacgataccagatacgctacacggtatattaaggactttcttgaaaataacctcgagttcaaagaaaatgagtttatcaaggtcaaagtgcaggcccgcagcggaggcctgacctccgttctgagctacaactgggggatgtctaaggatagagaggaatcctatttccatcacgcgaaggacgctattatcgtggcctgtagcacgcaaggaatggtccagtacatctctaaaatttcccagcagtatgagaatgataaggacaaaatgaagaaaatcaaggacaagacagaaaactgcattcccaaaccttgggatagctttcgggccgacgtggaggaatctatcgagggcattttcgtgagctttgctccccgccacaaggttaccgggtccgcccataaagagaccatctacagcaagaaacacctcgaaaaggagagatatgtcacagtgaagaaatctctggataagattaaactttccgacctggaaaatatcccgtgtaacgagaactgcggcatcattcgggtgctcaaggaacgcctggagaaattcaagaatgatagcctgaaggcttttgccgaccctgtccatatgcccaccaaatgtcctaacaagaaaggacccgtgatcagatccgttaagattaaagagtctaataagacaggcatcgaagtgcggaaagggcttgcggagcgcggagaaatggtcagagtggatgttttcattaaggacaagaaatactacctcgtgcccatctatgtcagcgattttaagaacaaagacctgcctaataaggccatcgctgccctgaaactcgagaacgaatggattatgatcgataagacgtactccttcaagttctctctgtttaaagacgatcttattaagatcaaaaagaaaaaggaggagattttcggctattttgggggagtgcaccggagcaccggcacaatcaagatcaaatccagacacaagccgaaagaaattgacgaggggatcggctctcgctgcctgctcgacttccggaagtttcaagttgatgtgctgggaaattacaccgaagtcaaacatgagaagagaatgcccgcttatattacacgcaaggacaaaaagcactga

SEQ ID NO: 3767 - RNA, 3105 nt, synthetic construct
  misc_feature 1..3105: note = Cas9 variant
  source 1..3105: mol_type = other RNA
atgaagatcctgggcttcgacattgggatcgccagcattggatgggcttttgtggagaacggcgaactcagagattgcggggtccggatcttcaccaaagccgagaatcccaagacaggagactccctggcgatgcctcgcagagaagctcggtctgttcgcagacggcttgcccgcagaaaaggccggctggagacgctcaagcgcctgcttgccaaagaatgggatctgtgttacgaggactatattgctgccgatggggagctcccgaaggcttttatgggaaagaacctgaccaatccctacgtgctgagatatgaagccctccagcggctgcttggcaaagaggaactggcgcgcgtgatcctccacatcgccaagcatagaggctacgggaacaaaaatgctaagattacaaaaagcgaggagtccaagcgggaacaaggaaagatcctgtctgcccttgctaccaacgccagcgtcattgcgcgctatagaacagtgggcgagtacttctataaagaattttgcgaggttatcaagaatcctcaggggctgaacaccaatgaaaactgtacacagcccaaagtgcgggtcctcaagcctattagaaataaaggaggcgagtacaccaactgcatcctgcaggaggacctgcaacgcgaactccggtgtattttcgagcaccagaaggggtttggattccccatcacgcaggaatttcaggataaaatcctgaagattgccttctaccaaagatcccttaaggacttttctcatctggtgggcaaatgcaccttctatcctgatgagccgcgcgctcccaagtttagcctctccgccatcgagttcattacaaaagctaagaccatcaatctgcttgttggcattgtgaaagagagcggggaggtctgggacaaggaacagtggcgggagagactggattctgtgttctccgccgtgtgtgaacgcggaaacctcacatttgcccagatgcggaagatcctgaaaatcgacgagcgcattcagttcaaggaagtcgattacaccgctaaaaatcctgagaacaagaaatttgttgagttcaagaacctgaagaaattttgcgaaatcctcggcgcgattgtgggggacagagccctggctgacagcatcgcccgggatatgacgcttattaaggacgaggaagaactggcccaaaaactcagaggatatggcaagttctctcaggagcagatcacacaactgggggctcttaatttttcccaccatatcaacctgagcctcaaagccctgtctgaaattctgcccttcatgcgcgagggaatgcggtacgatgaagcgtgtcaggaggctaagctccaggccaagcacaatgacaaaaagtccaaatttctgcctcccttctgcggcagcatctatgccgatgaacttaccaacccggtggtccacagagctattgccgagtaccggaagatcctgaatgctctcattgccaaatatggcaacgtgcataagatccacattgagctgacacgcgacgttgggaaaaattttcaggaaagagagaagtacaagaaagaaatcgagtccaactacaaggcgcgggtgcaagccatgcaggaatgtgagaaactgggacttaccctctctgagggcaatatcctgaagctgagactcttcatggaacagaacgagcgctgcgtctatagcgggcggaaaattaccctggctaatcttaaggaacagggagccctggagatcgatcatattctcccttactccagaagctctgacgattcctatatgaacaaggtgctggtttttacaaatgaaaaccaaaataaaggcaacaagacgccctacgaggctttcgggggcgacagccagaaatggggagagatcgaatctctggcccttcgcagcggctatcctaagaaaaaggcgaagcggattctcgataaagggttcggagacagagaggccggctttaagtcccgcaacatcgtggactctgggtacatcgctagactgattgccaattataccaaagaatacctgaagttcctccccctggatagccacgagaacacagctcttatcgccggagagaaagactccaagattcacgtcgaagccgtgaagggcatgctgaccgctacaatgcggcatttttgggggctcggcagcaaaaatcgctacgagcacacccatcacgcgatcgatgccattatcatcgcttatattaacgccgccatgatccagagattctctcagtttcggcaaaatcaggaatccctgaaggctcgcttctacgccaaagagctggcgaaggaagagtttaaaacgcagagagctttctttgagcccttcagcggatttcgggaacaggtccttgccaaggtgggccaaattttcgtttctcgccctccgagaaaacgggccagaggggctctccatgaggaaacattttattccatcgacgataagaagctgagcgagacctacggaggcaaagaaggggtgcagcgcgccctgtccctcggaaagattcggcagatcggcaccaaaatcgtcgcgaacgggcccatggtgagagttgacattttcaagcacaaaaagtctggccgcttctatgctgtgcctatctacacaatggattttgccctgggcattcttcccaataaggccgtcgtgagcggaaaagacaacgatcggatcattaaggactggctggagatggattccaattatgagttctgcttttctctcttcaaagacgatgtgatcgaagttcaaaagaaagacatggagaagcctgaactggcttactttgtcagcctgaacacctccagcgcctctattgctcttgtgaagcacgacaataaattcgagacactcacgtccaaccaggccaagctgtttagcaatgcgaaagaaaacaatgtgatcgccgagtctctggggatccagaacctcaaggtcttcaaaaagtacaaggtgagccccctgggagagattaaagaagctaagtatgagccgagacagcctatcgcccttaaaacctcccccaagaaacatcgcaagcaaaacaatgctcagtga

SEQ ID NO: 3768 - RNA, 3108 nt, synthetic construct
  misc_feature 1..3108: note = Cas9 variant
  source 1..3108: mol_type = other RNA
atgagacggctgggcctcgacctggggaccaacagcatcggatggtgccttctggatctcggcgacgatggggagcccgtgtccattttccgcacaggagccagaatcttttctgacggccgggatcctaagagcctggggtcccttaaagctacgcgcagagaagcccggctgacccgcagacggcgcgacagattcattcagcggcaaaagaatctcatcaacgcgctggtcaaatacggactgatgccggctgatgagattcagcgccaggccctcgcctataaggacccctaccctatccggaaaaaggctctggatgaagccatcgacccctatgagatgggcagagctatttttcacatcaatcagcgcagaggcttcaagtctaaccggaaaagcgccgataatgaagcgggggttgtgaagcaatccattgccgaccttgagatgaaactgggagaggctggcgccagaacaatcggggaatttctcgctgatcgccaggccaccaacgacacagtgcgggcgagacgcctgtctggaaccaatgccctttacgagttctatcctgaccggtacatgctggaacaggagtttgatacactctgggctaagcaggccgctttcaaccccagcctgtatattgaggccgccagagaacgcctgaaagagatcgtctttttccaacggaagctcaagcctcaggaagtgggcagatgtatttttctgtccgacgaggatcgcatcagcaaagcgcttccgtctttccagcggtttagaatctaccaggaactgtccaatctcgcttggattgaccatgatggggttgcccaccgcatcaccgctagcctggcccttcgggaccatctgttcgatgagctcgagcacaagaaaaagctgacgttcaaagccatgagagctattctgcggaagcaaggagtggtcgactaccccgtgggctttaacctcgaatctgataatcgcgaccatctgatcggcaaccttacctcctgcattatgagagatgccaaaaagatgatcgggagcgcgtgggaccggctggacgaggaggaacaggattctttcatcctcatgctgcaggacgatcaaaagggagacgatgaagttagatccattcttacacagcagtatggcctgagcgacgatgtggctgaggactgtctcgatgtccgcctgcctgacgggcacggatccctgtctaaaaaggccatcgatcggattctccccgtgctgagagaccagggccttatctactatgatgccgtgaaagaggctgggctgggagaagccaatctctacgacccttatgctgccctgagcgacaagctggattactatggcaaagcgcttgccggccacgtcatgggggcttccggaaagtttgaggacagcgatgaaaagcgctacggcaccatttctaaccccacagttcatatcgccctcaatcaagtgagagctgtggtcaacgagctgatccggctgcacgggaaaccggacgaagtggttattgagatcggacgcgatctccctatgggcgccgacgggaagagagagctggaacggttccagaaagagggccgcgcgaagaacgaaagagcccgggatgagcttaaaaagctgggacatattgactcccgcgagagcagacagaagtttcagctctgggaacaactggctaaagagcccgtggatcggtgctgtcctttcaccggcaagatgatgtctatcagcgacctgttttccgataaagtcgaaattgagcaccttctccccttctctctgacgctggacgatagcatggccaataagacagtgtgctttcgccaggctaacagagacaaagggaatcgggcccccttcgacgcctttggaaactcccctgctggctacgattggcaggaaatcctcgggagaagccagaatctgccgtatgcgaagcgctggcggttccttcccgacgccatgaagagatttgaggctgatggaggcttcctggagcgccaactcaacgacacccggtacatttctagatatacaaccgaatacatctccaccatcattcctaaaaataagatctgggttgtgacagggcgcctgacgagcctgcttcggggcttctggggactcaactctattctgagaggccacaataccgatgacgggacacccgccaaaaagtcccgcgatgaccatcggcaccatgccatcgatgctattgtcgtgggaatgaccagcagaggcctgctccagaaagtctccaaggccgcgcggcgctctgaggacctggatcttacaagactgtttgaagggcggatcgacccttgggacggattccgcgatgaggtgaaaaagcacatcgacgctattatcgttagccatagaccccggaagaaatcccagggcgccctccacaacgataccgcctatgggattgtggaacacgctgagaatggcgcctctacggtcgtgcatagagttccgatcacaagcctgggaaagcagtccgacattgagaaagtgcgcgatcctctgatcaagagcgcgcttctcaacgaaaccgctggcctgtctgggaaatcctttgagaatgccgtccaaaagtggtgtgccgacaacagcatcaagtctctgcggattgtggaaaccgtgtccatcattcccatcacagataaagagggagttgcttacaagggctataaaggggacggaaatgcctacatggatatttaccaggaccctaccagctctaagtggaaaggcgaaatcgtcagcagattcgatgctaaccagaaggggtttatcccctcctggcaaagccagttccctacagcccgcctcattatgcggctgagaatcaacgaccttctgaagctccaggatggcgagattgaggaaatctatcgcgtgcagcggctgtctggatccaaaattctgatggcgccccacacggaggccaatgtggacgctagagaccgcgataagaacgacacctttaaacttacaagcaagtccccgggcaaactgcaatctgccagcgctagaaaggtccatatctcccctaccgggctcattcgggaaggatga

SEQ ID NO: 3769 - RNA, 3108 nt, synthetic construct
  misc_feature 1..3108: note = Cas9 variant
  source 1..3108: mol_type = other RNA
atggagcagctgaactacatcctcggcctggacattgggatcgccagcgtgggatgggctgtcgttgaaattgatcacaatgaggaccccatcagacttattgatgtgggcgtgcggaccttcaacaaggccgaagtcgcgaaaacaggggagtccctgtctctcatccgcagactggctcggggaagccgcagacttgtgcggcgcaagaaaatgagactgctcacggccaagcggctgctgaaatccgaaggcatcctctctgacctggattttaataagggggccattcttaacctgcctaataactgctgggagctccgcgttaagggactggacaaaaagctgagcgataaagagtgggctgccgtgctgctccatatcattaagcacagaggctatctgtcccagcggaaacatgaccgcaagaccgatgacaaggaactgggcgctctcctgtctggggtcagcaaaaatcactcccttctggaggaaggagagttcagaacagccgcggagctcgccatcaacgtgttttgtaatagcaagggccatattcggaaccagtggggagattactctcacaccttctcccgcctggaccttcagaaagaaatcaagcagctgtttgttagccaaagagagctcggaaatccgtatacatcttccagcttcgaagagaacattatctctctgctgatgaaacagaaggaagctatctccggcaatgatattctcaaaatgctggggaagtgcacctacgagaagaacgagtataaagccgctaagaatacatacagcgccgaacggtttgtgtggcttaccaaactgaacaacctcagaatcgtcgacgacggagtggagcgcgcgcttaattcctctgaacggaaacttctgattgatgagccctataagaaggccaagctcacgtacgctcaggtgagaaaaatcctggaactgcctgacagcgccgtcttcaagggcgttcgctactttgctgataacgccgagtccagcaccctcatggagatgaaattctggcactctattcggaaggccctggaatccaataaccttaaagacgagtggctggtgctcaagacaaagcccgaactgctggatgagatcggcaccgggtttagcatctataaaacagacgatgacattacctcttaccttagcaataagctcgataaaaaggtgctggacatcctgctcgtcgaagtgtccttcgataaatttattgagctgtctcttaagtgtctgagaaagatcattcctctcatggagaaaggatatcgctacgacgaggcttataagtacatctatggcgaggttaacatcgaatacaatctgaacgacattaaaaatcccgtggtcctgcggagcttctcccagagcagaaaggtgatcaacgcggttattcgcctttacgggtctcctgcccggatccatattgagacggctagagatatcggaaaatccttcaaggagcgcaaagccattgaaaagcaacaggagaagaatcggctcgaaaaagtgagagccgctgagcactttaagcagctgttcccgaactatgtcggcgaacccaaagccaaggacatcctgaaagtgcggctctacgagcagcaacaggggaagtgcctgtatagcggaaagatccttgatattaaacgcctgatggagcatggctacgtcgaaatcgaccacgcgctccctttttctagaacatgggatgactccttcaataacaaggtgctggttctggctaatgagaaccagaacaaaggcaataagaccccctatgaatggtttaacgggaaagataatagcgactcctggaagcggttccttgccctcgtgaacaattctggatttagcgccgtcaagaaacaacacattctgatgaaggagatcgatgaagagggcttcaaacagagaaacctgaatgacacacgctacattacccggtttctctgtaactgggtggagaataacatccctctgcttgggaagggagttaaaagagtgttcgctccccagggcaagatcaccgccctgctccgctccaattgggggattagaaaggtccgggaagataacgaccgccatcacgctatcgatgccattgtggtggcgtgcacaacggtttctatccagcaaagaattaccaattatgtcaaaaacagcgagatcaatcggaagatcaaacgccagaactacctgaagtttccggaaccttggaaattctttagagaggacatttccatccgggtgttcagcaacaatcccattgaagaactgaagcagcagctttctgaccgccctgaggccaaccatcaattcgtgacacccctctttgtctccagagctcccgtgcggaaaatgaccggccagggacacgaagatacaatccgcagcgccaagagaatttctgagggcatctccgttctgcgggtgcctctgaccaagctcaatgacaaaagcctggaacttatggtcaacagagagcgcgagaaggaactgtacgatgctctcaaacagcggctgctggagttcaagaatgacccggaaaaagcctttgcggagcccttctataagaaagggggacagcaagtgaagacggttagaatcgaacgcgtgcagaagaacggcgtccttgtgaataacaatacagggattgccgataacggaaatatcgttcgggtggacgtctttctgaaaaagaaaaagtacttcctcgtgcctatttattcttggcaagtggctaagggcatcctgcccaacaaagccattgtcgctcataagaatgagtgtgattgggccgacatggatgggagcgcccagtttctcttctccctgtacaccaacgaccttatcgaggttgtgctgaaagatagcaccattctcggctatttttcttccatcgacagagctacagcggccatcattatcaaggaacctgatatggagaaaagcaagggaaaggaaggcattcaccgcgtgggggtcaaaaccgctcggtccttcatcaagtacaatgtggacgttctggggaaaaacatttctagatgccgcaaggccaaacggctgcccgtgagatga

SEQ ID NO: 3770 - RNA, 3108 nt, synthetic construct
  misc_feature 1..3108: note = Cas9 variant
  source 1..3108: mol_type = other RNA
atgctgagaaagatgcactaccggctcgccctggaccttggcagcacctccctggggtgggctatgatccgcctcaacgccggaaatgagccctgcgcggtgattaaagctggcgtcagaatcttctctaacgggcggaatcctaaggatggaagctccctggccgttacacgcagagaagcccgggctatgcgcagacggcgcgacagacttctgaaacggaaggcccgcatgattcagacgctcatcgagtatggctttttcccggctaaagaagatcaaagaaaggccctggagattatgaacccctttgcgctgcgggccaaggggctcaatgaagctctgacccctgccgagttcgctcgcgccctttttcatatcaaccagagacggggattcaaatctaatagaaagacagacaaaaaggataacgacagcggcgcgctgaaaaccgccatcaataagctccgcgagacactgaagaccgaaaactgtcggacagtgggcgagtggcttaataaaagagatgtggctgggctgaccgtccgcgcccggtaccaccaggacaagacgattaaagaagatggaaagtccaaaatcaacaagtattacgacctctatattgatagagctatgatcgagcatgagtttgacgaactgtggaaaaagcaggccgagctgaatcccaccctcttcacagaagccgctcgcgcggatctgaaggacgtgcttctgcaccaacgggccctcaaacctgttaagcccggcagatgcacctttatgcctgacgaggaacgcgctccgctggcccttccctctacacagcggttcagaatgtaccaggaggtgaacaatctgcgcattctccgggatgggctgaaagaggaaagcctgaccctcaaccagagagacgatctgatcgccgctcttgaggaaaacaataagcggacgtttacacaaattaaaaagctgctcggactgggcggggtcgtgaagttcaactttgaggaccctaaacgcgaggaacttaagggaaataccacatccgccatcctgggcaaagatgagcatttcggcagcgtttggttcaagtttgacgaagcgaaacaggatgctatcgtgatgcagcttttcaaggaggaaaacgaggccaagctgctgagatggctccagaatgaaaccgggattgacgagaaacgggccgagaccatcgctaacgtcggactgcccgaaggctatgggtctctttgtgccctggctctcgcccgcattctgcctgagctgagacgggatgtggtgccctactccgacgcggccaaggctgccggatttcaccacagcgatacatctaataaccaagaagtcccgggccttacgttccctatcgagctcgttgtgaccgagacaggggaaattaaaaccaagcatatctttcacgagctgccctactatggagaatacctgcagagacatgtgggcttcggctccgggaaacctgaggacagcgctgaaaagcgctatggaaagatcgccaatcccacagtccacattggcctcaaccaggtgagactggttgtgaatacccttatcaaacggtacgggcacccctctgaggtcattgtggaggttgcgcgcgacctgaagcaatccaaagatctcagagacgaagagggaaagcggcaggccgaaaaccagaaacgcaataagagaatccggacggctattgccggcgtgctgcagacaagcgaggaacgcgtcagacgggatgacatcgagaaaatgatcctgtgggaggaactttcctttgatcctgctgaccgcagatgcccgtattctggggtgcaaattagcgccgccatgctcctgtccgatgaggtcgaaatcgagcatattctgcccttcagccagaccctcgacgattctctgaacaataagaccgtggctctccggcaggcgaacagagttaagggcaaccgcacaccttgggaagcctttggagctcagtccaccgccggcttcgactacgccacaatcctggctcgggccgagcacatgcccaaagggaagagatatcgctttgcggaggatggataccaacggtggctcaaagacgatgctggcttcctgcctagagccctgaatgacacgcgccatatgagcaaggtggcccgggaatacatgtctcttatttgtcccaacaccagagtcatcccggggcgcatgacagctatgctccggggaaaatttggcctgaatgacgtgctggggctcaacggcgagaagaatagaaacgatcaccggcatcacgccgttgacgcgtgcgtgattgctgtcaccgatcagggactgcttcagcgcttcgccaaggccagcgcttccgccagagaacagcaactgaatcggctcgtggagaacatgcctctgccctgggagtcttatcgcgaacacgtggagagagctatcgacgccatctgggttagccataaacctgatcactcccatgaaggcgcgatgcacaatgacacagcctacgggctgcttggagatggcaaggtcagcattcacaaaatggtggaggggaagcgggaaagaatcgaggagtctctcaaagtgattgctttcaccaacgccaaggctaatgaccgccatggactgctggataacggcgaaccccggccttataaggggtacaaaggcgactccaattattgtatcgagattatcagaaacgaaaagggaaaatgggagggcgaagtcatcagcacgtttgatgcctaccagctcgtgcgcgagcacggggttgcccggctgagacatcccaccctttctgtgtccggaaagccgctggtcatgcgcctcatgaaagacgagacaattcggatggtgaccaatgaaaagcctatcacagctagagtttgctgggtgcgcagcgataccagaattgcgttcgcctccacgtctgaggctaacgtcgacgcccgggaccgcgataagaacgacagcttttcctatatcgtgaaaacagcctctgttctgcagaagctgcaggctagacggattagcatctcccccaccggcgaacttcgcgatcccgggttcaaagagtga

SEQ ID NO: 3771 - RNA, 3108 nt, synthetic construct
  misc_feature 1..3108: note = Cas9 variant
  source 1..3108: mol_type = other RNA
atggagcagctgaactacatcctcggcctggacattgggatcgccagcgtgggatgggctgtcgttgaaattgatcacaatgaggaccccatcagacttattgatgtgggcgtgcggaccttcaacaaggccgaagtcgcgaaaacaggggagtccctgtctctcatccgcagactggctcggggaagccgcagacttgtgcggcgcaagaaaatgagactgctcacggccaagcggctgctgaaatccgaaggcatcctctctgacctggattttaataagggggccattcttaacctgcctaataactgctgggagctccgcgttaagggactggacaaaaagctgagcgataaagagtgggctgccgtgctgctccatatcattaagcacagaggctatctgtcccagcggaaacatgaccgcaagaccgatgacaaggaactgggcgctctcctgtctggggtcagcaaaaatcactcccttctggaggaaggagagttcagaacagccgcggagctcgccatcaacgtgttttgtaatagcaagggccatattcggaaccagtggggagattactctcacaccttctcccgcctggaccttcagaaagaaatcaagcagctgtttgttagccaaagagagctcggaaatccgtatacatcttccagcttcgaagagaacattatctctctgctgatgaaacagaaggaagctatctccggcaatgatattctcaaaatgctggggaagtgcacctacgagaagaacgagtataaagccgctaagaatacatacagcgccgaacggtttgtgtggcttaccaaactgaacaacctcagaatcgtcgacgacggagtggagcgcgcgcttaattcctctgaacggaaacttctgattgatgagccctataagaaggccaagctcacgtacgctcaggtgagaaaaatcctggaactgcctgacagcgccgtcttcaagggcgttcgctactttgctgataacgccgagtccagcaccctcatggagatgaaattctggcactctattcggaaggccctggaatccaataaccttaaagacgagtggctggtgctcaagacaaagcccgaactgctggatgagatcggcaccgggtttagcatctataaaacagacgatgacattacctcttaccttagcaataagctcgataaaaaggtgctggacatcctgctcgtcgaagtgtccttcgataaatttattgagctgtctcttaagtgtctgagaaagatcattcctctcatggagaaaggatatcgctacgacgaggcttataagtacatctatggcgaggttaacatcgaatacaatctgaacgacattaaaaatcccgtggtcctgcggagcttctcccagagcagaaaggtgatcaacgcggttattcgcctttacgggtctcctgcccggatccatattgagacggctagagatatcggaaaatccttcaaggagcgcaaagccattgaaaagcaacaggagaagaatcggctcgaaaaagtgagagccgctgagcactttaagcagctgttcccgaactatgtcggcgaacccaaagccaaggacatcctgaaagtgcggctctacgagcagcaacaggggaagtgcctgtatagcggaaagatccttgatattaaacgcctgatggagcatggctacgtcgaaatcgaccacgcgctccctttttctagaacatgggatgactccttcaataacaaggtgctggttctggctaatgagaaccagaacaaaggcaataagaccccctatgaatggtttaacgggaaagataatagcgactcctggaagcggttccttgccctcgtgaacaattctggatttagcgccgtcaagaaacaacacattctgatgaaggagatcgatgaagagggcttcaaacagagaaacctgaatgacacacgctacattacccggtttctctgtaactgggtggagaataacatccctctgcttgggaagggagttaaaagagtgttcgctccccagggcaagatcaccgccctgctccgctccaattgggggattagaaaggtccgggaagataacgaccgccatcacgctatcgatgccattgtggtggcgtgcacaacggtttctatccagcaaagaattaccaattatgtcaaaaacagcgagatcaatcggaagatcaaacgccagaactacctgaagtttccggaaccttggaaattctttagagaggacatttccatccgggtgttcagcaacaatcccattgaagaactgaagcagcagctttctgaccgccctgaggccaaccatcaattcgtgacacccctctttgtctccagagctcccgtgcggaaaatgaccggccagggacacgaagatacaatccgcagcgccaagagaatttctgagggcatctccgttctgcgggtgcctctgaccaagctcaatgacaaaagcctggaacttatggtcaacagagagcgcgagaaggaactgtacgatgctctcaaacagcggctgctggagttcaagaatgacccggaaaaagcctttgcggagcccttctataagaaagggggacagcaagtgaagacggttagaatcgaacgcgtgcagaagaacggcgtccttgtgaataacaatacagggattgccgataacggaaatatcgttcgggtggacgtctttctgaaaaagaaaaagtacttcctcgtgcctatttattcttggcaagtggctaagggcatcctgcccaacaaagccattgtcgctcataagaatgagtgtgattgggccgacatggatgggagcgcccagtttctcttctccctgtacaccaacgaccttatcgaggttgtgctgaaagatagcaccattctcggctatttttcttccatcgacagagctacagcggccctgatcattaaggaacctgatatggagaaaagcaagggaaaggaaggcatccaccgcgtgggggtcaaaaccgctcggtccttcattaagtacaatgtggacgttctggggaaaaacatctctagatgccgcaaggccaaacggcttcccgtgagatga

SEQ ID NO: 3772 - RNA, 3111 nt, synthetic construct
  misc_feature 1..3111: note = Cas9 variant
  source 1..3111: mol_type = other RNA
atgagaatcttcggctttgacattgggatcaccagcattggatgggcctacgtggagtccaacgaactgaaggattgcggcgtccggatcttcacaaaagctgagaatcccaagaacgggaaatctctcgccctgcctcgcagagaagcgcggggagctcgcagacggcttgcccgcagaaaggcccggctgaatgctattaaacgcctcctgtgtaaggagtttggccttaacgttagcgactatttcgccaatgatggggaactgccgaaggcttacgagacgaccaaagacacaaagtccccctatgagctcagatctctggccctggaacagaaactcgagcctaaggaactggcgcgggtgatccttcacatcgccaaacatcgcggatacggcaacaagcacgctaagaccggcagcgataaagactccgggaaggtgctgtctgccattaaagtcaatgagacagctatgaaggataaatatcaaagcgtgggagagtacctctataaggaattttaccagaaactgagacttgagtccgaaaagaagggcaacaatatcaccaaagagttcaagaacgttcggaataaaggggaaaactacgagcattgcgtggcccaggagcaggtccgcgcggaactggagctcatttttgccaagcaaaaagacttcggagctacatttagcgaaaatttcgagtctcagatcattgaaaccgccttttatcagagagatctgaagtccttcgaggacaaggtgggcaaatgtgtgttttacgagaacgaaaatcgggctcccaaggatagcctgtctgccatggagttcgttgccctcacgagaatcattaacaccctgaaaaaccttgaagagaagtccaaaaatctggggatcggagaagtctatggcaaggacaagatccaggagattctcaaaatcgtgctggataagggcgagatgagctacaaaaagctgcgcgaaattctgcacctcgacgagcatatcctgttcgctaaagactctaagctggattatacacaaggggtgcaggaagcggagaaggccaaatttattgagctcaagaacctgaaagccttcaagaaagctatgggaggcgacttttccaatttcgcccgggaagaacttgataagatcgctaccgacatcacactggtcaaaagcaaggaaaacctcgccaagaaactgcagaattactccgcgctttctaaggagcaggttgaagctctgagcaacctctcctttgccaaacacattgatctgagcctgaaggccctcgagcaaatcctgcctttcatgagaggggacaaaaccggaaagtgccttcgctatgatgaggctgtgaagaaagccgaactgcaggagcaccggaagcataaacagaagggcgaatttctcattcccctgaaagactacgagccttacctggctaatccggtggtcgccagagcgctttctgaatatcgcaaggtgctcaacgccctgctgcggaagtacgggaaagttcacaagatccatctcgagttcacgagagaggctaaactgtccgccaaggaacgccaaaaatatgagaaggaacagaaggagcactttgaagctaatcagcgggccattcagcaatgtgagatccttggactgcccatcaacggcacaaatattctcaaaatgaagctgtggctggagcagggcgaatgctgtgcgtacagcggggagaaaatcaccagagaacaccttctcgattctaacgcccttcaggtggaccatatttatccttacagccgctccttcgatgactcttatatgaataaggtcctggtgtttgctaaagagaaccaggacaagggaaataaaacacccttcgaggcctttggcggggataaggaaaagtgggaccggatcctcagcctgtccgctaaacttcctaagcaaaaacagagacggattagcaacaccaacttcaaggataaagagggaggcttcctggcccgcaatctcaacgacaccgggtacatcgccaagctggcttctcagtggacaaaggattgcctggaatttgaggaccttagagaaaatgaggttacgattgcgggcgagaaaggatccagcgtgcacatcgaagtcgtgtctggccagctcacctccatgctgcggcattactgggggctgggaaacaaggatagaaataaccacctccatcacgccgtcgacgctgtgatcctggcctatacaaataacgccatgattaaggctttcgccaattttcgcaaaaaccaagaggaaaataaaaagaagttctacgcgaaacagatcgctgagagcgaatataaggccaaaaaggcctttttcgagccctgtaaaaactttcggcagagagttgaggaaaagattaaggagatcttcgtgtccaaaccgcctcgcaagagagtccggggcgcccttcaccaggaaaccttttaccccttcgagaaactgtgcaatgataaggaatattctgagaaactcaagatggactacgggggagagaagggcatgcaaaaagctattgcgctggggaagatccgccagatcggcacaaaaattgtgagcaacggagctatggttagagtggatatctttaaggacaaaaagggcaaattctatgccgtccctatttacaccatggattttgccctggggatccttcccaataaggctgtggccattggaaaggacaaagacggcgtgatcaaggattggatcgaaatggactccaactacgatttctgtttctctctctttaaagacgatctgattctggttcagaagaaagagatggaacgggctgagctctgctatttcgtcagctttgggtccacgaacgcccaaatcaatgtggagaagcataacaataagttcgaaggactgagcgagaacgagaaaattctttactctaatgcgacacagaaggaggtggccggcaaatccatcgggattcagaacctgaagacctttgaaaaatatcaggtcagccccctcggcgaggtgcaaaaggctgagttcgaacctcaccaggagatcaagctgaaatcttccccgaagcgcaaagactga

SEQ ID NO: 3773 - RNA, 3111 nt, synthetic construct
  misc_feature 1..3111: note = Cas9 variant
  source 1..3111: mol_type = other RNA
atgctgcacaagatgcattacagactcgccctggaccttggcagcacctccctggggtgggctatgatccggctcgatgccgacaaccagccctgcgcggtgattaaagctggagtccgcatcttctctaatggcagaaaccctaaggatgggagctccctggccgttacacggcgcgaggccagagctatgcggcgcagacgggaccgccttctgaaaagaaaggcccggatgatgcgcacgctcattgaatatggatttttcccggctgaggccgcgcaaagaaaagccctggaaaccatcaatccctttgctctgcgggccaagggcctcgatgaggctctgacccctgccgagttcgggcgcgcgctttttcacattaaccagagacggggattcaagtctaatagaaaaacagacaagaaagataacgacagcggcgccctgaagacagctatcggcaaagtgcgcgccaccatcgaggctgaggggtgtcggacagtgggagaatggctccataagagagatgtcgccggcctgaccgtgcgcgcccggtaccaccaggacaaggttattaaagaggatgggaagacgaaaatcgacaagtattacgatctttatattgacagagctatgatcgaacaggagtttgacgagctgtggaaaaagcaagcggaactcaatcccgccctgttcaccgaggctgcccgcgccgatctgaaagacgtgctcctgcatcagcggcctcttaagcccgtcaagtccggaagatgcacatttatgcctgatgaagaacgcgctccgctggccctcccctctacccagcggttcagaatgtaccaggaagtgaacaatctgcgcattcttcgggacggcctgaaagaggagcctctcacactgaagcaaagagatgacctgatcgcggctctcgaaaagaacagcaagcactcctttacccagattaaaacgctgcttggggttggaggcgccgtgcagttcaattttgaggatctgaagcggcaggaactcaagggcaacacaaccagcgccatcctgtctaatgacaaacacttcgggaaggcttggttcacatttgatgaggccaaacaagacgctatcgtccttcagctggtgaaggaagagaacgaggccaaactcgtgcgctggctgcaggatgaaaccggaattgacgagaagagagcggaagccatcgctaatgtcggcctgcccgaggggtatggatccctctgtgccaaggctctggcccggattcttcctgaactgagacgcgacgttatgacctacgataaagcggtgcaagccgctggcttcgagcatcacagccggctcgggtctaacacagagatccccggactgacgtttaagattgaatccatcgaccaggatagcggcgaggtgaaacagttccatatccacaaggtcctgccgtactatggcgaataccttcagagacacgtggggtttggatctggcgagcctgaggaccccgccgaaaaacgctatgggaagattgctaaccctaccgttcatatcggactcaatcaaattagactggtggtcaacgccctgctcaagcggtacggccacccctccgaggtgatcgttgaactggcccgcgatcttaaacagagcaaggaccagagagatgaggaatccaaacggcaggctgagaatcaaaagcgcaacaaaagactgcgggacgcgattgccgggacactcaagatctctgaggaacgcgtgagacgggatgacatccagaaaatgattctgtgggaggaactgagcttcgatcccgctgaccgcagatgcccttattccggcgcccagatcagcgccaccatgcttctctctgatgaggtcgaagtggagcatattctgccgttttcccagacactggacgacagcctcaataacaagaccgtcgctctgcggcaagccaatagaatcaagggaaaccgcacgccctgggatgcgttcggcgctcaggccgtggccgggtttgactacgagtctattcttgttcgggctgaaggaatgcctaaagccaagagatatcgcttcgcggagaatggctaccagcggtggctgaaagatgacgctagctttctcgccagagccctgaacgatacacgccacatgtccaaggtggctttcgaatacctgaaacttatctgtcccaatacccgggtcattcctgggagaatgaccgccatgctccgcgctaagtttggactgaacgacgtgctgggcctcaatggggagaagaaccggaatgatcatagacaccacgccgttgacgcgtgcgtgatcgccgtcacagatcagggcctgcttcaacggttcgctaaagcctctgctagcgcccgcgaacagcagctgaacagactcgtggagaacatgcccctgccgtggggatcctatcgggagcatgtgcaacgcgccatcaatgctatttggatcagccacaagcctgaccattctcacgaaggcgcgatgcacaacgataccgcctacgggctgagaggagacggcaaagtttccttccataagatggtcgagggggtgcggacacacagcgaagataatcttaaagtgattgagatctctaacgctaaggccacggacagacatggactcctgcccaatggcgagcctcgcccctataaggggtacaaaggcgactccaactattgtattgaaatcgtccggaatgagaagggaaaatgggaaggcgaggtgatcagcacctttgaagcctaccagctggttagagagcacgggattgctcgcctccggcattccacactgtctgtgagcggaaaacttctggtcatgagactcatgatcgatgacgtggttcgcctgattatcgatgagcagacccggacaatgagaattgccaccctgtccggcaacgggcagatcttcatggcggacacgtctgaagctaatgtggatgcccgcaacagaagcaaagaggaaacctttgcctatgtctccaagatggctggaagccttcaaaaggccaatgcgcggcgcatcaacatttctcctatcggcgagctgagagaccccgggttcaaagaatga

SEQ ID NO: 3774 - RNA, 3114 nt, synthetic construct
  misc_feature 1..3114: note = Cas9 variant
  source 1..3114: mol_type = other RNA
atggagagaatcttcggctttgacattgggaccacaagcatcggattctccgtgattgattactctagcacgcagtccgccggcaacatccaacggctgggggtccgcatttttcccgaagctagagaccctgatggaaccccgctcaatcagcagcggcgccagaagagaatgatgcggcgccaactgagacggcgcagaatccggcgcaaagcccttaacgagacactgcacgaagcgggcttcctccccgcttatgggtctgccgactggcctgttgtgatggccgatgagccctacgaactgagacggcgcggacttgaggagggcctgagcgcttatgaatttggcagagccatctaccatctcgctcagcaccggcatttcaaggggagagagctggaagagtccgacacccctgatcccgacgtggatgacgagaaagaagccgcgaatgagcgcgccgctacactgaaggccctcaaaaacgaacagaccacactgggagcttggcttgcccggagacctccgtctgatcgcaagcggggcattcacgcgcatagaaatgtcgtggccgaggaatttgagcgcctgtgggaggttcagagcaagttccaccccgctctcaaatccgaagagatgcgggccagaatcagcgacaccatttttgctcaacgccctgtgttctggcggaagaacacgctgggggaatgcagatttatgcccggagagcctctttgtcccaaaggctcttggctgtcccagcagcgccggatgctcgaaaagctgaataacctggccatcgccgggggaaatgctagaccgctcgatgcggaggagcgggacgccattctgagcaaacttcagcaacaggcttctatgtcctggcctggcgtccgcagcgccctgaaggccctctataagcagagaggcgaacccggggctgagaaatctctgaagttcaaccttgaactgggaggcgagtccaaactcctggggaatgccctggaagcgaagctcgctgacatgtttggacctgattggcccgcccacccccggaaacaagagatcagacatgccgtgcacgagcgcctgtgggctgccgactacggcgaaacccctgataagaaacgggttattatccttagcgagaaggacagaaaggctcatcgcgaagccgcggccaactccttcgtggctgatttcgggatcacaggagagcaggccgctcagctgcaggccctcaaactgccgaccggctgggagccctattctattcctgcgcttaatctgtttctcgccgaactggagaagggcgaaagattcggggctctggtcaacggacccgactgggagggctggcggcgcacaaattttcctcacagaaaccaacccaccggggaaatcctcgataaactgccgagccctgcctccaaggaggagcgggaacgcattagccagcttagaaaccccacggtggtgcggacacagaatgagctgcgcaaagtcgttaacaatctcatcggactgtacggcaagcctgaccggattagaatcgaagtggggcgcgatgtgggcaagtctaaaagagagcgggaagagatccagtccggaattagacgcaacgagaagcaacggaaaaaggctaccgaagacctgatcaaaaatggcattgccaaccccagcagagatgacgtcgagaagtggatcctttggaaggaagggcaggagcgctgcccttacacaggagaccagattggcttcaatgccctctttcgggaagggagatatgaggtggagcacatctggccccgctctcggagcttcgataactccccgagaaataaaaccctgtgtcgcaaggacgttaacatcgaaaaaggaaatcggatgccttttgaggctttcggccatgatgaagacagatggtctgcgattcagatccggctgcaagggatggtgagcgccaagggcggaaccggcatgtcccccgggaaagtcaagcgctttctcgctaagacaatgcccgaggatttcgccgccagacagctgaacgacacgcggtacgctgccaaacagattcttgcgcagctgaagcgcctctggcctgatatgggaccggaggctcccgtgaaagttgaagccgtgaccggccaagtcacagcccagctgagaaagctgtggacccttaataacatcctcgctgacgatggggagaaaacacgggccgaccacagacatcacgcgattgatgctctgaccgtggcctgcacgcatcctggaatgacaaataagctgagccgctattggcagctccgggacgatcccagagccgaaaaacctgctctgaccccgccttgggacaccatccgcgccgacgctgagaaggccgtctctgaaattgtggtttcccaccgggtgagaaagaaagtcagcggcccccttcacaaggagacaacctacggggatacaggcacggacatcaaaaccaagtctggaacatatcgccaatttgtgacccggaaaaagatcgagtccctgagcaagggcgaactcgatgagattagagacccgcgcatcaaagaaattgttgcggcccatgtggctgggagaggaggcgatcctaagaaagcctttcccccttacccctgtgtctcccccgggggacctgagatccggaaggtgcgcctgacatctaaacagcagctgaaccttatggctcagaccggcaacgggtatgccgacctcggcagcaatcaccatattgccatctacagactgcccgatggaaaggctgacttcgaaatcgtgtccctgttcgatgcgtctcggcgcctcgcccaaagaaaccctattgttcagcggacgagagctgacggcgccagcttcgtcatgtccctggccgctggggaggccatcatgattcccgagggaagcaagaaaggcatctggattgtgcagggggtgtgggcgtctggacaggtcgtgcttgaacgcgataccgacgctgatcactccacaaccacacggcccatgcctaatccgatcctgaaggacgacgccaaaaaggttagcatcgatcccattggcagagtgcgcccttctaacgactga

SEQ ID NO: 3775 - RNA, 3117 nt, synthetic construct
  misc_feature 1..3117: note = Cas9 variant
  source 1..3117: mol_type = other RNA
atggccaaacaggtgagataccggctgagcctcgacctgggctccacctctcttgggtgggctatcttccgcctggatgccgacgcgcaccccacagctattatcaaggccggagtcagaatttttagcgatggccggaacgccaaggacgggtcctctctcgctgttacgcgcagagccgctcggagcatgcgcagacggcgcgatagactgcttcggcgcaaaaccagaatgctggacgccctcctggagtatggattctttcctcaagatgcggcccagcggaaggctctggaacgcctcaatccgtacgccctgagagctgagggccttgcccggcccctgacacctggggagttcgcgagagccatctttcatctcaaccagcgccggggattcaaatccaatagaaagaccgacaagaacgataatgactctggcgctctgaaaacagccaccagccagcttcgccaagatattcaggcttccggctgccggacagtgggggaatggctgtggacccagagactccagaagaaacccgaaggagtgcctcaccaaggcgtccgcgcccggtatagagagacgccccatatcaacagcgaggggaagaaacgcatcgaaaagaagtacgacctgtatattgatcggtctatgatcgaggccgaatttgacgctctgtggtccgcgcaggccaccttcaatcctgtggtttttcacgctacagcccatgagaaactcaaggacattctgctttaccagagaccgctgcgccccgtgaaacctggacggtgtaccctcctgcccgaggaagagagagcccctcttgctctgcccagcacacagcggttccgcatctatcaagaactcaacaatctgagactgctcgtcgatcagctgaacgagcagccgcttaccctggcccaacgggacacgattgcgacactcatggaaggcagagctaagatctcttttgatcagattcgcaaagccctgaaacttgggtccatgaccaagttcaatctggaggacgataagcggaacgagctcaagggaaatgccacaggcagccagctggctaaaaaggaatttttcggccctgcctggcaccagttcgacgaggctctgcaagatgacatcgtgtggcacctcctgtctgaagagaacgaatccgcccttatcagctggctgcaggatagaaccgggattgacgcggccaccgctcaggccgtttccaatgcttctctccccgagggatacggcagcctgtcccgcaaagccctggaggtgatccttcctagactccggagcgaagtcattacatacgataaggcggtgcaggccgctgggttttctcatcactcccaactgggattcgagtatgaccccgacgatgtggaagactggatcgatcatgccacgggcgaggtcaaacccatttttaagcgcctgccttactatgggaaggctctccagagacacgttgccttcggaagcggcaaaccggaagactctcaggagaagcggtacggcaaaatcgccaaccccaccgtgcacatcgggctgaaccaggtgcgcgtcgtggctaatgcgcttattgccagatatggacggcctacagagatcattatcgaactggctcgcgatctcaagcaaagcagagagcagcggcagcaggaccaacgcagacaggccgataaccagaaacggaatgcccgcattagaaactccatcgctcaagccctgggcatcgcggaagctcgggttagacgcgaggacattcagaagtggatcctgtgggaggaacttgatcccggggacgccatgcatcggtgctgtccttactctggagtgcccattagcgcctccatgctcctgagcgagcaggtcgaaatcgagcacattctgccgttttctatgaccctcgatgactccctgaataacagaacagtgagccttcgccaggctaatcggatcaagagaaaccgctctccttgggatgcccgggaagacttcgaggcgcaaggctggcattatgacgggattctgcagagagctggcctcatgcccgttcagaaacggtaccgctttgccgccgatggataccagagatggctgcgggacgatcaagacttcctggctcgcgcccttaatgataccagatatctctcccggatcgctgccgagtacctgagactggtgtgccctcagggcacgcgcgtcatccccgggcagctcacagcgctgcttcggagacgctttggactgaacgacattctcggcctggaaggggagaagaatcggaacgatcacagacatcacgccgtggacgcttgtgtcatcggaattaccgatcacggcctgatgcagcgcttcgcccgggctagcgcccaagccagagaacaggggcttacccgcctcgctgaggaaatgcctctgccctggccgacatatagagaccatgtggatcgggcggtttccctgatctgggtgtctcacaaacctgaccatggccacgagggagccatgatggaggaaaccgcttacggcctcatgaaggatgggacaattcgccagagacacaaagccgacggaacgaagggccgggaggtcgccaatgtgatccgcatcgctgaacccgcccaacccaccagacatggggttgacgatcagggacggcctctgccgtataagggctacattgggggcagcaactattgcatcgagattacaagaggagcgcagggcaaatgggaagggaccgtgatctccacatctgacgcttacggaattgtccgcgcccggggcatcgccgggcttagaaataccagccagggacaaaacggccaccccctggtgatgcgcctcgtgatcggggattccctgcggctgagaattaacgacgcccttcagacgatgcgggttaccaagatcagcggcaatggacaggtctttatggctggcgtgcatgaggcgaacgtggatgctcgcaatagagacaaatctcaggccttcgccctggtctccaagatggctgggagcctccaagccgctcaggcccggcaggcgacaatttctcctatcggagagattcgcgatcccggctttcctgggtga

SEQ ID NO: 3776 - RNA, 3120 nt, synthetic construct
  misc_feature 1..3120: note = Cas9 variant
  source 1..3120: mol_type = other RNA
atgaagaaaagaatcctgggcctcgacattgggatcgccagcgtgggatgggctctgattgagttcgatgacgaatttcaggataacaagaaaaagggcaccatcattaaatccggggtccggatcttcacacgcgccgagacgcccaaggaaagagagcctcttgcgaagccgcggcgcgaagctagatctcaacggcgcagaatcagctgccgggttgagcgcctgaattttgtgagagaactcttcgtgaaaaacggactggtcgccaaggaatccgtgaataaaaacaatcccaacaatatttacatcacccttaaccagattaagacaccttggcagctgcggatggaggccctcgaccgcaaactgaccaatgaagagtttgctgttgtgctgacacacctcgccaagcatagaggctataagtctctgcggaaaaccgatagcaaggacaacaaaacaggggagatgcttaaggctatcaatcagaacaaagaacgcctggataattccgactacagaaccctcggagagatgttctgtaagcacgaatcttataaagagcataagcggaacaaggatggcgaatacattaatagcgtcacgagagagctgatcgaggaagaggccgaaaagatttttgcgaagcaacgcaaagagggcaacaacttcgccgacgtggatatcgaacgggagtatcttaagatcgctttttcccagaaacccaccgggagcattaataagatggttggattctgcacatttgagaacggcgaaaagagagcccctcgcgactcttactccgctgagctgttcaaagtgctcaataccatcaacaatacaaccattacggatatgaagacaggggaaacccggaactttacaggagccgagatcaaaaagattatcgaaatcattaaagacaccaagggcatcacctatgtcaagattaaaaaggagctgaaactggggagctctcagttctccggagtggactacagagagaatgcgaaaagcaaaggcgaaggcgagatcttcgtgtctatgaagacataccacgaaattaagtccaaaatcgagaagctcagcaaagagaagtggaacaaactgaaggaaaatacggagcttctggattccatcgtcaacattatcgccaattttaaagacgatgaatctattaagaaggagttccagaaactcaagatcgacgaagatattatcgacgttctgcttaactttgagttcaaaaagtttattaatctgagcttcaaagctctccgcaagatcatcccctttcaattccaggggcagaagtatattaccgcctccatgagcgtgggatactctctgaaacaggagggcatcaagaacaaatttctgcgggtgccttcccaagaagagaatgtcaacgtgccggttgtggctagagccttcgcccagacacgcaaggtcattaacgctgtgatccgggaatatgggcagtttgatcaaattaatatcgagctcgcgaccgacctgaaaaacagcaagttcgatagatctaagatcgaaaaaggacagaaggagtttcagagccagaaagacaaggttttccaagaggtgcaggatcttacaggcgaaattatcccctcctctagcctgctcctgaaataccgcctttggcgggagcaggacgaaagatgtatttattccgggcggaagatcagccgcaaggacctgctcgataccggattcctggacattgatcatatcatcccttactctaaatccatggacgatggctttaataacaaggtcctgtgcctcgccgaggaaaatagaaacaaaaagaatgacattcccttcaactattaccagcggatcggcagagattggaattttctgattagcatcattgcttctatgaaaaacatgaagtacgtgaaaaagaagcgccttctgaaacaagagctctccgacatcgagatcgagagcttcattgagcggaatatcaacgatacgagatatgccacacgctacattaagaattttctggaaaacaatctggagttcaaagagaacgaatttatcaaggccaaagtccaggctagacacgggggacttacctccgtgctccggtataactggggcatttctaagaatcgcgaggaaagctacctgcaccatgccaaggacgcgatcaccgttgcttgttccacacaggggatggtgcagtatatttctaacatcagccaaaaatacgagaatggaaagtataaaatgaagcagatcaaagaaagaaccgagaaccggattcctaagccctgggattccttcaaggacgatgtcgagcgcagcatcaatgacatttttgtgtctttcgccccgagacacaaagttacaggctccgcccataaggaaacgatctacagcaaaaagcacctggagaaagggtacgtgaccattaagaagtctctcgacaaaatcaagctgtccgatcttaaaaacatcccttgcgacgaaaattgtgatattatccgggtcctgaaggagcgcctcgaaaaatttaacgacgatagcctgaaggctttcgccgaccccgtgcacatgcctacaaagtgctctaataaaaagggccccattatcagaagcgtgaaaattaaggagaacaataaaaccggaatcgaggttcggaagggcctggtcgaacgcggggatatggtgagagtggacgtctttatcaaagataagaagtattaccttgtgcccatttatgtttccgacttcaaaaacaaggatctccctaataaagctatcgtgagctctaagtccgagaacgaatggattatgatcgacaaaacatacagcttcaagttttccctgttcaaggatgacctgattaaaatcaagaataaaaagggagagatttttggctatctcgggggagtccatcggctgaccggcgggatcaacatcaaatcttgttacaagccgaaggaaaaagacggcaacattggaagcaagtgccttctggatttcagaaaatttcaggtgggcatcctcggggactataatgaggttaagcacgagaaacgcatgcccgcctacattaacacgaagaaggataaagaacattga

SEQ ID NO: 3777 - RNA, 3123 nt, synthetic construct
  misc_feature 1..3123: note = Cas9 variant
  source 1..3123: mol_type = other RNA
atggacagacgggatgcccgcgctatgagacggcgcagagaccggttccagcaacgccagagagccctgctcaagtacctggtggcggatggcctttttcccgaggacgaaggggagcggaaagctctggccgccctcgatccttatgctctgcgcgccagagctcttgacgaagccctgagcctccacgagctgggacgggcgctgttccatctcaaccagcgcagaggctttaagtccaatcggaaagccgatcgcaaggctgacgatgacgccgggaaaatcgctattggagtcgatagagcccgggaagcgatggccgagaacggcgctagaacctacggggagtggctgcaccgccggagagcctctgctacagacgccaatgccatcccgcccgttcgcacgcggcttagacctgaaagcggagaggatgctaagggcgacggctatgacttctaccccgggcgcgatctgctcgaagaggagtttgcggccatttgggaagctcaggccgcccatcaccctgacgtgctgaccgatgacgtgtatgagcggcttttcgaaatcgtcttttaccaaagacccctgaaggctcctcagattggaatgtgcacactcatcgccggcgatcgccggctgccgaaagcgcatcccctgttccagagacgccggctcctggaggaacttaacgctctgatgatcgtgagacctggggaggttgcccagcggctcacccgcgaggaaagagacacactgtttcttaagctgaaagatcggaataaggtgtccttcgagtctctcagaaaaaccctgaagctggaccccgatgcccgctttaacaaggaaagcgagaatcggacagaactcaaaggagacgaggtcgctgccgctatgggctccaagaccagattcgggaaccgctgggtgcacctgtctattgaggaacaatgggccgttatcgagagacttggagatgtggaaagcgacgcggaggacgccgcttttcgggcctggctggctgaacgctatgagctcacgcctgagcagaccagagccgtcacaaatgcgcccctgccgcagggctacggccggttcggggaaaccgccacacgcaaacttattgatgctctgagagacggagagaaggatggccgggtgctcgtgtactccgaagccgtcaccgctgccgggctgggacaccatagcgaccgcagaacgggcgaggttttcgaggatgaagaggggcggcctcagctgccctattacggagtggccctcgaacgccacatcatgcctggcacaggcgacccctctgattccgacgagatgagagtggggcggctgaccaaccccacagtccatattggacttaatcaactgagacgcatcgtgaaccggctcattagagcttatggccctccggcggaaatcgccatcgagctggctcgcgagctgaaacttaccgatgaagacaagaaacggattaataaggagaacaatagcaacagactcgatgccgaacgccggtctgagaagctgctggccatcgggaaacccgacaccggagctaacagagccctcctgaaactttgggaggaactgaatcctgcgaacgttctcgatcgccggtgtatttactccggcgtgcagatcagcattgacatgctgttttctgctgccgtcgaggtggaccacatcctgcccttcacagccacgcttgatgactccaatgggaacaagatcgtttgcaccagagaagctaatcgggagaagcgcaaaagaagcccttatgaagcctggggccactccgcgcggtgggaggaaattgctgcccgcgccgctcagctccccagaaacaagcggtggagatttgagccggatgccatggagaagttcaaagacgatggaggctttcaagctcgccatctgatcgacacacagtacctggcccggctctctagagaatatctggcgaccctttaccctgataagggggagggaagcggccacatttgggtgtcccccgggcgcctgacagaaatggtccggagaaaactcggactgaatgacctgcttcctgatcataacttcggcgggggcgccgaccaggctaagaatcgcctcgatcaccggcatcacgccatcgacgctgtggtcgtggccattgttgatagaggaatgctgaaccgcatcgccagagctagcggccaggagggggcggagggacgggaacgcatcattatccccgagccttgggaaggctttagagacgacctgcggaccgccgtgaatgctattacggtctctcaccgcacagatcatgggaccgcctccaaagccggactccccaagggcaaggacgctaccgccgggagactgcacaacgatacagcgtacggcttcaccggagagagcgacgctaaaggcaattctatcgtggttcggagagtgccgcttagctcctttaagaaactggccgatattgaccgcgtccgggatcctgaactcaaggccgctctgtatcaacatctggacgggcttgagggaaaagccttcgagaaggcgatcggcgaatttgggtctagagagtggcacccctacggaggcgtgcgccgggtgagagttacagaacccctcagcgtcattcctatccgggatcgcaacgggcacatctataagggctacaaaggagactccaattatagatacgatgtgtgggagctgccgggcgggaagtgggtgaacgaagtcgtgagcatgttcgacgctcatcagcccggatggcagtctgccattcgggccgctaaccctacggcccgcaaagttctgtccctccacagagacgatgtgctggctatcgagcggaatggcgccgagcgcgaacttgtcagagtggttaagtttagcgagaaacagttcgcggtggctccccctaacgaagggggagccctgaaggcccgggacgctgataaaggcgaccccttcaagtattcttacccttcccccaataccctcaaggccctgcgcgccagacaagtccggattgatgagctgggcagagtgcttgacccggggtttcctgctcgcacaaaacagcggaagaccagaaaacccaactga

SEQ ID NO: 3778 - RNA, 3132 nt, synthetic construct
  misc_feature 1..3132: note = Cas9 variant
  source 1..3132: mol_type = other RNA
atgcagagagacaaccccctggtgtaccggctcgccctggatcttggcagcacctccctggggtgggctgtcttccgcctcgacgccgagggatctcctctggcgatcattaaggctggcgccagaatctttagcgatgggcggaatccgaaagacggatcctctcttgccgttacacgcagagctgcccgggctatgcgcagacggcgcgatagactgctcaagcggaaagcccgcatgctgggcgcgctggaaagacacgggttctttccccaagacgagagcgcccggaaggtgctcgaaacgctgaaccctttccttctgcgcgctcagggactcgaggtggccctgaaacccgaagagtttggcagagctcttttccatctgaatcagcggagaggctttcagtccaaccgcaagaccgatcggaaggactctgatagcggggccctcaaacaagcgattggaacactgagagcccagatgcacgagtccggctgccgcaccgtcggggaatggttctggaaggtgcggatggagcataaacctgaaggagttaagggccagggggtgagagctcgctatcgggagacaccctttaccacagacgagggcaaaaagagaatcgataagcgctacgacctgtatgtcgatcgggccatggtggctcaggagttcgacgccctctgggccgctcaagcggcctttaatcctgctctgttcaacgaggccgccagagctgaacttcgcgacattctgctccaccagcggaaactgagaccggttcagcccggacggtgtacccttgtgcctgaggaaccccgcgccctgctcgcgctgagctctacgcagagatttcggatctaccaagaggtcaatcatctgagagtgctccacgatgagctgcgcgaagagacccttacactggctcagcgggaccagatcgtggccctcctggaaaagcaagccaaagtcaccttcacagctatgagaaaggcccttggcttctccgctctgtttaacctcgaggatgccaaacgcgacgggctgaagggaaatgcgaccgccgctgccctgagcaaaaaggatctcttcggccctctgtgggctgggtttggaacggcccttcaggacgaaattgttacacagctgatgaccgaggagtctgaacccagactcatcgcgtggctgcaggagcacacaggcgtggatgaagcccgggctcaagccattgctaacaccgggctgccggagggatatggctcccttggccgcaccgccctcgccagaatcgtgcctgaactgcagcgggacgtcattacatacgataaggctgtgcaggcggccgggttcgctcatcacagcgacctgggattttctttcgagcatggcgccgatgaggttgaacgcatcggggagagaacgattgcctccaccggagaaatcaaacccgtgtttgctttcaagcagctcccttattacggccgggccctgcaacgccacgtcgcgtttgctaaagacaatcccagaaacgacgaggagcggtacgggaagatcgccaatcccacagtgcacattggccttaaccaggttcgcgtggtcgtgaatgccctgatgagacggtatggaagacctgctgaagtcgtgatcgagctcgcccgcgatctgaaacagagccgggaacagaagctggaggcgcaacagagacaggctgacaaccagaagcgcaacgcccggattagacgctccatcgccgaagttcttggcatttctgaggagcgggtgagaaccctcgatatccaaaaatggatcctgtgggaagaactgagccatgacgctgccgatcgccggtgcccgtactccggggtccagattagcgcttctatgctcctgggagaaagagtggagatcgaacacattcttcccttctccatgacactggacgatagcctcaataaccggaccgttgccctgcgcgaggcgaatagaatcaagcggaaccgcgccccttgggaggctagagccgactttgaagctcagggctggtcttatgatgggattctgcaacgggccgagagaatgccccttcgcaaacggtacagattcgcccctgacggatatgaacgctggctcggcgaggataaggactttctggctcgggcgctgaatgatacgagatacctcagccgcgtggccgctgaatatctgcggcttgtctgtcccgggtccgccacaagagtgatcccgggccagatgaccgccctgctccgcggaaaattcggcctgaacgacgtgctggggcttgacggagagaagaatagaaacgatcatcggcaccatgctgttgacgcctgcgtcatcggcgtgaccgatcagcgcatgatgcagagattcgcgcaagctaatgcccaggcccgggaggacgggctcacacgcctggtggaagatatgcctctgccctggcctacctacagagaccacgtcgagcgggctgtgcaccatatttgggtttctcacaagcccgatcatggatttgaaggcgccatgatggaggagacaagctacgggatcctcagagacggctccattaaacagcgccggaaggcggatggaagcgctggcagagaaatctctaacctgattcgcatcgccgagcctgggcagccccaacggcacggagtggacgccgaaggcagaccgcttccttataaagggtacgtcggaggctccaattattgtattgagatcacggtgaacgataaggggaaatgggaaggccaggttatcagcaccttcgacgcttaccggattgtgcgcgagggaggcctgagacagctccggcaccccacacaggggcaaaatggacgcgccctggctatgagactggtcatcggcgattctgtgcggcttgaggccggggaaggatccctgcagaccctccgcgttgcgaagatgagcgccgctggccaggtgtttatgtccgaggtcaaccaagccaatgtggacgctagaaaccggaacggcgacctgccctatgtgtctaagatggccgggagcttccagaaagcccgcgctagacaggtcacaatttcccctatcggagaactccgggatccgggctttaaggggtga

SEQ ID NO: 3779 - RNA, 3135 nt, synthetic construct
  misc_feature 1..3135: note = Cas9 variant
  source 1..3135: mol_type = other RNA
atgaagtacaccctgggcctcgacctggggtataacagcatcggatgggccattcttgagaatgatgaaaacggctcccccatcaaactgttcaatgctggggtgcacatttttgagccttctatcgaagacattgagatcgatggaaagggcaaaacaaagaacgtcaaaagacgggaagcccgcctcagacggcgccagctgttcagaaagacgaagcggcttgagaaactgctcaactttttcatccaagaggggtttttccagaatcagaaggttctgattaatgacccgtttgaacgcgcggagttcctgtaccagctcgataaaaagagcagaaacccctatatcctgcggcgcgaagctcttgacaatagactgtccctcgaggagattgcccggatcttttaccatattgcccaacaccgcggattcaaatctaccaagagagaactggctgagatgaacaaggatgaaaagaagaaaaaggaggacggcatcattcagagcgaaatcaatacacttaaagaggagatcaagaaaaactcctgccggaccctgggcgaatattttgccaaactcttcgagaatggggaaaagattcgcggaagacatacagatcggaaaatgtacgaggaagagtttcagaagatcttcaacaaacagaaggagttctatcctaatatttttaccgacgagttcaaaaagaagctgtacaaactgatctttcaccaaagagaactcaagtctcagaaagataaggtgggcttctgtagcctggaacgcgggaaaaagcgggctccccttgccctgctcgtgtcccagagataccgctatatgtgcaaggtcaacaacctgaatgtgattgacacagagaccggagaaaaccgggagcttacggttgatgagaaaaagaaactgtacgaaaagctcgagaatagcgaaaaactgtcttttaaggagatcaagaaaatcctgaacctctccgagaagagatatattttcaatctggaaaagagcgagaagtacatcattggcaacaaaaccaatgtgaagatgaaaaacatcattaaggactgggacaattttgatgaagacaagaaaaacttctttatcaatgaggcgcgcacagtcgtgaagatcgaaacccttgagcggagagggaaaaagctgggactctctgatgaggaatccaaagagttcagcaaggttgtgtttgaagacggctatctgaacttctctaagaaagccgtcgagaaacttctgccttacctcaaagaaggcaagaaagagtatgaggctattaagctggcctaccccgaaaattccgtgcagaacgataatctgaaggagctcgactttctgcctccgatcaaaagcaaggaacttaaaaagtacttcgaggtgcgcaaccccattgtcgaaaaagctctgacagagacccggtatctcgttaacttcctgatcaagaagtacgggaaacctgagacgattaagatcgaactggccagagagcttaaactctccaataagcaaaaagaacgcaagcataaagagaaccaggagaatcggaagaagagagaagaggtgattgaaaaactgaagaacgatctgaaaatctctgagcccacagaaacccagatccaaaagtatctcctggcggaggagtgtgactgcaaatgtccttacacaggacggagcatttccatggatagcctttttggcgaacaccccctgttcgacatcgagcacattatcccgtttgatcgctctctcgacaattccttcctgaacaagaccctgtgctatagcgaagagaatagaaaggtgaaacataacaagaccccttacgaagcctattacgggacagagaaatgggaggctattatcgaacgggtcaagaaatttaagtctaatgtgagaaacgagaaacttcgccggttccagatgacgaaagaagacgttgagaattacatccagaactttagcacccagaatctcaacgatacaaagtatgcctccaaactggctaagaaatacctgggactcctgtatggctctattaatgaagacgggatcgataagaacagaaagcgcagaattttcgccagctccggaaaagtgaccagcacacttcggtacgccctgggcctcaacaccatcctgaatgacgagaacattaagacgcgcgaggatcacagacatcacgctatcgacgcgatcacaattgccctgaccgattcttccatgatcaaaaagattagcgacgcttctaaacgggaaaagaatatcaactccctttttaaggatttccaagccccctgggagaattttcgcaaagaagtcgaggagattatcgccaagatgaacatcagcattagaatcaataaaaaggtgtccggccagattcacgacgaaaccttctataaaaagccttttaaagaggaagagaagtcttacacacatcagcggatcaacctcgaggaactgaccattaaggatgaggacaaaaagaaacagagctccaagctgatcgataatattgttgactctaaaatccgcaacatcattatcaatagcctcaacggggaaaagcccaagattagattcaaagaccccaaggatcacccttatatcattcaaaagaatggaaagaaaatccagatccataaggtgacaattaagacgaaactggagacctacaacgaaatcggcccggagaaggctaaacggtacgtcaagtccagcgactctcaccatattgaaatcttcgaggatcttaaaacaaagaagtgggacgggtatgtggtctccctgctcgaggcctacgaacgcaaaaagaaaaagctgcccattgtgaataaaaacctgggagagggcaagaaatttcttttcagcctcgcgaagggggaaatcatcgagctggataccgaaaacggcaagagagagctgtttgttgtgcggattatctctgcttccaataaccagattaaattcacaagaatcaatgacagccgcaagattaccgatatccctgccacgggactcaccgcctgtccctctagcctgaaaaagcggaactgcaaaaaggtcgtgattaatatccttggcgagaagcactattccaacgactga

SEQ ID NO: 3780 - RNA, 3135 nt, synthetic construct
  misc_feature 1..3135: note = Cas9 variant
  source 1..3135: mol_type = other RNA
atggccgagaagaaattcaagtacagactgggcctcgacctggggaccaacagcatcggatggtgcatgcttcggctgaataaagataacgaacccgctgccgtgattaagtccggcgtccgcatctttcacgacgggagaaatgagaaaacaaaggaacctctcgcggttgtgcggcgcaacgctagatctattcggcgcaatctggatagaaagatcagccggcgcaaccatcttctgaatacgctcgtgaaatatttcctgctgccgtccaacgagattgaaagaaaggccctcgccgtcctgaatccctacgagcttcggtctcgcgctgtgaacgagagactggaactctttgagctgggacggcttctgatgcacctcagcaaacgcagaggcttcaagtccaatcggaaagttgacaaggaagattctagcgggaagatcaaacctgccatcgagagactgaagaacaaaatgcaggagaccaataagaaaacagctggagaatatctgtactccctcatgcaaaacggcaagcccgtgcgcgcccggctgggcagaattgacgggagcaatggatatgagatctaccttgatcgcgcgctgattgaagaggaatataacctcatcatgaacgagcagaaaaagcatcacaaggagctgaccgacgatattatcaatgaaatttttaacatcatcttctaccagcggcctcttaaaaagcagattatcggcaaatgttctctgacaggggaggacaccaagctcaaaaaggcccatgtcctggctcaagattttattctgctccagaaggtgcaggacctgagagttttcgatgacaatcagcttgaatttcgccccctgtccaacgacgagaaagatatcattaagcgggaactcagaaagaagaaagaggtgagctacgagaatatccgcaagctgcttaagaaatattacgaaaacgtcaagtatggaatgttctctcacgagacactgtacaaaaagctccaaggcaataaaaccaacgccctgatgtccgacaaggaaatcattggggatagctggtattctctgtcccctgaggtgcagtacgacatcattgaagaactctatagcgataaggacaatgatgagctgtccaaactttactctgaaaagtttaacctgaatgagagccagatcaacggactcctgaataaagctatttaccggctggactccggctatatcagatacggcaagacggccgtgaccaaccttaatagcatcatggataaagacaacctcaacctgcacgatgcgcgcgaagaggccgggtatgagaaggaaaataaacaggacgcttctgagtacctggaatattacggaaaggtcctcccggactccgttgtggatccccaaattgagaaccctaagaatgacgaggagcggtatggcaaaatcgccaaccccacagtgcatgctgccctgaatcagcttagaaagctggtcaacgagctcattaaactgtacgggaagcctgaacagatcgtgattgagctggcccgggatcttaaaaatagccgcaaggctaaggacgttatcaacaaaaagattgcggaaaatagaaaactcaacgaggaagtggataagaccctgcaagagtactctgagaaatataatacacacatcgtcaagaacaagctgaatcgggacaaagtgaagctctggagagaactgggaaaagatccccttgagcgcaagtgcatctacaccggcgaacagattaacatcgccaaactgttcagcgacgaggttcagattgaacatatcgtgccgtattccaagacgctcgatgactcttttaataacaagacactgagcatgaaacaggctaactactataaggggaataaaaccccttacgaggccttcaaggattccaaagacggatataactacgatgacattatcgcccgggctaagctgcttaataacgacaataaattcaagagatttacaaaggatgccatggacatctacaaccgcgatggcaaagacttcattgcgagacaactcagcgatacccagtatctgtctacccgggctctgatctacctccagtccctgtatgagaaggcccaccacagctctatttggacaatccccggccagcttacggccctgattcgcaattacctcgggctgaacaccctgatctccaatgacaaaaacaagaatagaaacgatcatcggcaccatgctgtcgacgcctttgtggtcgctgtgacaagccgctcccttctccagaaaatctcttatgccgcgagcctgcaagaagatctggacaatagaaacgtttcctcttaccggaataagctcctggagaagatgcctgaacccttccccaactatcgcaaaagccttgagctggccattgataacatcaagacctcccacaaagctgacagaagcatttctggaaagctccatgaggatacagcctacggcatcgtggaaaatgacgacaaatacaacgtcgtgacccggtggacggttgataagtttaaggagcagaaacacttcgaaacaattcgcgacaatgagctgaaggaaatcgcttgttccgataaagagctgtttgccaagatcgtggagaccagaaaaattaagagcatccggaaacttgcgaaagaaaaccctgtcattaagatcaaagacaagtctgggagagattataaagccttcgctggaggcaataacatttgcgtggagatctacgaagtggacggggttcgcaagtccgaggtcattcagctgtttgatgccgctcaaaagggcttcatgccggaatggatgaaaaagtatcccaatggaaaactcctgatgcggctctttaagggcgacgtgatcgggttcatcgagaacagaaaatacaattattacaccattaagggaatcagcattgccgatcagaacctgaaacttctggccatcaataaggctgagggcatttttaagaaagggctcaacatcctgttcgactctaataacaagaatagcctgaacgcgaaacagttcaatatctccgtgacaggaattgtcaccaagaaaaagacagccgatgtgaacttttggaagaaccgcaaatga

SEQ ID NO: 3781 - RNA, 3135 nt, synthetic construct
  misc_feature 1..3135: note = Cas9 variant
  source 1..3135: mol_type = other RNA
atgctgcacaagatgagataccggctcgccctggaccttggcagcacctccctggggtgggctatggtgcgcctcaacgccaatcagcaaccctgcgcggtcatcaaagctggagttagaattttctctaacggccggaatcctaaggatgggagctccctggccgtgacacgcagagaggcccggtctatgcgcagacggcgcgacagacttctgaaacggaaggctcgcatgatgagaacgctcatcgaatatggatttttcccggccaacgagacccagcggaaagctctggaaaatctgaacccctacgccctccgcgcgaagggcctggatgaggcccttacacctagcgaatttgctagagccctgttccatattaatcagcggagagggtttaagtccaaccgcaaaaccgacaagaaagattctgacagcggagctctcaagacagccatcaaacagctgcactccgtgcttgatccccaaggcaatgacggcaagcctcggaccgtcggggagctgctctataagagattcacagatctgagcaaactgcccaaggaccgcaccgtgcgggcgagataccgccaggataaaattgttaaggacgatggaaaaacgaagatcgacaaatattacgacctctatatcgatcgggccatgattgagcaggaatttgacgctctgtggaagaagcagtctgagcttaaccctatcctgttcaccgaaaatgccagagctgatctcaaagacgtgctgctttaccaacgctccctgaagccggtcaaacccggccggtgtacatttatgagcgaggaggaaagagcccctctcgccctgccctctacccagcgcttccggatgtaccaggaggtgaacaatctgcggattctcagagaagggctgaaggaggaatcccttacactgcagcaacgcgatgacctcatcaacgctctggagaaaaataacagacggacctttacgcagattaagaagctgctgggagttggcgggagcgtgcagttcaactttgaggatcctaaaagagaggaactcaagggaaatacaacctctgcgatcctgggcaaatccgaacatttcggcgaggcctggttcgcttttaacgaagccaagcaagacgccattgtcctgcagctcatcaaagaggagaatgaagctaagctggtgcgctggcttcaggatgagacagggatcgacgaaaagcgggccgaggtgattgcgaacgctggactgcccgaaggctatgggagcctctgcatcgaggccctggcccgcattctgccggagcttagaagagatgtcgttacctacgacaaagctgtgcaggccgctggattcgaacaccattccaagctcaatcggaacgaggaaatccctgacattacctttaaaatcgagtctatcgatcgcaatagcggcgagattaagcaattccaccttcacaaagaactgccctattacggggagtatctccagagacatgtgggatttggctccggcaagcctgaagacagcatcgagaagcggtacgggaaaattgccaaccccacagtccacatcggactgaatcaggtgcgcgttgtggtcaacgcgcttattaagagatatggccatccctctgaaatcatcgtggaggttgcccgggatctgaaacagtccaaggaccgcagagatgaggaaaataaacggcaagctgagaaccagaagcgcaatgaaagactccggaaagacattgccgatatcctggggattagcgaggaaagagtgcgccgggacgatatcgagaagatgattctgtgggaggaactttctttcgaccctgctgatagacgctgtccgtacagcggagtccaggtgtccacggtcatgctcctgtctgacgaggtggaagttgagcacatcctgccctttagccagaccctcgatgactccctgaacaataagacagtggcccttcggcaagcgaacagaattaaaggcaaccgcaccccttgggaagccttcgggacaagcaatatctctggctttgactactccggaatcctgacccgggctgagctcatgcccaaggccaaaagatatcgcttcgctgaggatggctaccagcggtggctgaaggacgatgccgggtttctggccagagctcttaacgacacgcggcacctcagcaaaattgcgcgcgaatatatgtctctgatctgccctaatacaagagtcattcccggacagatgaccgccatgctgcggcgcaacttcggcctcaatgatgtgctggggcttaacggagagaagaatagaaacgaccatcggcaccatgctgttgatgcctgtgtgatcgccgtcaccgaccagggcctgctccaaagatttgctgccgcgtccgctagcgcccgcgaacggcagctgaatagactggtggagaacatgccgcttccttgggagtcctaccgcgaacacgtgcggagagccattgatgggatctgggtttctcatcgccccgaccacagccacgagggcgctatgcataatgatacagcctatggactccggggcaacgggagagtctccttccacaagatggtggaaggaaaacgcgagtacatcgaagacaatctgaaggtgattgagatcaccgatacaaaagcgattgacagacatggcctgctccctacggggaagccccggccttataaaggatacaagggcgactctaactactgcatcgagattgtccgcaatgaaaaggggagatgggagggcgaaatcatcagcaccttcgatgcttatcagctggtgcggaaatacggaattgttcaacttcgctatcccgtgctgtccgtcagcggcaagccgctcgtgatgagactgatccggaacgactttgttagactggagcacgaagggattacacgcacccttcgggtgtgtaaaatgagagaggatggacaggtcgccctggccgacgtgacagaggctaacgttgatgcccgcacccggacgaaggaaatctgctacgtgttcaaaaccggcgggtctctccagaaggctaaggccagacggattacaatctcccctatcggagagctgcgcgaccccggctttaaagaatga

SEQ ID NO: 3782 - RNA, 3138 nt, synthetic construct
  misc_feature 1..3138: note = Cas9 variant
  source 1..3138: mol_type = other RNA
atgcagaaggagaaacccctggcctacagactcgctctggaccttggcagcacctccctggggtgggccgtgctccggctgtctgcgcctggagaaccgagcgctgtcatccgcgccggctccagaattttctctgatgggcggaaccccaaggacggaagctcccttgccgttacacgcagagctgcccgggctatgcgcagacggcgcgatagactgctcaaacggaaggcccgcatgctggcggccctggagagacacggctttttccctcaagacgaagctgcccggaaagctctcgagaagctgaatccctatgggcttcgcgccagaggactggaatctgcgctcaagcctgaggagtttggccgggccctgttccatcttaaccagagacgcggctttcagagcaatcggaaaacggatagaaaggactccgatagcggggctctgaaacaggccatcggaaccctccgcgctcaaatgcacgaatctggctgccggacagtgggggagtggttctggaaggtgagaatggaacgcaaacccgagggagtcaagggccagggggtgcgggccagataccgcgagaccccttttacaaccgacgaaggaaagaaacggattgataagagatatgacctgtacgttgatcgcgccatggtggctcaggagttcgacgcgctgtgggccgctcaggccacatttgccccggctctcttcaacgaagccgcgcgggctgagctgagagatatccttctgcatcaacggaaactccgccccgtccagcctggcagatgtaccctggtgcccgaagaacctcgggcccttctggccctcccctccacgcagagatttcgcatttatcaggaggttaatcatctgcgggtgctgcacgacgaactcagagaggaagctctgacccttgcccaacgcgaccagatcgtcgctctgctcgagagacaggccaaggtgacattcaccgcgatgcggaaagccctgggctttagcgctcttttcaacctggaagatgccaagcgcgacgggctcaaaggaaatgctacaaccgccgcgctgggcaagaaggatctgttcgggccgctctgggccggatttgacacggctctgcaagatgagatcgtgacacagcttatgaccgaggaatctgagcctagactgattgcctggctccaggaacacacaggcgtcgacgaggctcgggcccaggccatcgctaacgcggggctgcccgaaggatacggctccctgggccgcaccgcccttgctagaattgttcctgagctccaacgggatgtgatcacctatgacaaagccgtgcaggccgctgggttcgcccaccatagcgatctgggattttctttcgagcacgacgcggatgaagtcgagcgcattggcgaaagaacaatcgcttccacgggggagattaagcccgtgtttgccttcaaacagctgccctactacggacgggccctccagcgccatgttgcttttgccaaggagaatcctagaaacgacgaggagcggtatggcaaaatcgcgaatccgaccgtgcacatcgggctgaaccaagtcagagtggttgtgaatgctcttatgtgccgctacggccggcccacagaagtcgtgattgagctggccagagacctcaagcagagccgcgaacagaagctggaggcccagcaacggcaggctgataaccagaaaagaaatgcccgcatccggagatccattgctgaggtcctgggaatctctgaggagcgcgtgcggacccttgacattcagaagtggatcctctgggaggaactgagccacgatgccgcggacagacggtgtccttattccggcgttcaaatcagcgcctctatgctgctcggggaacgcgtggagattgagcatatcctgcccttctccatgacacttgatgacagcctgaacaacagaaccgtcgctctccgggaagccaatcgcattaaaagaaaccggacgccttgggatgctagaacagactttgaggcccacggatggtcttacgatggcatcctgcagcgcgccgaacggatgccccagagaaagcgccatcggttcgctccggacgggtatgagagatggctgggagaagataaagactttcttgcgcgcgccctcaatgatacccggtacctgagcagagtggctgccgagtatctgcgcctcgtttgccctggctccgccaccagagtgattcccgggcaaatgacagctctgcttcggggcaagttcggactgaacgacgtcctcggcctggacggggagaagaatcgcaacgatcacagacatcacgccgtggacgcgtgtgtgatcggagttaccgatcagcggatgatgcagcgctttgctcaggccaatgcccaagctagagaagacggcctgacacggcttgtcgaggatatgcctctcccctggcctacgtacagagcccacgtggaacgcgcggtgcggcatatctgggtctctcacaaacccgaccatgggttcgagggagctatgatggaggaaaccagctacggcattctgagagatgggacaatcaagcagcgccggaaagccgacggctccgccggaagagagattagccggctgatccgcattaccgaaccgtctcagcctcagagacacggcgtggatgctgaggggcggcccctcccctataagggatacgttggcgggtccaactattgcctggaaatcacagtgaatgacaaaggaaagtgggagggccaagtcattagcaccttcgatgcctaccgcatcgtgagagaagggggccttcggcagctgcgccactctacgcagggacagaacggccaagctctcgccatgagactggttatcggggactccgtgcggctggaagtcgatgagcaggaacgcgtgatgagaattgttaagatcaatggaaacaatggccaggtgtttatggcgcctgtccatgaggccaacgtggacgctcggaatagcgacaaaaacgaagccttcgcttatacctccaagattgccgggtcttttcagaaaacaaaggccagacaagtgaccatcagcccgattggagagcttcgcgatcccggcttcaaaggctga

SEQ ID NO: 3783 - RNA, 3138 nt, synthetic construct
  misc_feature 1..3138: note = Cas9 variant
  source 1..3138: mol_type = other RNA
atgaagcccagaaacctgaattacatcctcggcctggaccttgggattgccagcgtgggatggtccgtcgttgagatcgatgaaaacgagtatcctattcggctgatcgacgtgggcgtgcgcaccttcgaaagagctgaggtcccgaaaacaggggaatctctcgccctggcgcggcgccttgctagaagcacgcggcgcctgattagacggcgcgcctttagactcctgaaggccaaacggctgctcaagcaccatcagatcgtgaatgctgaggagctgacccaacttcccaaccagtgctgggaactgcgcgttaaaggactcgattccctgctttctaatacagagtgggccgctgtgctgctccatctgctgaagcacagaggctacctcagccagcggaagaacgaagcccagaatgcggacaaagagctggggaagctccgcgagggaatggataacaattccaaactgctcctggaaaacaattatagaacccctgccgacatcgctgtcaagaaattcgccgtggaggaaggccacatgcggaaccaaagaggcgcttacacacatacctttaatcgccttgatattctggccgagatgcagctcctgttcaagacacagcgggaactggggtctacctatgcgaacggagagctcgagcaggccttttgtgaactgcttctgtggcaaaagcaggctctcaatagaagccagatgctgtcccttgttggcaaatgcacgttcgagaaggaagagaaacgcgccgctaaggccagctactctgccgaacggtttgtggctatccagaaactgcaaaacctccgcattctggagaacggggaggaaagaggactgttcgactccgagtttagcctcctgcttgaaaatgcgtataacctgaagtctggcctcacctacaaacaggtccggaagatcctgtccctgagcgagaatgccattttcaaggggcttccctacctctctgatgacctggaaaaacctgagaagacacagtttctggctttcaaattttatcaccaactcgccgatatcctgaagaacaatggattctccgacgagtggcagaaacttagccaggaacccaccctgctcgataagctgggcacagagctgtccctttgtaaggaagagaacgagttcattgcccagtttaatggcgaactccctgaggctatgctgtctaccctgttcaaccacacgaattttgacaaattcatccatatcagcctcaaggccctgaacaatattcttccgctgatggaacaagggaacgactacacaaaagcgtggagaaaggtgtatcccgagcctaccaaaaaggatgaaaagacacttccccctatccccgctgacgagattcgcaatccggtggtcctgcggtccctgagccaggccagaaaagttatcaacgccgtgattcgcctttacggatctcctgctcggatccacatcgagaccgccagagaactcggcaagtcctatgatgaccggcagaaaattaagaaacagcaagataagaatagcgacgagcgcgatcaggctgtgaagaaatttctggaagagtgccccaacttcgccaacaaggtcaaagggaaggacatcctgaaaattagactctacatcaatcaggatggaaagtgtctgtattctggcaaacctcttgacccccatcggctgctcgaaattgggtacgtggagatcgatcacgcgctgccctttagcagaacctgggacgactcccagaacaataaggttctggtgcttgccaacgagaatcaaaacaagggaaatcagacacctttcgaatggctcggcaaagatgagcaccagtgggctctgtttgtcgcccgcgtgaacggctgccggttcccgtacgctaagaaacagagaatcctgacgaagaaactcgacgaacaagggtttctgaagcgcaatcttaacgataccagatatgtttctgcctacctgatgaagcatattaaagagaatctccacctggtgggaaagggcagcgacaaagtcttcgcgtccaacggacaggtgacaaattttctgcggcgctgttggggacttgaaaagaaaagagaggagggcgatcggcatcacgccctggacgctatcgtcgtggcctgcagcaccgcttctatgcgccagaagattacactcttcaagaaatatcaaagatggaacctgaagaccgggaaacatatcgatcaggaaacgggcgagattatccccctccacttccctgccccctgggactttttccggcaggaagttatgattcgcatcttttccgagatgcctcaggaggatctgatcatgcaacttcccgacagaccgcaggccaatcacgagttcgtgcagcctctgtttgtcagccgggctccctctcgcaagatgtccggacagggccatgaagcgaaactcagaagcgcccggatgctggaagctacagggaagtccattaagaaagagttcctgaccgatcttaccatcaagaacctggaacacatggtgaacaaagagagagagcctgaactctaccaagccctggttgagcattttaagaaatatggagacaagcccaaagaaaagttctttaagaaaggcggggtggaggtcaagtctattcgcatcagcaaaacacagaataagtccgtgaacctcggaaataaaaccattgccgataacggcgacatcgtgcggacagacctgttccttaagaataagaaatactattttgttaacatctacgcttggcaggtctctaaggggattctgcctaaagaaacgaccacaggcaatatcctcgataacagctacgagttccagttttccctgttcaagaatgacctgcttgagattccccacccgaaaaacgaaaatgatagcatcctggcctatttcattagacctgacgatgagcgccggtggatcctcaagtttcacgacaacgcgaagatccccgatatttacgggaaaaaggacgaaacctctatcagactgtccattcaaggccagaaattcatcaagaaatatcaggtggatgagctcgggaagaatattcgcccctgtcggcctacaaagagacaaggagtgcgctga

SEQ ID NO: 3784 - RNA, 3141 nt, synthetic construct
  misc_feature 1..3141: note = Cas9 variant
  source 1..3141: mol_type = other RNA
atgaagatctacagcttcgacattggcgtggcctccatcgggtgggcttttattgagaacgaagtcctgcaggattgcggaatcagaattttcaccaaagccgagaatcccaagaacggcgcgtctctcgctctgcctcggcgcgaagccagaggggttcggaaacgccttgccagacggcgcggaagactgaatacaatcaagcaactcctgtgtaaagagtttggccttcagctggaagactatctcagcaacgatggggagctgccgaaggcttacacggcctccaaggctaatcccctgaaatctccttatgagctccggaccctggcccttagccagaagctggactccaaagatctcgtgcgcgtgatcctgcacattgcgaagcatagaggatacggcaacaaacacgccaaggactctaaggatacagaaagcggcaaagtcaagaaagctatcgagttcaatcggaagacccttgccgaaaaagggtatcgctccgtgggagagtacctgtatagagagtttttccagcaaagccggatttctcagaacaatggcgctacagaatttgttaacgtgcgcaataagaccgggaactacgagcattgcgtcgcccaggacatgctcaaagatgaactggagctgatcttcagaaagcagaaggaactcggactgcacctttccgacggctttgagaaacaactgctcgataagattttcgagcagcggcccctgaaatcctttgcggacaaggtggggaaatgtcagttcatcgccggagctaagagagcccctaaggattctatttccgctatcgaatttgttgcccttagccgcatcattaatacactggccaacctctctaaaaagtccggcgagatgtacgacaaagctatggtgctgaccatcctggacagcgtcctcgaaaagggcgagatgtcctattacgcgctgcgggaagccattaatcttgatgagaaaatcagattcgctgactctcgcctggattatagcaaggagattaaggaaacggagaaagtgaagttcgtggaatgcaaaaacctcaagtcctttaaaaaggtcctggggaactgttacaagacccttgagcggaaacatatcgacagcatcgccgaaagaattgccgttatcaaggatgtggagaaactgcacaaggagctcgaatcttattgcgctacagagcagctgtccctgaccagcgaacaaattcaggccctctctcacctgaatttcagctcccatatctctcttagcctgaaagcgctcgagcagattctgccctttatgcgcggagagcgggaagctagatccagcgacgccgattactgtatcggcatcgacgagtctggggaatcccaatgcctgcgctatgatgagagcgtggaaaaggccggacttaaagctctctctaaggacacactgaagggccagattctgcctccgctcaacgagttcgagccctacctggccaatcctgtcgtggctcgggcccttgcggaatacagaaaagttctgaacgccctcctgaagcagtatgggagcccccacaaaatccatattgagtacgctcgcgaagccaagctgaataccacggagcggcagaaatatgaaaaggagcaaaaggataactacgctgccaatcaggcggcccacaaaaagtgtcaggagcttggactcgaacctagctccacaaacctgctgaaactcaagctgtggcaggagcaaggcggcctttgcctgtattctggggctaaaatcaccattagctacctccaggaccccacagcccttcaggtggaccacatctatccgtactccagatcttttgatgacagctacatgaataagtgtctggtcctgaccaaggctaaccaggaaaaaggaaatcggacccctttcgaggcctttggcacagattccgccaagtggggagtgattacgaccctcgctcaaaaactgccccataagaaacgcagacggatcctgaacacagcgttcaatgacaaggaagccggatttaagctcagaaacctgaatgataccagctatatcgctcgccttgttgccgactacacagagacctatctggagttcctctctctggtggaatccgagaacacgacactgggcaaagggcagaagggcagcaaaaagcacattgccatcgtcaacggagctcttacctctaccatgcggtactatctcggctttgcctccaaagatagagacaatcatctgcaccatgcgctggatgctgtgattatcgggttcatgaacgacagcgtcattaaggccttttctgatttcaaaaagacacaggaaaccagcaaggccgcttactatgcccacacactctccaaacaggagtacaagaaacaacgcgcgttcatccagctgcctagcggagagaattttagagctaacgtgcttgaaaaggccgagtctgttttcgtgtccaaacctccccggaagcgcgtcagaggcgccctgcacgaagagagcttttactcccagaatgacacgaagctcctgaaatcttatgggggagctgaaggcatcgagaaggccctgcaacttgggaaaattcggcagatcggcaccaagattgtgagcaacggagctatggttcgcgtggatatcttcaaacatagaaagtccggcaagttttacggggtccccgtgtatacaatggacttcgccctggggattctcccgaataaagcggtggttcagggcaaggacaaaaacgatgtcatcaaggactggctggagatggattctagctacgaatttatcttctccctctataaagacgatctgcttctggtgcagaagaaggagatggccgaacccgagctctgctactttgtgtctttcgacaccagcggggcttccattaaagtcgccaagcacgataataactttagcacactgaccgaaaatcaaaaactgcttttctctaacgctacgaaggaggaggtggttggaaaatccatcggcattcagaatctgaaggtgtttgaaaagtggcaggtcagcgtgctcggggaggttaaacggacccagtcttatcctcgcgaaaacatctccctggccagcaaggccaaaaagtga

SEQ ID NO: 3785 - RNA, 3144 nt, synthetic construct
  misc_feature 1..3144: note = Cas9 variant
  source 1..3144: mol_type = other RNA
atgaagctgctcagatacatcctgggccttgacctggggattgccagcgtgggatgggctatcgtcgagattgatgaaaacgacttccccatccggctcattgatatcggcgttcgcacctttgacaaagccgaggtgtccaagacaggggaatctctggcgcttgctagacggctggcccgcagcacgagacggctcatccgcagacgggccttccgcctgctgaaaggaaagagactcctgaaacagcacaatgtgattaacaaggaggctcttaccacactgcctaccgattgctgggccctccgggtcaagggcctggacgaacgcctttccccgacagagtggtctgctgtgctgctccatctgctgaaacacagagggtatctcagccaacggaagaatgaggccaaatccgcggataaggaaatgggagccctgctttctggcgttgctagcaaccatcagctgctcgtggagaatcagtttcgcacccccgccgaaatcgctgtcaaaaagttcgccctggaggagggccacattagaaaccagcttggggcgtacacacatacctttaatcggctggacctcctggccgaaatgaagctgctgttccaaacgcagagagagctgggaaaccctcacacctccggccagcttgaacaggagttttgtgaactgctcatgtggcaaaaacccgctctgagcggggatgccatccttaagatgctgggaaaatgcacattcgagaccaatgagtataaggctgccaaacactcttacacagccgaacgctttgtgtggctcaccaagctgaacaatctgcggattctcgagcatggctccgaaagagttctgaacacggacgagcgcagccttctgctcaatcagccttatgaaaaagctaagctgacatacacccaggtgcggaagctgcttgggctctctgaggaggcgagattcaacggagtccgctatggcaaagaaaaggccgaggatgctacactgatcgaactgaaagcctaccacgccattcggaaggctgtggagaaagccgacaagtccgcgtgggaaaccctcaagaatcagaccgctctgcttgatgagatcggcacaacgtttagcatctacaaaaccgacgacgatattacagagcaactgaacgggaagctctctgacaccgtgctgaacgccctgcttgaaaatctcaacttcgataaatttatccagctgtccctcaagagcctctataatattgtccccctgatggagcagggacttagatacgacgaagcctgtcaacagatctatggcgatcatttcgggaaaaagtccggagagattaaccgcctgctccctccgatccccgctgacgagatccggaatcctgttgtgctgagatctctgacacaggcccgcaaggtgattaacgctgtcatccggctttacggcagccccgcccggattcacatcgaaaccgcgagagagctcgggaaatcctataaggatcgcaaagaaattgagaagagacaggaacaaaatcgggccgagagagagaaagctacggcccagttcaagacactgtttcctaccttcatcggagaacccaagggcaaagacatcctgatgatgcgcctctacgagcagcagaacggccaatgcctgtatagcgggaagccgcttaatctgaaccggctcctggaaaaaggatacgtggagattgatcactctctgcctttttccagaacctgggacgatagccagaataacaaggttcttgtgctcgctggcgaaaatcagaacaaagggaatcagacacccttcgagtggctgggaaaggacgagcatcaatgggccctgtttgtcgcgcgcgtgaacggctgtagattcccttacgccaaaaagcagcggatcctcacccagaagctggacgaacaggggtttattgagcgcaaccttaatgatacaagatatatcgctcggttcctggttaactttgtgcgcgaaaatctccacctgacgggcaaaggaaagaacagagtcttcgcctctaatggccaaattaccgcttttctgcgggggcgctggggacttagcaaagtgagagaggaatccgaccggcatcacgccctggatgccgtcgtggttgcttgctctacagtggcgatgcagcagaagatcacccgcttcgtcaaataccaagagggcaacctccagacagccgagagaattgaccgggaaaccggggagatcatccccctgcattttcccgatccttggcacttcttcagacaggaagtgatgattcgcatctttagcgagaatccgcaggaggacctcattatccaactgcccgatcggcctgaagctaaccacgagttcgttcagcccctttttgtgtccagaatgcctacgcgcaagatgagcggacagggccatatggaaaccattaagtctgccaaacggctggacgaggggatctccgtcagcaaggtgcccctcacacagctgaaactgaaggatcttgacaatatggtgaacagagaacgcgagaaagccctgtatgaggctctcaaggcccggctgaatgcgttcaacgatgacccgaccaaggcttttgccgaacctttctacaaaaagggcggacaacaggttaaagccgtcagagtggaacaggtgcagaagtctggcgtcgtggttcgcaatgggaacggagtggctgataatgcctccatggtccgggtggacgtttttatcaaaggcgggaagtatttcctcgtgcccatttacacatggcaagtcgcgaagggaatcctgcctgacagagctgtggttgccgccaaagatgagagcgagtgggaacttatggacaagaccgctcagtttctgttctccatgtttcccaacgatctcattcaggtgaaaacgaagaaagagacattctttggctattacaacgggctggaccgggccaccggcgctatcaatctgaaggagcctgattctaacattaataaaggaaagagcggccttcaccgctccatcggggtcaagacagccctgtctgtggaaaaataccaagtggacgagctcggaaagaacatcagaccctgtcggccgagcaaacgccaggcggtcagatga

SEQ ID NO: 3786 - RNA, 3147 nt, synthetic construct
  misc_feature 1..3147: note = Cas9 variant
  source 1..3147: mol_type = other RNA
atgaagagactgggcctcgacatcgggaccaacagcattggatggtgcctgatcgaggatgacggcgatgggaaaggacggattatcgacattggcgcccgcatcttctccgatgggagagaccccaagtctggagctagccttgccgtggatcggcgcgcggctagagccatgcggcgcagacgggaccgctacctgggcagacggacagcctttctcaaagctctgaagcgcttcggccttatgcctgccgatgaatccgctgccaaactgctcgcggacagagatccgtatgagctgcgggcccgcgctctggacgaaagactcgagccccacgaaatcgggcgggccctgtttcatcttaatcagagacgcggattcaagtctaaccggaaggctgagagaaaaacgaaggatgccgaggacggcaaaattgcgaatggggccaaggctctggaccaagccatggctgaaagcggagccgagaccctcggccagtttctgtcctctcgcgatacaaaacgggtcagaatggggagcgacgcccagggatacgatttctatcctcagcgccggcacgttgaatacgagtttgacaccatctggtccagacaacagcagcatcaccccgcccttctgacagaggaagcgcgcaagaagctccatgatattctgttctttcagcggcctctgaaagagcaagaagtgggcgtgtgtaccttcgtccacaacgagtgcagactccccaaggcccaccctctgtttcaggaacgccggctttatgaggaggtgaatcagctggaaatcacaaccccgggcgctcccaacagaaaactcacgatggacgagcgggatgccctgattcttgaactgcgcagcagaaaggagcggtctttcgactccctcgccaaaagactgaagctggctcctgggcagagctttaataaagcctctgaatcccgcacccggctcagaggagatgaggtttacgcggtgatggctcataagaagcgcttcggcgacagatggccccacctggatcgggaccgccaatgggccatcattaaaagaatcatcgaggaagaggaccctgataaacttcatgccttcctgacaggggaatggggactcaccgacgagcaggctctggccacagctcgggctccccttccggaactgtatggccgcctcgggcctaccgcgacggcccggattctggaggagctgaagaaggatgtcatcacatacgacgaagctgtgcggcgcgccggatggcaccacagcgatgacagaaccggcgagattctcccccagctgccttactatggcgaacttctgacacgggatatccctcccgggacccaagaccccaacgatccgcccgagcagcgctggggaaaaattaccaatcctacagttcatatcggcctcagacagctggagaagctggtgaacgctatcattaaggtccacgggcggcccgaccagatcgtggtggaacttgccagagagctcaaactgaatgaaaaggataaagaggaacataaccgccggattagacgcgacacggcggccgctcaactgcggtctgccaagctccagtccgagggaatccctgataccggcgctaatagaatgctgcttcgcatttgggaggaactgaaccccggggaggtcctcgaccggagatgtccgtactgcggcgaacctgttggaatgcgcatgctgtttgccggcgaggccgacatcgatcacatcattccctatagccggtccctggacgattctgctgggaataaagtggtggcgcatagaagctgtaaccgggccaagggaaaccgcacaccttacgaaaagtgggtccacgaccccgatagatgggacgtgatctccacccaggttgctcggcttcacaaaagcaagcagtggcgcttcggccctgatgccatggccagagtggagaaagacgggggatttattgctcggcaactcacagatacccagtatctgtctagactggccggccgctacctctccagcctgtatcccacgaaggacgatgggtctgtctacgtgatcccgggccggatgacagcgatgcttagacgccggtggggactgaatagcctcctgcctgaccataacttcgttgataatgagcactccaacgctcccaaaaatagactggaccatcgccaccacgccattgacgccgctgtggtcgccgtgaccacccgggcgcttatgcaggaaatcgctagaacagccggccgcgccgaggataaggacctcgatagactgtttgaagacctgccccagccttgggaggggttccgggaggaactcggagagaagctggtccgcgtgaccgtttctcataaaccggatcacggcagaaaggggcttccccctaaaaaccgggacgtgacagctggacgcctgcataatgatacggcctacggcctcaccggggacgtcgctgccgatggcaagacacccattgtggttcacagagtgcctctgatgagcctgaaacccgcggacatctccgatcctgaccggatccccgacccggcccttagaagcgctctccatcgcgccaccgatggactgtctggcaaggcttatgacgccgccctggctgggtttgcgaaaacacaccctcaattcgccggcattcggagagtccgcgtgcgggaacccctcaccgtgatccctattgctgatagagacggacggccctttaaggcctacaagggggatgccaactcccgcgttgacatctggagaatgccggatggaaaatggctgagcgacgtcgtgacgatgtatgaggctcaccggcgcgatcattctgacagacggcctcaccccgccgcgaagaaacttatgtccctgcgccagaatgatatgattgctgtggaaagagacggcgcccctcggcagatcatggtcgtgaagcagatctggcccacccaaattaacctcgttgagcataaagagacagggaatctgaaggatcgccacagcaacgaaaccgaccccttcagatttttcgcccctacagctggcggactgaagaaaatgaaggccagacaggtgagaatcgacccgcttggccgcatttttgatcccgggcctcggtga

SEQ ID NO: 3787 - RNA, 3147 nt, synthetic construct
  misc_feature 1..3147: note = Cas9 variant
  source 1..3147: mol_type = other RNA
atggccaacatcgctgagaatctggtgttcggcattgacctcgggatcggaagctgcggctgggccgtcctgaaccagaaggcgaaagatgaaaatattgttgctcttgggtcctggtgttttgacgtgcccgagaccgataaggaaagaatccctacaaaccaaattcggcgcgccaatagactgctccggcgcgtgatcagacggcgcagaaaccggatggccgagatccgcagactgttcgcttctaaaggaatgcttgacacggccgatccggacgctctggccaagattagcgcggatccctgggaaatgcgggccaaaggcctcgactaccagctgacccctcaggagtttgctgtcgccctggggcacatcgctaagcgcagaggattcaagtccgccgcgaaacgggtgtctacaaatgcccccagcgaggattccaagatgctcgctgccctggaaaagaccaaggagcagtctgctcaatatcgcacaattggcgaaatgtttgccagagaccctgcctacgctgatcggagacgcaaccgggacggctgcttcgatagaaccatgagccgcgaggacctttttaaagagacacagatcctgttcgaatcccagcggagactcgggaattttagcgcgacctctgagacggaacaggccttcattgacatcgcttttcgccaaaagcccatgcaggattccgagcggctggttgaaacctgtcttttcgagcctgacgagaagagagccagccgctttgccccgtctttcgaacggttcagactgctctgccgcctggtgaacctgcgggtcacagatggactcgaggacagacccctgacccctgaagaacttcggctggcttgtgaagatgccggcaaaacacgcaagctctccgtgaaaaaggttagaagcctgattgggcttcgggacgatcagagatttaccacgattccccctgaccaggagcaacatgatatcgcggctcgcacaggagacgccctgaccggcacagccaccttccgggctatcctcggggagtctttttggagacagctgctgccccacccggaacagctcgatcgcgccgcttggatcatttccttccatgagctgaccgacacaatcattagcaaacttgccacgatcggactgccttccgaagtgatggagctcatcagaaaggcgctggaagacggcaaattttctaagttcaagggcgccgctagcctttccgataaagccgctcggaagctgattccctttctccaagaggggctgacctatgacaaagcctgccagaaggcgggatacaatcacgccgctagcaaattcacacattatgattctatcgacaccaaggccaagtttaactccctgatggatgacgtccgcgatagcattacaaatcctgtggctagaaaagccatctctgagggcatgaaacaggtgtgggccatgcggaaccagtgggggctccccggagctatttgtatcgaactggcgcgcgacgtcggcaatagcgccgagaaaagacgggaaatcgagtccgggattaagaaaaacaccgctcaacgcgagagagaacggcaggaggccaaggaacaccttaaccagtctgatatcagctccgagacgctgctccgctacagactgtggaaggaacagggaggccggtgctgttatacagaccaacccattacccctagccagctgatcgcctctgataattccgttcaggtggaccacattcttccgtggagcagattcggcgatgactcttacctcaacaaagctctgtgcaccgccaaggcgaatcaggagaaaaagaaccgcacaccctgggagtggatccataatcaaaaaggggtggaggcttggaaccactttaccgccgccgtcgagtcccggaaggaaacaagaggactgaagaaacgcaatttcctccttaagagctccaaagagacggaggaacggtttagatctcgcaacctgaatgacacccggtacgctgccagagtgatggcggaggctgttcgcctgctctatcctagcggcaaccgggccgaaaaagggggagtgaagagagtcttcacacggcccggcgccctgaccgctgccctgcgccatgcttggggcgtggagtcccttaagaaaattaatgggaagagactcaacgatgaccggcaccacgccctggatgcggccgttgtggctgccgtctctgaaaaggagatccagaaactgacaaagagcttccagatctgtgaacagaaaggactcgctcgccctatgagagacgtgcccatgccgtgggagggctttcggcatcaactggagaccgcctacgccgatattagagtcgctcgccctgaacggagacgcgcgcgggggaagggacacgacgccacgatcagacagcttcgcgaggaaaaagatggccccgtggtttatgagcggagagctatttccgacctgaagctcaccgatctggagcgcatcaaggaccctgaaagaaatagcgccattatctcttccctgcggacatggatcgagaaagggaagcccgccgattaccctccccagagcccgaaaggagacgaaattcgcaagatcagagtgatgtctcggaacaaacctgctgtctccgtgcgcggcgggaccgccgatagaggcgagatgacacgggttgacgtgttcaccaagatgggaaagaaaggcaagcccgaatggtttcttgtccccatttatagacatcaagtgatcgaccgcattcagtggcctcagccgcccaatcaggcggctgccaacgggaaaagcgagaagaactggcctacgatgggactcgagcacgagttccggttttctctgtaccccagaagctatgtgcaaatcgttaaacgcgatggcgaaatcattgaagggtacttcgccggactggaccggacagtcgctgccttttccctcctgtctagctccgatcctaccagcatccagagaggcattggggcgaagacacttgagtccatccggaagtacaatgtgaaccgcttcggcgacatttctatggtggaacaggagaccagaacctggcatggagatgtctgcatcagccccgaccagcctgattccgcttga

SEQ ID NO: 3788 - RNA, 3147 nt, synthetic construct
  misc_feature 1..3147: note = Cas9 variant
  source 1..3147: mol_type = other RNA
atggtggagaagatcctgggcattgacctcgggatcagctccctgggatgggccgtcgttgaatacgataaagacaacgatgagaataacaagattatcgactgcggcgtgagacttttcaccgctgccgaaacacccaaagagaaggaatctcctaataaagcgcggcgcgatgctagagggctgcggcgcgtgattaagagacggcgcgtcagaatgaacacgatcaagaatctcctgatcacctataaacttattgacaagacactgctcgatgaggagatgggaatgtttcacagccagtccaaccgggtggacgtttggaaactgcgccatgatgccctgtaccacctcctgtctggcgacgaacttgccagagtgctgatccatattgctaagcaccgggggtataaattcctcggagatgacgagagcgatgaagagtccggcaaggtcaagaaagccggcgctgagctgaagaaaaagtttcttgaagccgggtgtcaatctgtgggagagtggctgtggaaagaacgcggcctccaggggaagaaaagaaataagagcggagactacgagatctccattccgcgggacttcctggttgaagagatccagcgcatttttgagacccagcaaaagttcggcagcacatttgcgacctctgaactgcagaaagcctatacagatatcgctttctacgtgaagcccatgcagtccatcgaggacatggtcgggtattgcaccttttaccctaaaattaagagcaaaaaccaggatggagaaaagagagcccccaaggcttctccttccgccgagcaattcgtgatcctcagcaaaatcttttctacgattgtgattgacgaaaataagcaggagaaaaagctgatcgagcttaaatccatcgaacagctgattcagatcgcgcggagcaaggagaccctcaagtacaaacaactgagaaaggaacttaacctggccaaagatatttccttcaagtctatcagcgacgaggaaaagacatggattaatctcgtcggcaacgctaagtttaagaaaatcctgggcctgaattatgagaccttcctcaagaacacagagatctccgatgaaattgccaaaatcctgacctacgacaagacgttcgagcagaaagaaacaaaacttaaaaatctgctcgttaacattgattggatcgacaacaatcatattgctgagctggccaaacttagcttttctcagttcaaccaactgtccctcaaggccatcaaaattatcagcaagatcatgattgaggggtatgctcgctacgatgaagcggtgcagtatgcctttgagaataacctgctgcccaaaccttctcacgaaaagagcatcctcctgccgccccttaaagagaccaatattgctatcctgaaccctacagtgattcgggccttcgcccagtttagacaggtcgctaatgccctcgtgtccaagtacggatctttcgacaaggttcactttgaactggcgcgcgaggtgaacaccaaagaggaccggaagagatgggaaaaagatcgcgacaagaatgagaaaatgcatcggcaaatcaccgaaaagctggtcgaggaaggcgtgaagcccagctataaaaacatccttaagtccaaactcagaagcgagcagaaggatacatgtccttactgccagaaaaatctgcactaccccatgattttcgaggacgggtatgctgaaatcgatcatattctgccgctctctcagtcccaagacgatagctacgttaacaaggtgctggtccactctgcctgtaatcagaacaagaaaaatcgcacgccttttgagtggttccaggacgaaaagaaagattgggacacctttaagtcctatatccttatggagagcacactgggagaaaagaagcggaactacctcattaaagagaacttctccgatccccagtctagaaaggagtttatcagccgcaatctgaacgacacccggtatatgtccaaggccatcaaaacatactgcgaaaatcactggaagctgtctcatgatgacgacaaacttcgcattcaagtgcggagcggcaagctcacctccacgctgcgccaccagtgggggctggataacaaaaatagagagacacatacccaccatgctatggacgccatcatgattgctttcagcacccagggaatggtcaagaagctctctgattatttcgccaaaaaggaagcgaaagtggagaaggacaaacctgttctgatcacacccattaagcagtttaaggaggccgtggaacaagctaccacacttgagcggcaggaatccatccagacgaaagccggcgataccatcacactgaacagactcctgattagcagaccccctcgggcttctgtcaccggcgccgcgcacgagcaaacagccaagccgtaccccagaatcaaacctattaagaataaatacaagcgcagacggatccccattgacgaagataagttcgagctgtttcgcaacgacaaagtggcttccgggaatgataagaacttctataatagctctaccatccctagagttgacatttacaaaaaggatgacaaatatcacgtggtccccatctaccttagcgatatgacgaaggccgaggtgccgaacaagtccctcggaaccaatcctgaaggcatggacgagaaatatttttgtttcagcgtgtttaagaacgacctgatcgaactggagacaaaagctacccccaagaaaccttctaagaaactcctggggtacttcaagcagcttaatggagccaactttattctgaactccatccataatggcattatcgatgggttcgtttgcagccccattacactctttaagcagcagaaagacatgtgtaagaaatgcctgcctgaagatcgggccatcggcaactgttcccaagagaccctggagttctgggaagctgagaatatcaaggtccccaaaaaggactttgaatgcgatcagggaattaagttcgcgatcgccgtgcgcaaatatacgattgacccgcttggctactaccacgaggtgaagggggaaaaactcctgggaacaatccctcagggcgctaagaaacatcccaagagacagaagtga

SEQ ID NO: 3789 - RNA, 3150 nt, synthetic construct
  misc_feature 1..3150: note = Cas9 variant
  source 1..3150: mol_type = other RNA
atgatcaacgagagactgaccttcggcattgacctcgggatcggaagctgcggctgggccgtgctgcggcacgctgatgccgcgggggaacccggagtcattgagggccttgggtcctggtgttttgacgttcctgaaacatctaaggagcgcatcccgacgaatcaggtgagacggagcaaccgcctgctcagacgggtgattcgcagacggcgcaatagaatggctgaaatccggcgcctgttccatgcccaaggacttctgccctccgccgatgaggacgctctcaaaagacctcggctggatccctgggagctgcgcgccagaggcctcgaccagtgcctgtctgctgaagagtttgccgtcgcgcttggccacatcgcccggcatagagggttccgcagctccgctaagcggaaagccgctaacacctctggagaagatagcaagatgctgtccgccctcctggtgacaagagagcgcaccgcgcggtacagaacagttggcgagatgtttgcccgcgaccctgaatatagcgctcggagacgcaatcgggatgggattttcgacagaaccgtggcccgcgatgaccttatccacgaggtcggaaaactgtttgaagctcagcgggccagaggctctgccttcgcttcccccgatctcgaggcggactttaacgccattgctttccggcaggccgaaatgcaagacagcgagcgcctggtggggaattgtccttttgagagagatgaaaagcgggccgctagatgggccccgtctttcgagcgctttcggctgctcacaagactgatcaaccttcgcattgcgaccgctgaaggagagagacggttcacgcccgaagacctggcccgcgtttccgccgagctcggcgctaccgccaagctgcctgtgagcagagtccgggctcttatcggcctgctccccgatgagcgcttcacaaccattagagtggaagacgaggatcgggacatcgtggcccgcacaggggaagcggcccctggaacctggagactgcggaaaacgctgggcgaggctctctgggccgaaatgcaggctcgccccgatcagctggacgccatcgcgcatgtccttagctttttcgaggccacagctaagattagatccgagctggatcggctcgggctgccggccgctgttatcgaagcccttgacagaggactggaggatggcgcctttgctaaattcaagggggcgggacacattagcgccaaagcgtgccgcaatctcctgcctcatctgcagcaaggccaccggtacgaccaggcctgtagactcgccggctatgaccacgctgcctccaccctgtctcatacagctcaggtggtgagcaaggctgggtttaacgcccttgtcaccgaactgggagagtccatcgccaatcccattgctcgcaaggccctcaccgagggcctgaaacagatccgggcgatgtgcgctagatgggggctgcctggagccatccacattgaacttgcccgcgaggtgggcaacagcatcgaaaagcggagagagctcgaatctcaacgcgagacaacgaccaaacggagacagacagagcgggatgaaattcgcgggctgctggctctcgaggacgttgatgacgataccctgcttagataccggctgtggaaggaacagggcggaaaatgtctctatacaggcaaggacatccacgtgcgccaactgattgccaccgataattccgtccaggtggaccatatcctgccctggagcagattcggggatgactcttttaacaataaaacgctttgcctcgctagcgccaaccagcggaagagaggacagacaccctgggagtggttctccctgaccggcacccctgaagcgtgggaggtttttgcctctcgcgtggagacaagcaaggatctgcgggggttcaaaaagagaaacctcctgcttaaaaatgctgacgaagtcgcccaacgctttcggtccagaaacctgaatgatacccgctacgctgcccggctcctggccgaggctgcgaagctgttctatccggccggagacagacaggaaaaagacggccgcagacgggtgcttacacgccccgggcctctcacggctgccctgagacacgcctggggcctggagagcctcaagaaggctgatggaaaacgggtctctgacgatcgccatcacgccctggacgcgcttgctgtggccgccatctccgaaagagaggttcagcggctgaccagatcttttcaggagtgggaacaacagggcctcgctcgccccctgcggcatgtggcccctccctggccggggttcagaggagatgtcctggcggcttacgcccaggccttcgtggctcgccctgagcggagacgggcccgcggcaaggggcacgacgcttctattagacaggttgtgggagaaggccccgaggcccaagtctttgagcggcgcgggcttgcggatctcaaagaagccgacctggatagagtgaaggaccctgagcggaaccaggctatcattgaagccgtgcgcgcttggatcctggccggcagacccgccgatgctcctccccggtccccgcgcggagacgttattgtcaaactcagaacagcgcctgccaagaagatcaaacccgctgtgcccgtgcggggcgggaccgccgatagaggagacatggtccgcattgacgtgttcacacggcctaatagaaagggccgcgatgagtggtacctggttccgatctatccccaccaggtgatgaaccggaaagcctggcctcatccccctatgagaagcgtcgtggcttacaaggacgaagccgggtggaccgagatcggagcggagcactcctttcgcttctctctttatccccggagctacgttcagctggtgaaatccaatggcgatgtcattgaagggtatctcgtgtctatggacagaagcacgggcgcttttcgcgttttcgtgcataacaatcctgccgagatggccaagggaatcggcgctaagaccctgctgaaccttcggaaatttaatgtcgatagattcggggtgcgcacagaagtgaagtccgaggtccggacctggcacggagaagtttgtacaagccccgtgccgcctgactga

SEQ ID NO: 3790 - RNA, 3150 nt, synthetic construct
  misc_feature 1..3150: note = Cas9 variant
  source 1..3150: mol_type = other RNA
atgcagctgagcaagctcaactacatcctgggccttgacctggggattgcctccgtgggatggtctgtcatcgagattgatgaaaccgagatgcccatcagactcattgacgttggcgtgcggacattcgaacgcgctgaggtgcctaaaacgggggaaagcctggcccttgcgagacggctggctcgctccaccagacggctcatccgcagacgggcctttcgcctgctgaaggccaaaagactcctgaagaatcaccaaatcgtctctgctgatgagcttagcacactgccgaaccattgctgggagctccgggtgaaaggactggacgaacgccttacctgtcaggagtgggccgctgttctgctccaccttctgaagcatagaggctatctctcccagcggaagtctgaagcccagaatgcggataaagagatgggggccctgcttagcggagtggctaacaatcacaagctgctctccgagaaccattaccgcacacccgccgaaattgctgtcaaaaagttcgccctggaggaaggccacatgagaaatcaacggggcgcgtatacccacacatttaacagacttgacctgctcgccgagatgcgcctgctgttccagacccagcgggaactcgggagcccttacgcttctggagagctggagcaggaattttgcaaacttctgatgtggcaaaagcccgccctctccggcgatgctatcctgaagatgcttgggaaatgtacgctggagcctaccgaatataaggccgccaaaaatacatacaccgctgagagattcgtgtggctcacaaagctgaacaatctgcgcattctcgaaaacggaagcgagcgggcgctgaatgccgacgagagagctctgctgctcaaccagccctatgaaaaagccaagtttacctacgagcaggcccgcaaactgctgcagcttaatgaagctgcccggttcaactctgttagatacggcaaggagaacgcggaaaagtccacgctcatggagatgaaggcttatcatgccatccgcaaagccgtggagacagctgatagctctgcctgggctaccctgaaaacacaacctctgctcctggacgaaattgggaccgccttttccatctacaagaccgatgaggacattaaaacacagcttcagggaaagctggcggataatgtcatcgacgtgctcctggaaaacctgaatttcgacaagtttatccaacttagcctcaaagccctgtataagattctgccgctcatggagcagggcctgcggtacgatgaggcttgctcccagatctatggcgaccacttcgggaaaaaggaacagaaaaacgatagacttctgccccaaattcctgccgacgagatccgcaatcccgtggtcctccggacgctgtctcaggctagaaaggttattaacgccgtgatccggctgtacggaagccctgcgcgcatccatattgaaaccgccagagagcttggcaagtcctataaagatcggaaggaaatcgagaaaagacaggagcagaatcgcgctgaacgggagaaggccgtggacaaatttaaggaactcttccccaacttcattggggagccgaaggctaaagatatcctgacaatgagactgtacgaacaacagaatggacagtgtctctacagcggcaagtctctggaccttcaccgcctgctcgagaaagggtatgtcgagattgatcacgccctgcctttttccagaacctgggacgatagcttcaacaataaggtgctggttcttgccggagaaaaccagaataaatctaaccaaacaccctttgagtggctcggcaaggacgaacagaaatgggctctgttcaccgcgcgggtgaatagctgccgctttccttactccaagaagcagagaatcctgacgaaaaagctcgacgatgagggcttcatccagcggaacctgaacgacacacgctatattgccagatttcttgtcaatttcgtgaacgataatctgcatctcaccgggaaaggaaagcggcgcgtttttgcttctaacggccaaatcaccgccttcctgagagggcggtggggactgacaaaagtgcgcgaagagagcgacagacaccatgcccttgatgctgtcgtggtcgcctgttccaccgtgagcattcagcagaagatcacacggtttgttaagtaccaagagggcaatctgcagacggcggaaagaattgaccgcgagaccggggaaatcattcccctccacttccccgatccttgggcctttttccgggaggaggtgatgatcagaatcttctctgaaatgccgcaggaggacctggtcattaaactccccgatcgccctcaggctaaccatgaatttgtgcaacccctgttcgtttcccggatgcctacaagaaagatgagcggccagggacacatggagaccatcaaatctgccaagcgccttgacgaaggcatttccgtgagcaaagtccccctgacacagctcaagctgaaggatctggagaatatggtgaaccgggacagagagatcgctctttatgaagccctgaaagcgcgcctcaccgagtttaaggatgacccggctaaagccttcgccgaacctttttacaagaaagggggagtgcaggttaagtccgtccgggtggagcaagtgcagaagtctggcgtcgtggttagaaatgggaacggagtggctgacaatgccagcatggtccgggtggatgttttcattaaaggcgggaagtattttctggtgcccatctacacgtggcaggtcgctaaaggcatcctccctgaccgcgccgtgattgcgtacacccccgaaaacgagtgggagctgatggatgactccgcccagttccaattttctatctatcctaatgatcttattaagctgacaaccaaaaaggctatcttctttggatactatagcggcttcaacagactcacaggggccattaatatcaaagaacacgacctgcagatctccaagggagataagggcgttcatctggggcttggagtgaaactggctctcagcctggagaagtaccaggtcgacgaactcggcaaaaacattcggccctgccgcccgacccaaagacagaacgtgcggtga

SEQ ID NO: 3791 - RNA, 3153 nt, synthetic construct
  misc_feature 1..3153: note = Cas9 variant
  source 1..3153: mol_type = other RNA
atgagctcctacagattctcttttgacctgggcaccaacagcatcgggtgggccgtgttcgagctcgatcccaagacacggcctgtcgctctggccgactgcggagttcgcatttttccggatggcagaaatcccaaagacaagcagtcccttgcggtggctcggcgcgaagccagagccgtgcggcgcagacgggatcgctatctgaaaagacggtctgagctcatggaacgcctggtcgctaaggggcttatgcctgagagcagagacgatcaaaaagccctggaaggactcgacccctacgctctgcgggccgcgggcctggatgacgccctccctccccaccatttcgggcgcgctctgtttcaccttaaccagagacggggattcaagtccaatagaaagacggatcgcggcgagaactctgagaccggcatcacaaaaattgggatgaagaaactgcatgaagccctcctgagcgagggatgtcggacccttggcgaactgcagcacagacatcacgaggctaatcagacccctgccatggacaccaacccgaagtccgtgcgcagcaaactccggggagagggagcgaaggccgtttatgatttttacccctctagagacgctgtggaagacgagttcaataagctgtgggattcccaaaaacgctttcaccctgacctgctcacagatagcgcccgggacgctatcagagatgccattttctatcagcgcaagctgaaaacccccgacgccggccggtgctcttttaaccctgctgaagagagagtcgcgcgcgccatgcccatcgctcagcatttccggatccttcagtttgtgggggatctgagactcattgacaatgatctggttcggcacccgcttaacaatgaccaaaagaaagccctgtaccgcgatctcctggccaagggaaaactgacgttcaaggctatgagaaagaccatcggcattggctccgaatatgccttcagccatgagtctgagaaacagtccgaatttagaggggacgagacagcggctcggctcgccggacctaagtacttcggccccaaatggcgcgaactgagctttaacgaccagtccgagatcgtggatcggcttctgcacgaagagaatgaggaaaccctcattcagtacctgcaagacagattcgggtttgatcacgaccgctgtgaggtcatcgccgatgctcctcttcccgacggacatacaagactgggcaagaccgccctcgaaacgctggtggagattatgcgggatgaccaccttccctatgatcaggcttgcacaaaagccgggtacgaacatgcgctccctccggacggagtgatcctggatgaccttccctattacggcatcgccctggagcgccacgtcgctttcggcgatgggaagtctgagaaccctgaaaagagatatggaaaaattgccaatcccaccgttcatatcgctctcaaccagctgcggaaggtgattaacgccctgatcgcgcgctacggccaccctgaccaagtggtcatggagattgccagagaccttaaacagagcaaggctaaacgggatgacatctccaaggaacagaagaaaaatcaggatcgcaacgaccaaagacggaagaaactccaggaggcccacatcgctgtgaatgccgagaacatgctgcgcatgagactgtgggaggaactcgatgaagacaatgccgctgcgcgggcctgtccctttacaggggagaccattagcatggctagactgttctctccggaagttgagatcgagcatattcttcctttttcccgcagcctggataactctcccgccaataagaccctctgcatggtgtgggccaaccgggctaaaggaaatagaacaccttgggaagccttcggccgcgaccgggagcccgggtttgattggcctgaaatcgcggctagagccgcccgcctgcccaagaacaagagctggcggttcggcccggacgctatggagagactggaacgcgagggagattttcttgaccggcagctcacggatacccagtatctgtccagaattgcccgggagtacgtcacaaaaatctgtgaccctaatcaagtgtgggttacccccggccgcctgacagcgtggctcagacggaactgggggctgaatggaatccttcccaccggcaacgctacgaagaatcgcgacgatcacagacatcacgccattgacgccatcgtggtcgggctgacagatcgggggattctcaacagagtgtctcgcagcgctgccctggctgaagccgaggacctggatcggtccatcgcggaaatgcctgacccgttcgatggcttcagagacaacattcgccacatccttgagcagattatcgtcagccataaacccgatgccgggtttgtgcctggccaccccaagggaaataccacccctggcgctctccataacgacacagcctacgggatcattaaaaccgatgctaagggaatgtctgaagttgtgacacggaaagacgtcctgtccttcaagggcacgaaggagatcgagagcattagagacgccgccacccgccagtctctgctcgatgctgtggcgggggttccctccggactggcctttaaagaagctctgcgggactggagcgtgagaacaggcaccaagcgcgtcagagtgacattcaatatgtccgtgatccctattcaggatcgggacgggaaagcctataagggctacaaaggagatggcaacctgtgcgccgagatctatgaacgccccgacgggaagtggggagatgagatcatttctagatttgacgctgttcaaccgggcttcacccctcagtggcagcgggatcaccccgccgcgcatcgcgtcatgagactctttcgggacgatatgatcatggctgagattgacggggtgatgacggtgtgtagaatcgtcaagatgagccctggaaaagtggttttcacaccccaccacgaagccaatacagattcccgcaaccgggacaaggacgatccgttttctttccatacctgcagcggcgagtccctgagaaaacgcaaggcccagaaactgtttgtggaccctcttgggaagattcggggctacagagctaaggaaggatga

SEQ ID NO: 3792 - RNA, 3153 nt, synthetic construct
  misc_feature 1..3153: note = Cas9 variant
  source 1..3153: mol_type = other RNA
atgggcgagaacatgatcgacgaaagcctgaccttcgggattgatctcggaatcggctcctgcgggtgggccgtgctgagacggccctctgcttttggacgcaagggcgtcattgaggggatgggaagctggtgtttcgacgttcctgaaacatccaaagagagaacgccgaccaatcagatccggcgctctaacagacttctgcggcgcgtgattagacggcgcagaaatcggatggccgcgatccgcagactcctgcacgctgccggccttctgcccagcacagattccgacgccctcaagcggcctggccatgatccctgggaactgcgcgctagagggctggacaaacctctcaagcccgtggagtttgccgtcgtgctgggacacatcgctaaacggagaggcttcaagtctgccgcgaagcgcaaagccaccaacattagctccgatgacaagaaaatgcttacagctctggaggccacccgggaaagactcgggcgctaccggacagttggagagatgtttgctagagatcctgacttcgccagccgccggagaaatcgcgaaggcaagtatgatcggaccacggcgagagacgatctggagcatgaggtgcacgccctttttgctgcccaacgccggctggggcagggattcgcttctccggaactcgaggaagcctttaccgcctccgctttccatcagagacccatgcaggacagcgagcggctggtcggcttttgccctttcgaacgcacagagaaaagagcggccaagctgaccccctcttttgagcggttcagactcctggctcgccttctgaacctccggatcacaacccctgacggcgaaagacccctgacggtggatgagattgcccttgttacacgcgacctggggaagaccgccaaactctccatcaagagagtgcggacactgattggactggaagataatcaacgcttcaccaccatcagaccggaggacgaagatcgggacattgtcgctcgcacaggcggggccatgacgggaaccgcgacactcagaaaagctctgggcgaggccctttggaccgatatgcaggagcggcctgaacagctggacgccatcgtccaggtgctcagctttttcgaggctaacgaaacaatcaccgagaagctgcgcgaaattgggcttacgctggccgtgctcgatgttctgctgacagctctcgacgccggagtgtttgcgaaattcaagggcgccgctcacatctctaccaaagccgctagaaatctgcttccccacctggagcaaggccggcgctacgatgaggcctgtaccatggcggggtatgaccatgccgcttccagactcagccaccatggacagattgtggccaagacacagtttaacgctctggtcaccgaaatcggcgagtccattgccaatcctatcgcccggaaggctctgatcgaagggcttaaacagatttgggcgatgagaaaccactggggactccccggctctatccacgtggagctggcccgcgacgttgggaatagcattgagaagcggagagaaatcgagaaacatattgaaaagaacacagctctgcgcgcccgggagagacgcgaagtgcacgatctcctggaccttgaggatgtcaatggcgacacgctgctccggtacagactgtggaaagagcaaggaggcaagtgcctgtataccgggaaggccatccatatccgccagattgctgccacagataactccgtgcaggttgaccacatccttccctggagccggttcggagatgactcttttaacaataaaaccctctgtctggcgtccgctaaccaacagaagaaaagaagcacaccttacgaatggctgtctggccagaccggggatgcctggaatgccttcgtgcagcggattgagacgaacaaggaactccgcggatttaaaaagagaaattatctgcttaagaacgctaaagaggccgaagagaagttccggagccgcaatctgaacgacaccagatacgcggctcggctctttgccgaggccgtcaaactgctgtacgctttcggcgaaagacaagagaaagggggcaatcgccgggtgtttacaagaccgggagcccttaccgctgccctccgccaggcgtggggcgtcgaatccctgaagaagcaggatgggaagcggatcaacgacgatagacatcacgccctggacgctctcacagtggccgctgttgacgaggccgaaattcagcgcctgaccaaatctttccacgagtgggagcaacagggacttggccggcccctgagacgcgtggaacctccctgggagagcttcagagccgatgtcgaagctacgtatcctgaggtgtttgttgcgcggcccgagcgcagacgggcccgcggggaaggacatgctgccacaatcagacaggtgaaggagcgggaatgcaccccgattgtcttcgagagaaaagccgtgtccagcctcaaggaagctgacctggagcgcatcaaagatggcgagcggaatgaagccatcgtggaggcgattagatcttggatcgctacagggcgccctgccgacgctccccctcggtcccccagaggcgatattatcaccaagattcggctggccaccacaatcaaagccgcggttcctgtccgcggaggcacggctgggagaggagaaatggtgcgggccgacgtgtttagcaagcccaaccgcagaggcaaggatgagtggtaccttgtcccggtgtatcctcaccagatcatgaatcggaaagcctggcccaagccccctatgcgctctattgttgctaacaaagacgaagatgagtggaccgaggtggggccggaacatcaattcagattttccctctacccccggagcaatatcgagattatccgcccttccggagaagtcattgagggctatttcgtggggctgcacagaaacacaggcgccctgaccatctctgctcacaacgaccccaagagcatccattccggaattggcacaaaaaccctcctggccatctctaagtaccaggttgatcggtttgggagaaagagccctgtgcgcaaagaagtccggacgtggcacggagaggcgtgtatttcccccacacctcccggctga

SEQ ID NO: 3793 - RNA, 3153 nt, synthetic construct
  misc_feature 1..3153: note = Cas9 variant
  source 1..3153: mol_type = other RNA
atgaagatcctgggcttcgacattgggatcgccagcattggatgggcttttgtggagaacggcgaactcaaagattgcggggtcagaatcttcaccaaggccgagaatcccaaaacaggagactccctggcgatgcctcggcgcgaagctagatctgttcggcgcagacttgcccggcgcaagggcagactggagacgctcaaacggctgcttgccaaggaatgggatctgtgttacgaggactatattgctgccgatggggagctcccgaaggcttttatgggaaagaacctgaataacccctacgtgctgcgctatgaagccctccagagactgcttagcaaggaggaactggtgcgggtcgtgctccacatcgcgaaacatcgcggctacggcaataagaacgccaaaatcaccaagtccgaggagtctaagagagaacaagggaaaattctgagcgctcttgccacaaatgcttccgccatcgcgcggtatcgcaccgttggagagtacttctataaggaattttgcgaggtgattaaaaaccctcagggcctgtctacaaatgaacactacacccagagcaaggtcagagtgctcaaacccatccggaacaaagggggagagtacacaaattgtattctgcaggaggacctgcaaagagaactccgctgcatcttcgagtatcagaaaggctttgggttccctattacccaggaatttcaggataagatcctgaagatcgccttctaccaacggccccttaaagacttttcccatctggttggaaagtgtacgttctatcctgatgagtttagagctctcaaatgcagcctgtctgccgtggagttcattaccctttccaagacaatcaacgtcctgacctacattagcaaagaatctggcgaggtgtattccaagggccagtacgaacagatgctcgacagcgtgttcaaggctgtctgtgagaaagggtctctgtcctttgcccagctgcgcaagatcctccacattgatgaacggatcagattcaaagaggttgactatatggcccgcaagagcaaaaatacatccggagattctacccataagcaaaagacgagcaacccggaaacgaaaaagtttatcgagcacaaaaatctgaagaaattctgcgagattctttccgaaatcgctgaggaccgggcgctggccgacagcattgctagagatatgaccctcatcaaggacgaagagaagctggcccagaaacttcacggctacgggaagttttctcaggagcaaattacacagctgtccgccctcaacttcagccatcacatcaacctgtctctgaaagctctcagcgaaatcctgccctttatgcgcgagggaatgcggtacgatgaagcctgtaaacttgcgggcctgaaagctagacataatgacaagaaatccaagttcctccctcccttttgcgagtctatttatgccgatgaactgaccaaccctgtggtgcaccgcgccatcgctgagtaccggaagattctgaatgcccttatcgctaaatatgggagcgtccacaagattcatatcgagctcaccagagacgtgggaaagaacttccaggaacgggagaagtacaaaaaggaaattgagtccaattataaggcccgcgttcaggcgatgcaagaatgtgagaaactgggcctgacactcagcgagggcaacatcctgaaacttagactgtttcgggaacagaatgagatctgcgtgtactctgggagaaagattacgctcgccaacctgaaggaacagggagctctggagatcgatcacattcttccctattcccgcagctctgacgattcctacatgaataaagtcctcgtgttcaccaacgaaaatcagaacaagggcaataagacaccgtacgaggcctttgggggagacagccaaaaatggggcgagatcgaatccctggctctgcggtctgggtatcctaagaaaaaggccaaacgcattctcgataagggcttcggagacagagaggcgggcttcaagagcagaaacatcgttgactccgggtacatcgcccggctgattgctaattataccaaagaataccttaagtttctgcccctcgattctcatgagaacacagccctgatcgctggagagaaagacagcaagattcacgtggaagccgtcaaaggcatgctgaccgccacgatgcgccatttctgggggcttggatccaagaacagatatgagcacacacaccatgctgtggatgcgatcattatcgcctacatcaatgctgccatgattcagcggtttagccagttccgccagaaccaagaatctctcaaagccagattttatgctaaggagctggccaaggaagagttcaaaacccagcgggcgtttttcgagccttttcgcggcttcagagaacaggtcctggctaaggtggggcagatctttgtttcccggcctccccgcaaaagagcccggggcgccctccacgaggaaaccttctacagcattgacgataagaaactgtctgagacatacggaggcaaggaaggggtgcaaagagctctttccctgggaaagatccgccagattggcaccaaaatcgtcgccaatgggcccatggtgcgggttgacatctttaagcataaacagagcagacgcttctatgcggtgccgatttacacaatggatttcgctctcggaatcctgcccaacaaggccgtcgtgtctggcaaagacacaaagagcaaggtgattaaagattggctggagatggactcctgctatgagttttgtttcagcctttttaaggatgacctcatcgaagttcaaaaatctgatatggagaagcctgaactggcctacttcgtctccctggacgctagcgacgggcggattaaagtgagacaccactgcaatgatatcaccaagattaacgagaatcagaagaaactcttttccgaagccatcgagaaggaggtggtcggccgcggatctatccagaacctgaaagtgttcaagaaatataaggttagcccccttggcgaaattaaggaggctaaatacgaacctcggcagcccatcgccctgaagacatccccgaaaaagcatagaaaacaaaataacgcgcagtga

SEQ ID NO: 3794 - RNA, 3156 nt, synthetic construct
  misc_feature 1..3156: note = Cas9 variant
  source 1..3156: mol_type = other RNA
atgaacaattacatcctgggcctcgacattgggatcaccagcgtgggatatggcattgtcgattccgacacaagagagatcaaggatgccggggttcggctgttccccgaagctaacgtggacaataacgagggacgcagatctaaacggggcgcccgcagacttaagcggcgccggattcacagactggatcgcgtgaaacatctcctggcggaatacgaccttctggatctcacgaatatccctaagagcaccaacccgtatcagacaagagtcaaagggctgaatgagaagctgtccaaggacgaactcgtgatcgctctgcttcacattgccaaacggcgcggaatccataacgttaatgtgatgatggatgacaacgattctggcaatgagctgagcaccaaggaccaactcaaaaagaacgccaaagctctgtccgataagtacgtctgcgagcttcagctggaaagatttgagcaggactataaggtgcggggcgagaaaaatcgcttcaagacagaagactttgttagagaggcccggaaactcctggaaacccagtctaagttctttgagattgatcaaacattcatcatgagatacattgaactgatcgagacccgccgggaatattttgaggggcccggaaaaggcagccctttcgggtgggagggaaacattaagaaatggtttgaacagatgatgggccactgtacgtacttccccgaggaactcagatccgtgaagtacagctattctgctgagctgtttaatgcccttaacgacctgaacaatctcgtcatcacccgcgatgaagacgcgaagctgaactacggggagaaattccagatcattgagaatgtgtttaagcagaaaaagacacctaaccttaaacaaatcgccattgaaatcggagtgcatgagaccgaaattaagggctatcgggtcaataagtccggcaaacccgagttcacacagttcaagctgtaccacgatctcaaaaacatctttaaggaccctaaatatctgaatgatatccagctgatggacaacattgctgaaatcattaccatctaccaggatgccgagagcattatcaaggagctcaatcaactgccggaacttctgtctgagagagaaaaggagaaaatctccgctctcagcgggtattctggaacgcaccgcctgtcccttaagtgcattaacctgctcctggacgatctgtgggagagctccctcaatcagatggaactgttcacaaaacttaacctgaagcccaaaaagatcgacctctctcagcaacataagattcctagcaaactggttgacgattttatcctgtcccccgtggtgaagcgggccttcattcagagcatccaggtcgtgaatgcgattatcgacaaatacggccttcctgaggatatcattatcgaactcgccagagagaacaattctgacgatcgccggaagtttctgaaccagctgcaaaaacagaacgaagagaccagaaagcaggttgagaaagtgctccgcgaatacgggaatgacaacgctaagcggattgtccagaagatcaaactgcacaatatgcaagagggaaagtgtctttattccctgaaagatattcccctcgaagacctgctgagaaacccgcatcactacgaggtggatcacatcatccctcggagcgttgccttcgacaattctatgcataacaaggtgcttgtccgcgctgatgaaaatagcaaaaagggcaacagaacaccctatcagtacctcaattcctctgagagctccctgagctataacgagtttaagcagcacattctgaatctctctaaaaccaaggaccggatcaccaaaaagaaaagagaatacctgcttgaggaacgcgatattaacaagttcgacgtgcagaaggagtttatcaatcggaacctggtcgacacaagatatgccacgcgcgaactcacctccctgctgaaagcctacttcagcgctaataaccttgatgtgaaggttaaaacaattaacgggtcttttaccaattacctcagaaaggtgtggaaattcgacaaggatcggaacaagggatataaacatcacgcggaggacgccctgatcatcgctaatgccgattttctgttcaagcataacaaaaagctccgcaatattaacaaagtcctggacgccccttccaaggaggtggataaaaagagagttacagtgcaaagcgaagacgagtacaatcagatcttcgaagatacccagaaggctcaggccattaaaaagtttgagatccggaaattctcccaccgcgtcgacaagaaacccaacagacaacttattaatgatacgctgtattctacacggaacatcgacggcatcgagtacgtggtggaaagcattaaggatatctattccgttaataacgacaaggtcaaaaccaagtttaaaaaggacccccaccgcctcctgatgtacagaaatgatcctcagaccttcgagaaatttgaaaaggtgttcaagcagtatgagtctgagaaaaacccgtttgcgaagtactacgaagagacaggcgagaaaattcggaagttcagcaaaaccgggcaaggaccctatatcaataagattaagtacctgcgcgaaagacttggccggcattgcgacgtgacaaacaaatatatcaactccagaaataagattgtccagctcaaaatctacagctatcgctttgatatctaccagtatgggaacaattacaagatgattacgatctcttacattgacctggaacagaaatccaactattactatatcagccgggagaagtacgaacaaaagaaaaaggataaacagattgacgattcttataagttcatcggatccttttacaaaaatgacatcattaactataatggcgagatgtacagagtgatcggggttaacgatagcgagaagaataaaattcagctggacatgatcgatatttctatcaaggactacatggaactcaacaatatcaagaaaaccggcgtgatttataagacaatcggaaaaagcaccacacacattgagaagtacaccacggacatcctgggcaacctttataaagctgcccctcccaagaagcctcagctgattttcaaatga

SEQ ID NO: 3795 - RNA, 3159 nt, synthetic construct
  misc_feature 1..3159: note = Cas9 variant
  source 1..3159: mol_type = other RNA
atggagaacaagaatctgcactacatcctcggcctggaccttgggattgccagcgtgggatgggctgtcgttgaaatcgatgagaaagaaaaccccctgagactcattgacgtgggcgtgcggaccttcgagcgcgccgaaacacagaagggggagtccctggcgctttctagacggagcgctcgctccgccagacggctgacgcaacgcagagtcgcccggctcaaaaaggctaaacgcctgctgaagtctgagaatatcctcctgagcaccgatgaaagacttcctcatcaggtgtggcagctgcgggttgagggactcgaccgcaagctggaaagacaggagtgggccgctgtgcttctgcacctcattaaacatcggggctatctgtcccaacgcaagaacgagtctaaaagcgaaaataaggagctgggggccctcctgtccggagtcgcgagcaaccacgaacttctgcagcaggccacatacagaaccccggctgagctcgccgtgaaaaagtttgaagttgaggagggccatatccggaatcagcaaggcgcttatacacacaccttctctagactggatcttctggccgaaatggagctcctgttttcccgccagcagcacttcgggaacccctttgcgagcgaaaagctgctcgagaatctgacagcccttctgatgtggcagaaacctgctctctctggagaagacatcctgaagatgcttggcaaatgcaccttcgaggatgagtacaaggccgctaaaaacacgtataccgccgaacggtttgtgtggattacaaagctgaataacctcagaatccaagagaatgggctggaacgcgccctgtccgacaacgagcggctcatgctgattgaacagccctacgagaaagctaaacttacctatgcgcaggtcagaagcatcctgaatctctctgatgacgccattttcaagggagtgcgctactccggcgaggataagaaggctatcgaaacaaaaaccacgctgatggagatgaaggcctaccatcaaattcggaaagtgctggaagggaacaaccttaaggccgagtgggtcgctctcaaggccaatcctacactgctggacgagatcggaaccgcgtttagcctctataaaacagatgaagacatctccgcttacctggccggcaaactttctcagcccgttctgaacgccctcctggagaatctgagcttcgacaagtttattcagctttccctcaaggctctgtataaactgctccctctgatgcagcaaggccttagatacgatgaagcctgtcgcgagatctatggggaccactacggaaagaagaccgaagagacccatcacttcctgccgcagattcccgctgatgagatccggaaccctgtggtgctcagaacactgacgcaggcccgcaaagtcattaatggcgtggttcggctgtatgggagccccgcgagaatccacatcgaaaccggacgggaggtgggcaagtcttacaaagaccgccatgaacttaagaaaagacaggaggaaaaccggaagcaaagagagaagacaatttccgagatcaaaaccctctttcctaatttcagcggggaacccaagggaaaagatattctgaagatgcgcctgtactatcagcagaacgccaaatgcctctactctggcaagccgctggagcttcaccggctgttcgaacagaaatatgtcgaggtggaccatgctctccctctgagcagaacatgggatgactcctttaataacaaggttctggtgcttgccaatgaaaaccaaaataagggcaacctcacccccttcgagtggctggatgggaaaaataactctgagcgctggagaacgtttaaggctctggtcgaaacaagcgccttcccttacgcgaaaaagcagcggatcctctcccagaaactggacgagaagggatttattgaacgcaaccttaatgataccagatatgtggcccggttcctgtgtaactttatcgctgacaatatgcacctcaccggcgaggggaagcgcaaagtcttcgccagcaacggacagatcacagctctgctgagacggcgctggggccttgccaagtctagagaggacaatgatcggcatcacgccctggacgctgtgctcgttgcgtgctccaccgtggccatgcaacagaaaattacacgctttgtcagattcaaggctggggatgtgtttacgggcgaacggatcgacagagagaccggagaaattatccccctgcacttccccacaccttggcagtttttcaaacaagaggttgaaattcgcatcttcagcgataacccgaagctcgagctggagaatcggcttcccgacagacctcaggccaaccatgaatttgtgcagcccctgttcgtctctcgcatgcctacccggaagatgacaggccaggggcacatggagaccgtgaaatccgccaagagactcaatgaaggaattagcatgatcaaaatgcccctgacgaagctgaaacttaaggatctggagctcatggtgaaccgcgaacgggagaaggacctgtacgatgctctcaaaaccagactggaggcctttaatgacgatccggcgaaggctttcgccgaaccttttatgaaaaagggcggggccatcgttaaatccgtccgcgtggagcaagtgcagaagtctggagtccttgtgcggcagggcaacggggttgctgacaatgccagcatggtgagagtcgatgtgttcacaaaagacggcaagtattttctggttcccatttacacctggcaagtggcgaagggaatcctccctaacaaagctgtcattcagggcaaggacgaagaggattgggaagacatcgatgacgccacattccagttttccctgcatcccaatgatctgatttctgtgaaaaccaagaaagacgagttccttgggtactttaacggactgaaccggcacacgggcgggatcaatatccgcacacacgatctcgaaaagagcaagggaaaacagggcattttcgaggggatcggcgttaagattgccctgtcctttgagaaatatcagatcgacgaactcggaaagaacattagactgtgtaaacctagcaagcggcaacccgtgcgctga

SEQ ID NO: 3796 - RNA, 3159 nt, synthetic construct
  misc_feature 1..3159: note = Cas9 variant
  source 1..3159: mol_type = other RNA
atgaagaacaccagcctgaattacgtgctcggcctggaccttgggatctcctctgtcggatgggccgttgtggagattgatgaaaaagagaaccccctgagcctcatcgacgtgggcgtcagaacattcgaacgggctgagacgcagaagggggaatccctggcccttgcgcgcagactggctcggtctgcccgcagactcacccaacggcgcgtggccagactgaaaaaggctaaacggctgctcaagagcgagaatattctgctttccacagatgagtgcctgcctcaccaggtttggcagctccgcgtggaaggactggagagaaaacttgaacggcaggagtgggccgctgtcctgctccatctgatcaaacaccgcggctatctgtctcaaagaaagaacgagagcaaatccgaaaataaggagctcggggccctgcttagcggagtggcgaacaatcataaactgctccagcagaccacataccggaccccggccgaactggctgttaagaagtttgaggtggaagagggccacattcgcaaccagcaaggctcttatacacataccttctccagacttgacctgctcagcgagatggaactgctgttttctcggcagcagcacttcgggaatccctttacgtccgagaaactcctggaaaaccttaccgccctgctcatgtggcagaagcctgctctgagcggagatgccatccttaaaatgctgggcaagtgtacattcgagaatgaatacaaagcggccaagcacacctattctgctgagagatttatctggattacaaaactcaacaatctgcgcatccaagagaacgggctggaacgggccctcaatgacaacgagagactggctcttatgaagcagccctacgaaaaggccaaactgacctatgcccaggtccgctccattctcaacctgagcgatgaggctatcttcaagggactgcggtactccggcgaagacaaaaagacgtctgagacaaaaaccgtgcttatggagatgaaggcgtaccatcaaattagactcgccctggaaaagaatgatctgaaaacagagtgggctgaactcaaggtgaacagctccctgcttgacgagatcgggaccgcctttagcctgtataaaaccgatgaggacatttctacatgcctcgccggaaagctgtcccagcctgtcctgaatgctctgctcgaaaacctgaatttcgataaatttatccagctgagcctcaaggccctgcacaagatccttcccctgatgcagcaaggcctccgctacgacgaggcgtgtgctgaaatttatggcgaccattacgggaaaaagacggaggaaaaccaccttctgcttcctcagatcccggccgatgagattcggaatcccgttgtgctcagaaccctgacacaggcccgcaaagtgatcaacggagtcgtgcggctgtattctagccctgctcgcattcacatcgagaccggcagagaagttgggaagtcctaccaggaccggagagagctcgaaaaacggcaagaggaaaatcgcaagcagagagagaaggccatctctgagattaaaacactgttccccaactttagcggagaacctaaggctaaagatatccttaagatgcggctgtattaccagcagaatgccaaatgcctctactccggcaagcccctggagctgcatagacttctcgaacaagggtatgtggagattgaccacgcgctgccgttcagccgcacctgggatgactctttcaacaataaagtcctggtgctcgccaacgaaaatcagaacaagggaaacctgacgccttttgagtggcttgatggcaagaataactccgagcggtggaaggctttcaaggccctggttgaaacaagcgcttttccctacaccaaaaagcagagaatcctctctcagaaactggacgagaagggcttcattgaacgcaatctgaacgataccagatatgtggcccggtttctttgtaatttcatcgcggacaacatgcatctgacaggggagggaaagcgcaaagtctttgcctccaatggccaaatcaccgctctcctgagagggcggtggggactcgccaagagccgcgaggataacgacagacaccatgctctggacgccgtggtcgtggcctgctccacagtttctatgcagcagaaaattacgcggttcgtgcgctttgaagagggcaatgtcttcaccggggaaagaatcgatcgggagacaggcgaaattatccctcttcactttcccgctccctggaagttctttcgcgaggaggtggaaattagaatcttcagcgacaaccctaaactggagctcgaaaatcggctgattgcgagaccgcaagccaaccacgagttcgttcagcccctgtttgtgtcccgcatgcctacccggaagatgacaggacagggccatatggaaaccatcaagtctgctaaaagacttaatgaggggctgagcgtcatcaagatgctcctgacgaaactccgcctgaaggatcttgagtccatggtgaaccgggaaagagagaaagaactgtacgaggccctcaaggcccgcctggaggctttcaatgacgaacccgccaaggcgtttgctgagcctttcatgaaaaagggaggcgccattgtgaaaagcgttcgggtcgaacaggtgcaaaagtctggggtgctggtcagagatggaaacggcgtggccgacaacgcttccatggttcgcgtggatgtctttaccaaagggggcaagtatttccttgtgcccatctacacatggcaggttgccaaaggcattctgccgaataaggcggtgatccagggaaagaacgaggaagactgggaggtcatggatgacgctacctttcggttcagcctccaccagaatgatctggtgaaactcgttacaaagaaaaagaccatttttgggtatttcaacggactgaatagagccacgggcaacatcgacatcaaagagcatgatcttgaaaagtctaaggtgaaagacgggattcaccaatccatcggaattaagctggccctgagctttgagaaataccaggtcgacgaactcggcaagaatatccggctgtgtaaatctagcaagcgccaggctgtgagatga

SEQ ID NO: 3797 - RNA, 3159 nt, synthetic construct
  misc_feature 1..3159: note = Cas9 variant
  source 1..3159: mol_type = other RNA
atgatcggcgagcacgtgagagggggatgcctgttcgacgatcattggacccccaactggggcgcctttcggctccctaatacagtccgcacgttcaccaaggctgaaaacccgaaagacgggagctccctggccgagcccagacggcaggcgcgcggacttagacggcgcctgagacggaagacacaacgcctcgaagatctgagacggcttctggctaaagagggcgttctctctctgagcgacctggaaaccctctttcgcgagacccctgccaaggatccctaccagctgagagccgaggggcttgaccggcctctgtccttccccgaatgggtgcgcgtgctctatcacattacaaaacatagaggatttcagtctaatcggagaaaccctgtcgaggatggccaggaacgcagccggcaagaggaggaaggcaagctgctttccggggtgggagagaatgaaagactgctccgcgagggcgggtaccggacagctggagaaatgctggccagagacccgaagttccaggatcaccgccggaacagagctggcgactattctcataccctgagccgctccctcctgcttgaggaggcccggagactgtttcagagccagcgcacgctcgggaatccccacgcgtcttccaacctggaagaggccttccttcacctggttgcttttcaaaatcctttcgccagcggagaagatatccggaacaaagctggccattgttctctcgagcccgaccagattagagcccctcggcgctccgcgagcgccgaaacctttatgctgctgcagaagacaggcaatctcagactgatccaccggagaaccggggaggagcgcccccttacagataaagaacgggagcagattcatctgctcgcttggaagcaagaaaaagtgacccacaagacgctgagacgccaccttgagatcccggaagagtggctgttcacaggactcccttaccatagatctggcgacaaggccgaggaaaaactgtttgtccacctggctgggatccatgagattcggaaggccctcgacaaaggacccgatcctgccgtgtgggacaccctgcgctccagacgggatcttctggacagcatcgctgatacactcaccttctataagaacgaagacgagattctgccccgcctggagtcccttggcctctctcccgaaaatgcgagagccctggctcctctgagcttctccgggaccgcccacctcagcctgtctgcccttggaaaactgctcccgcatctggaggaaggcaagtcctacacacaggctcgggccgatgcgggctatgctgctccccctcccgaccgccaccctaaactgcccccgcttgaggaagccgattggagaaaccctgttgtgtttcgggctctcacgcagacccgcaaggtcgtgaatgccctggtgagacggtacgggcccccttggtgcatccacctggagacagctagagagctcagccaacccgccaaggtccgccggagaattgaaaccgagcagcaggcgaacgagaaaaagaaacagcaagccgaacgcgagttcctggacatcgttggaacagctcctggccccggggatcttctgaagatgcggctctggagagaacagggaggcttttgtccgtactgcgaggaatatctgaaccctacccgcctggccgagcccgggtacgctgaaatggaccatattcttccctattctcggagcctcgacaatggctggcacaacagagtgctggtgcatggaaaagataatcgcgacaagggcaaccggacgcctttcgaggcctttgggggagatacagcgagatgggaccggctggtcgcctgggtgcaggcttcccacctctctgccccgaagaaacgcaatctgcttagagaagatttcggcgaggaggctgaacgggagctgaaggaccgcaacctcaccgataccagatttatcacaaaaaccgccgccacactgctgcgggacagacttacgttccaccccgaagctcctaaggatcccgttatgaccctcaatgggcgcctgacagcgtttctgcggaaacagtggggactccataagaacagaaagaatggcgacctgcaccatgcccttgatgctgccgtgctggccgtcgctagccgctccttcgtgtaccggctcagctctcacaacgccgcgtggggagagctgcctagaggccgcgaggctgaaaatggattttccctgccctatcctgccttccggagcgaggttcttgccagactgtgtcccacccgcgaagagatcctcctgagactcgaccaaggcggggtgggatacgatgaagcctttcggaacggcctgcgcccggtcttcgtgtctagagccccttcccggcgccttagagggaaagcgcatatggagacactgcggagccccaagtggaaagaccaccctgagggacccagaaccgcttcccgcattccgctcaaggacctgaatctggaaaaacttgagcggatggtcggcaaggatagagaccgcaagctgtatgaagccctccgggagagactggccgctttcgggggcaacgggaaaaaggcctttgtggctcctttccggaaaccctgccgctctggcgaagggcctctcgttagaagcctgcggatctttgattccggatactctggcgtggagcttcgcgacgggggagaggtctacgccgtggcggatcacgaaagcatggttagagtggacgtctatgccaagaaaaatcggttctacctggtgcccgtgtatgttgctgatgtcgcccgcggcattgtgaagaacagagctatcgtggcccataaatccgaggaagagtgggacctcgtcgatgggagctttgacttccggttttctctgttccccggcgatctggtggaaattgagaagaaggacggagcctaccttggctattacaaatcctgtcaccgcggggatggaagactgctcctggaccggcatgacagaatgcctcgcgagagcgattgcggcacgttttatgtttctacccggaaggacgtgctctccatgagcaaataccaggtcgatccgctgggggaaatcagacttgtgggatctgagaagccccctttcgttctgtga

SEQ ID NO: 3798 - RNA, 3162 nt, synthetic construct; identical to SEQ ID NO: 3702
  misc_feature 1..3162: note = Cas9 variant
  source 1..3162: mol_type = other RNA

SEQ ID NO: 3799 - RNA, 3162 nt, synthetic construct
  misc_feature 1..3162: note = Cas9 variant
  source 1..3162: mol_type = other RNA
atgaagagaaactacatcctgggcctcgacattgggatcaccagcgtgggatatggcattatcgattacgagacacggaatgtcattgacgccggggttcgcctgttcaaagaagctaacgtggagaataacgaaggaagacggtccaagcgcggcacgagacggcttaaacgcagacggcgccacagactgcagcgggtgaagaaactcctgtttgatcataatttccttaccgacaactctgagctgagcgggatctccccctatgaagcccgcgtcaagggactcaatcaaaagatctctgaggaggaatttagcgtggcgctgctgcacctcgctaaaagacggggcgttcataacgtgaatgaggtcgaagaggatacaggcaacgagctgtccaccaaggaacagatttctcgcaatagcaaagcccttgaggaaaagtacgtggccgagctgcagctcgaaagactgaaagttgacggggaggtgcggggagctgtcaacagattcaagacatccgattatgtgaaggaggcccagcaaatccttaaagtgcagaaggcttaccaccagtttgaccagagcttcattgatacctatatcgacctgctcgaaacacgccggacctactacgagggccctggggaaggatctccgtttggctggaaagatattaaggagtggtatgaaatgctgatggggcaatgcacgtacttccccgaggagctgagatccgtcaaatatgcctacaatgcggacctctataacgccctgaatgatcttaacaacctggttatcgctcgcgacgaaaatgagaagctcgaatactatgagaaatttcagattatcgaaaacgtgttcaagcagaagaaaaagcctaccctgaaacagatcgccaaggagattcttgtgaatgaggaagacatcaaaggataccgggtcacaagcaccggcaagcccgagtttacaaacttcaaggtgtaccatgatattaaatctatcacctccagaaaggaaattctggagaatgctgagctcctgaaccaaatcgccaaaatcctgacgatttatcagagctctgaagacatccagggcgagctcgcgcgcctgtactccgaacttacacaagaggaaattgagcagatcagcaagctggccgggtataccggaacacaccggctctccctgaaagctattaatcttatcatcgatgagctgtggcacacctctgacaaccagatggaaatttttaatagactcaagctggttcctaagaaagtggatctgagccagcaaaaggagatccccaccacactcgtcgacgatttcattctgtcccctgtggttaaacgcagcttcatccagtctattaaggtgatcaacgccattatcaaaaagtacggctttccgaatgacatcattatcgaacttgctcgggagaagaactccaaagatgcccagaagttcattaatgaaatgcagaaaagaaaccgccaaacgaatgagcggatcgaggaaattatcagaaccacagggaaggagaacgccaaatatctgatcgaaaagattaaactccatgacatgcaggagggaaagtgtctgtacagcctggaagctatcccccttgaggatctcctgaacaatccttttaactatgaggtcgaccacattatcccccggtctgtgagcttcgacaattcctttaacaataaggtcctggtgaaacaggaagagaactctaagaaaggcaatcgcacccctttccagtactttagctccagcgattctaagatttcctacgaaatcttcaaaaagcatatcctcaacctggcgaaggggaaaggaagaattagcaagaaaaagaaagagtatcttctggaggaacgggacatcaatagattttctgttcaaaagtacttcattaaccgcaatctcgtggatacacggtatgccaccagagagctgatgaacctgcttcgctcctactttagagtcaatgacctcgatatcaaggtgaaaagcattaacggcggcttcacgtcctttctgcggaagaaatggaagttcaaaaaggaacgcaataaggggtataaacaccacgctgaggacgccctgatcatcgccaacgctgatttcatttttaaggaatggaaaaagctcgacaaaacaaacaaggttatggaggatcagatcgtggaggaacagcaggccgagtctatgcccgaaattgagaccgaacaagagtacaaagagatcttcattaccccgcatcagatccaggacattaaggattttaaggactataaatacagccacagagtcgataagaaacctaatcgggaactggtgaacgacacactttactccacccgcaaggacgataaaggaaatacactgatcgtgaacaatctcaagggcctgtatgacaaggataacgacaaactgaagaaacttatcaataagtctcccgagaaactcctgatgtaccatcacgatcctcaaacgtatcagaagctgaaggttattatggaacagtacagcaacgagaaaaatcccctctataagtaccatgaagagaccgggaactatctgacaaaatactccaagaaagacaatggacccgtcatcaagaagattaaatactatggcaacaaacttaatgtgtacctggatatcaccagagactatctcaagagccggaacaagattgtgaaactgtctctgaagccttaccgcttcgatgtctatcttgacaatggggtgtacaagtttgttacagtgaaaaacctcgatatcatcaagaaagaggactattacgaagtcgattccgacagctacgaggaagcgaagattgtgaaaaaggtttctgagcaggctcaattcgtggcctccttttataacaatgacctgatcaaagtcgatggcgagctgttcagagtgattggagttaacaatgacctcctgaaccggatcgaagtgaatatggtcgatattacctacaaggagtatcttgaaaacatcaatgacaagaaaagctctcgcatcattaagacgatcagctccaaaacccagagcattaagaaatactctacagatatcctgggcaacctctatgaggccaagtccaagcagagaccgcagatgaccatgaaagggtga

SEQ ID NO: 3800 - RNA, 3162 nt, synthetic construct
  misc_feature 1..3162: note = Cas9 variant
  source 1..3162: mol_type = other RNA
atgaagagaaactacatcctgggcctcgacattgggatcaccagcgtgggatatggcattatcgattacgagacacgggacgtcattgatgccggggttcgcctgttcaaagaagctaatgtggagaacaatgaaggaagacggtccaagcgcggcgccgggagacttaaacggcgcagacggcaccgcctgcagagagtgaagaaactcctgtttgactataaccttctgacggatcattctgagctcagcggaatcaatccctacgaagcgcgggtcaagggcctgtcccaaaagctgtctgaggaggagttcagcgctgccctcctgcaccttgccaaacgcagaggcgtgcataacgttaatgaggtggaagaggacaccgggaacgagctgtccacaaaggaacagatctctcggaatagcaaagctctcgaggaaaagtatgtcgccgagctgcagcttgaacgcctgaaaaccgatggagaggtgagaggctccattaaccggtttaagacaagcgactacgttaaggaggctaaacagctcctgaaggtgcaaaaagaatatcaccagctggatcagtctttcatcgacacctacattgatctcctggagacaagacgcacctactatgaagggcctggagagggctccccgtttgggtggaaggacatcaaagaatggtacgagatgcttatgggacattgcacgtatttccccgaggaactgcggagcgtcaagtacgcctataatgcggatctctacaacgccctgaatgaccttaacaatctggtgattgctagagacgagaacgaaaaactcgagtattacgaaaagtttcagatcattgagaacgtgttcaagcaaaagaagaaacctaccctgaagcagatcgagaaagaaatcctggtcaatgaggaagatattaagggctaccgcgttacatctaccggcaagcccgagttttccaacctcaaagtgtatcacgacatcaaggatattacagcccggaaagagatcattgaaaatgctgagctgcttgaccagatcgccgaaatcctgaccatttaccagagctctgaggatatccaagaagaactcgtgaagctgaactccgagcttacgcaggaagagattgaacagatcagcaatctgaaagggtatacaggaacccacaacctctccctgaaggcgattaatctgatcctcgacgagctgtggcatacaaacgataatcaaatggccatcttcaacagacttaagctggtccctaaaaaggtggacctctctcagcagaaagaaattcccaccaccctggttgatgactttatcctgagccctgtggtcaagcgctccttcattcagagcatcaaagtgattaatgctatcattaagaagtacggccttccgaacgatatcatcattgagctcgcccgggagaaaaattctaaggacgctcagaaaatgatcaacgaaatgcaaaagagaaatcgccagacaaacgagcggattgaagagatcattagaacgaccgggaaagaaaacgccaagtatctgatcgagaaaatcaagctgcacgacatgcaggagggaaagtgtctctactccctggaagccattccccttgaggatctgctcaataacccttttaattatgaagttgaccatatcattccccgcagcgtgtctttcgataacagcttcaataacaaagtcctggtgaagcaagaggaaaattccaaaaagggcaaccggacaccttttcagtacctgtctagctccgacagcaaaatctcttacgaaaccttcaagaagcacattcttaatctcgctaaagggaagggaagaatctccaaaacaaagaaagagtatctgctggaggagcgggatatcaaccgctttagcgtccagaaggacttcattaatagaaacctcgtggatacccggtacgcgacgagagaactgatgaatcttctgcgctcttattttcgggttaacaatctcgacgtgaaggtcaaatccatcaacggcggcttcaccagctttctgagacgcaagtggaaattcaagaaagagagaaacaaggggtacaagcaccatgccgaggatgctctgattatcgccaatgccgactttattttcaaagaatggaagaaacttgataaggctaaaaaggtgatggagaaccagacagttgaagagaaacaagccgaatccatgtctgagatcgagaccgaacaggagtataaggaaatctttattacaccccaccagatccagcatattaaggacttcaaagattacaagtatagccaccgggtggacaaaaagccgaatcgcgagctcatcaacgacaccctgtactccacaagaaaagatgacaagggaaatacgctgattgtcaacaatctcaacggcctgtaccataaggataatgacaaacttaagaaactgatgaacaagtctcctgaaaaactcctgatgtatcaccacgatccccaaacctaccagaagctgaaacttatcatggagcagtatggggacgagaaaaatcctctctacaagtattacgaagagacaggaaactatctgaccaaatacagcaagaaagataatggccccgtgattaagaagatcaaatactatgggaacaagctgaatgcgcatctcgacatcacagatgactaccccaactcccggaacaaagtggttaagctgagccttaaaccttatcgctttgatgtctacctggacaatggcgtgtataagttcgtgaccgtcaagaacctcaatgtgattaaaaaggaaaactactatgaggttaattctaaatgctacgagaaggctaaaaagctgaaaaagatctccgatcaagccgagttcattgccagcttttacaacaatgacctgatcaagattgacggagaactttatagagtgatcggcgtcaacacggatctgatcaatcggattgaagtgaacatggttgacatcacctaccgcgagtatctcgaaaatatgaacgataaaagatctccgcggattttcaagacaatcgcttccaaaacccagagcattaagaaatactctacagacatcctggggaccctctatgaggtgaatagcaagaagcacccccagatgatcatgaaaggatga

SEQ ID NO: 3801 - RNA, 3162 nt, synthetic construct
  misc_feature 1..3162: note = Cas9 variant
  source 1..3162: mol_type = other RNA
atgagcggcatggtgttcgggatcgacctgggaattgcctcctgcggctgggctgtcctcagacagccccaacgggatggggaccctggagagatcgttgatctgggctcttggatgtttgacgtgccggaaaccgataaggagcgcacacccacgaaccaggtgagacgggggaatcgccttctgagacgggtcattcgcagacgggcccagcgcatggtggaaatcagacgcctcttccacgaccatggactgcttgcgggccacgctcctgaggccctgaaacgggccggcctcgatccctgggacctgagagctcggagcctggataaggttctcgaacctgccgctctggccgtggcgcttgggcatattgccaaacgcagaggatttaagtccgctgcccggagaaaagaggctaacaccgccggcgacgatcagaagatgctgaaggcgctcgaggccacacacgaacgcctggggcggtacagaaccatcggagagatgttcgctcgcgaccccgattttgaatctcggaaaagaaatcgcgacggcatgttcgaccggacacaagggagagatgaccttctgcatgaggtcggagagatctttaaggcccagcgccggctcggcagcgctctggccaccgccgaactggagcaggctttcacagcgattgcctttagacagctccctatccaagattccgaacgcctggtgggcctttgtcagttcgagccgaaagaaaagcgggctgccagatttgccccctctttcgagcggtttcgcctgctccagagactgaccaaccttcgggttgtgacggtcgagggggaaagacctctgaccgctgacgagattgccgcggctgccgccgatctcggacgcacagctaaactgagcgtgaaggaagtgcggaagagaatcggcctggccgctgaccaccgcttcgccgcgttcaaagccgatgaggaagacagagatattatcgctcggaccggggaggccctccacggaacatatcgcctgagaaaggctcttggcgaggggctgtgggccgaaatgctccccggacagctggacgcgattgcccatgctctttcctttttcgagacccaagatgtcatcctgaaagaactcgacaagctggacctgcctgccggcgttcgggatgctatcgccacgggcctcgacgccggggcttttgcgcgcttcaaaggaacaggccacattagcgccagagctgcccgggccctgcttccccatctggaggctgggctccgctacgatcaggcctgcaccaaggcgggatatgaccacgctgcctctagatgggccaaacgggaacaggtggctgataaggccgcgtttaatcgcctggtgacagacatgggcgctgagatcgccaacccgattgccagaaagtccctgaccgaggctcttaaacaactctgggccatgcggaatagatgggggctgcctgatgctatccacattgaactggcccgcgacgtcggcaacagcctcgagaagcggagagaaatcgagcgcgcgatcgagaaaaataccgccgctcgggaaagagagcgcggagaagcccgggatctgcttggcattgacgatgtgtctggggacacactgctcagataccgcctgtggaaggagcaggctggacggtgtccctatacggatgcccctatccctcccggcgccattatcgctaccgacaactccttccaggttgaccatattctgccctggagcagatttggggatgactctttcgcgaataaagtgctttgcgccacagctgccaaccagcggaagaagggacaaaccccgtgtgaatggatcacagccgctcagggcgaggaggggtgggccacctttgtcgcgcgcatcgaaggcaatgctgccttcagaggacccaaaaagcggaactacgtgctcaaaaatgccaaggaggctgaggaacgctttagagcccggaacctgaacgatacgagatatgcggctcgcctgctcgccgaagccgttaaactgttctaccctgagggcgagcggcaggacaaagggggagtgagacgcgtctttacacggcccggcgggcttaccgctgccctgagacacgcttggggagtggaagccctcaagaagcgcgatggcaagcgggtcgacgatgcgagacatcacgccctggacgctctggtggttgccgctattggggagggcgaagtgcagcgccttaccagatcctaccaagagtgggaacagcagggactcgcccggcctctgcgcagagtcgatcccccgtggggcgacttccatagcttccggcgcgaggtgaaagatgcctatgacgggatctttgttgctagacctgagcggagacgcgcgcggggagaaggccacgccgctacaattagacaggtgcgcgagcgggatggggccgccgtcgtgttcgaaagaaaggctatcgccgacctgtccgagaaacggctcgcggacattaaggatcccgagcgcaatcaagctatcgtggaagccattagacagtggatcgttgacggacggcctgccgatcgcctgcccagatctcctgctggcgacgagatccggaaggtccgccttagaaccaaagggaagcccgccgtccaggtgcggggcggagcggccgatcgcggcgaaattgtgagagtggacgtttttacaaaaccgaacaagaaagggaagaatgagttctacctggtgcctatctatccccaccaggtcatgaacaaagctgaatggcccacgcctccgatgcgggccgtggttgcttacaaggatgagagcgagtggaccctcctggacgaaaattttggattcctgttttcccttttccccagaagctatgtggaggtcacaaagcctggcggggaagtgctctctggatactttcaaggcatggatcgctccaccggcgccattagcctgttcaaccatcgggactctagaagcctgacagatgactccggaaattctacccgcgggatcggcgctaaaacgctcctgaccatgaagaaatatagcgttgaccggtttgggaagagagccgaggtgaaatccgaagtccgcacatggcacggagtggcgtgcacctaccccacacctcccggctga

SEQ ID NO: 3802 - RNA, 3165 nt, synthetic construct
  misc_feature 1..3165: note = Cas9 variant
  source 1..3165: mol_type = other RNA
atgaagctgacacccctcaactacatcctgggccttgacctggggattgccagcgtgggatgggctgtcgttgagatcgatgaacaggagaatcctctcggcctgattgacgtgggggtgagaaccttcgatcgggccgaagtcgcgaaaacgggagagtcccttgctctggcccgcagactcgcccggtctagccgcagactggtgaagcggcgcgctgacagaatcaaaaaggttaaacggctgctcaagtccgaaaacattctgctttctgccgatgagcaactgccgaatgacgtgtggcagctccgcgtcaagggcctggatcagaaacttgagagacaggaatgggctgccgtgctgctccaccttctgaagcatcgggggtatctcagccaacgcaaaaacgagtccaagtctgaaaataaagagctgggagcgcttagaagcggcgttgccgctaaccaccagatcctgcagtccgccgagtaccggacccccgctgaaatcgccgtgaagaagtttcatgtcgaggaaggccacattcgcaatcagagaggggcgtatacacataccttcagccggctcgacctgcttgccgagatcgaactgctctttacaagacaaaccgagctgggaaaccctcacacatctgctaaactgctcgagaatctgaccgcccttctgatgtggcagaagcccgctctcgccggcgaagccattctgaaaatgcttgggaagtgcacgttcgagcctaccgaatacaaagctgcgaagaactcctatagcgccgagcgctttgtgtggctgacaaaactcaataacctgcggatcctggaacagggagctgagagagccctcaccgataatgagcgcttcgccctgcttgaccagccctacgaaaaggctaagtttacatatgcccaagcgcggaccatgctggctctccctgatgaggccattttcaaaggcgtgagataccagggggaagacaagaaagccgtcgagacgaagacaatcctgatggaaatgaaggcttaccaccagattcgcaaagccctggagaacgctgatcttaaggccgagtggaatgaactcaaaaacaactctgagctgctggacgacatcggaaccgcgttttccctccataagacagatgaagacatctgtcggtatctggatggcaaacttagcgagtctattctgaatgccctcctggagaacctgaatttcgacaagtttatccaactttccctcaaagctctgcagcagattctgccgctcatgctgcagggccaaagatacgatgaagccgttagcgctatctatggggaccactacggaaagaagtccgccgagattaaccgccttctgcccaccatccctgcggatgaaatccggaatcccgtggtgctcagaaccctgacacaggcccgcaaagtcattaacgctgtggttcggctgtatggctctcctgccagaatccatattgagacggggcgggaagtgggaaagagctaccaggaccgcaaaaagctggagaaacagcaagaggataatagaaagcaccgggaatccgctgtccagaagttcaaagagtattttcccaacttcgtgggcgaaccgaaggggaaagacatcctcaagatgagactgtacgagctgcagcaggccaaatgcctctacagcggaaagtctctggaacttcaccgcctgctcgagaaaggctatgttgaggtggatcatgccctgcctttctcccggacctgggacgacagctttaataacaaggtcctggtgcttgctaatgaaaaccaaaataagggcaacctcacaccctacgagtggctggatgggaaaaataactctgaaccttggcagaacttcgtcgcgagagtgcagaccagcggattttcccacacaaagaaacagcgcattctgtctcataagctcgacgagaaaggcttcatcgaaagaaatctgaacgatacccggtatgttgtgcgctttctttgtaatttcatcgccgacaacatgctgctcacggggaagggaaagagaaaagtctttgctagcaatggccaaattacagccctgctgcgggggcgctggggccttcagaaggtgagagatgacaacgatcggcaccatgccctggacgctgttgtggtcgcctgctccaccgtggcgatgcagcagaaaatcacccgcttcgtgagatacgaggagggaaatgtttttagcggcgaacggattgatcgcgagacaggggaaatcattcccctccacttcccctctccttgggcctttttcagagagaacgtcgagatccggatcttttccgaaaatccgaagctggagctcgaaaacagactgcccgactatcctcaatacaatcacgagttcgtgcagccccttttcgtgagccgcatgcctacccggaaaatgacaggacagggccatatggaaacggtcaagtctgctaagagactggatgaggggctctccgtgctgaaagttcccctgacccaacttaagctgaacgacctcgagcgcatggtgaatcgggaaagagagatggccctgtatgaaagcctcaaagtccgcctggagcagtttgataacgacccggctaaggccttcgcggaacctttttacaaaaagggaggcgctcttgtgaaggccgttcgggtggagcagacacagaaatccggggtcctggtgagagacggcaatggagttgccgataacgcttctatggtgcgcgtcgacgtgttcaccaaggccggcaaatactttctcgtgcccatttatacatggcaagtcgctaaggggatcctgcctaacaaagccgttaccgcgaatgtggatgagattgactggctggaaatggatgagagctaccagttcatctttacgatgtatcccaacgaccttgtgaaggtcaaactgaagaaggaagagttctttggatactatggcgggctcgatcgggccaccggagctattgtgatcaaagaacacgacctggagaagtccaaaggcagacaggggatttaccggatcggcgttaagctcgccctgtctttcgagaaatatcaggtggatgaacttggaaagaatatccgcccttgtagacccacaaagcggcaacatgtccgctga

SEQ ID NO: 3803 - RNA, 3165 nt, synthetic construct
  misc_feature 1..3165: note = Cas9 variant
  source 1..3165: mol_type = other RNA
atgagaatcctgggcgtggacctcggggtcgccagcgttggatgggctctggtgaacgataagaataacaaaattatcgactccggcgtgcggattttcacccagtctacaaatcgcgaggggaagacgcttgccgcggtcagacggagctttcgcggaggcagacgggtgctgtcccgcagaaaacaacggctcaaccagctgaagaaacttttcatcgctcacaagctgctctctaagagcgaatttaaacatctgttcaattccaagaaccgcctggatatttggcagctcagagccaaagggctggagcagcaacttaataacaaggaatgggcccgggttctgtaccacatcgctaaacgcagagcctatcagtctaatcggaagtccgaggaatccggaaacaccgacaagaaaaaggtgctcagcggcatctctaaaaatgagaagaaaatgaacgagctgggctacaagacaattggggaaatgctttataccgagaatcgctaccccgataacagaatccggagaaataaaaaggaccagtataagcattccattagccgcgatctgctccggaaagaaatcgacgtcctgtttgagtctcagagagatttcggaaaccaatttgctacagacggcctgaaggagcactacaaagatattgccttcacccagcgccctatcaagtttaaagcggacctcgtggggaagtgcacattcgaaacccaggagtatcggggagccaagaactgtttttccgttgaaaagagcacgctgctttctaagattaataacaccgatctgatcgacaaatccacaggcgagatcaagagactcttcgaaattagcgagtttgacaaactgcttgatatcttctactccattaaggaggtgaagtacaccacactgcgcaaacagctcaagatcaccgacgctttcaaatttaagcaactggattatcatcagaatttcgaatacaaaacgaacattaaggccaagatcgaggacttttataaactggaagattggctcacaccggagcagaaggtcctgcttgaaaaacaagtgctggacgataagaaagagaagttcaaatgctacaagtattctagcatccggtccattctcagcctgtctgagtcccagaagtttaatggggtgaaatacgacaccaaggtcgaaaacacagttttcggaaaacttaatggctatcacagcatcaagaaagagctgaacaaggaagtgtttgatctcctgttcattgacaaggataaatttaataagatcgctgagattctgtcttaccagaaagacgacaagagcgccacccaggatctcaaaaagcaagtgttcaacgactttaatatggataagaccatcgtcaacgaagcgatcaattccctgcttaacatttctttcagcggctttaattccctgagcctcaaagccatcaacaagctgctgccctacctttgtcaggggctcaaatatcacgacgctgtggcccattctgagtacaagcaccattcccagttcaaagctgccaaccctcagcaatatctgagacccctgaataaggaggaaaactaccagattacaagccctacggttaagcgcgtgttctctcagtttcggaaagtcctcaatgccgtgatcagaaagcacggatccttcgatgctatgcacattgagatggcgcgcgaactgaaaaacagcaagaaaatcaagtttgagattcagaccggccaaaaagagtatgcccaggaaaaggaggctatccgggttaagttccttgaaatctttaaatacgaggggtccggaagagacctgctcaagctgcggctgtatgaacagcagcatggcaaatgcatttactctaagaaagagatcgagattaataaacttctcgaagatgggtacgtggagatcgaccacattctgccctggagccgcacattcgataactccctgaataacaaggccctctgtctgtctgccgaaaatcaaaacaaagctaatcagaccccttttgagtatcttacaaacagcgacaagaatagcaaagatagcaaggaatggcaggagtacaaaaactatgtctcttccttcgccggaatcaagcaagcgaagaaacataagctgctcaataccacgctgccgcccagacggggcaacgactttagcgatgacatcaaaaaccctgagtctggcttcctggctagaaatcttaacgacacagcctacgcctcccgctttattaagaatttcgtgcagaaccacctccagtttagccagaatgataccatcaaacaaaaggtcaaggtgcggtctggggctctgaccaaccagctgagatataattggggaattgaagagaaaaaccgcgacaataacctccatcacgccgaagatgctatcattctggccttcgcgacacagggcgaggttcagagaatgagcaccatctccgccaagcgggaagacttcaaataccaaacagctaaggagcgcaaaatcaagtttacgccccctttcagcgattttaagtctgtgcttgacgagtccgtcggggatattttcgtgagctttgcccccagacggaaaatctccggagctgcccacaaggcgaccattaaaccgaaggacacaggcgggaaatataagttccctgttaataacggcatggccgaaaatggagtgatccagcgcgtcgatgtgtttaaaaacgctaagaataagtaccagttcattgtgttttaccccgccgacttctataaagatgactttcctgagctggatctcaagggcaacgaaatcgacaaaaacgttcagttcctgttctctctgtttaaggacgatcttatcgagttcaaaaccaagaagacaaaaaccaaggacagcaaacatctcctggcttactttaagtatattagatccgatgggaaaatcgccttccaacagaattacaaggccgagattgaacggaaggagtctgacaacaaaaagggatataaagatatcctgctcgctacgggcagcgggctggcgtcccttaagaaataccaggtctctgtgctgggagacattgccgaagtgaagaatgagaagcgcctccccctgatcaaacaaatgtataagagcaaacccaagaaaaagtga

SEQ ID NO: 3804 - RNA, 3165 nt, synthetic construct
  misc_feature 1..3165: note = Cas9 variant
  source 1..3165: mol_type = other RNA
atgaaccagaagttcatcctgggcctcgacattgggatcaccagcgtgggatacggcctgattgattatgagacaaagaatatcattgacgccggggtcagactttttcccgaagctaacgttgagaataacgaaggacggcgctccaagagaggctctcggcgcctgaaaagacggcgcatccacagactcgagcgggtgaagaaactgcttgaagattacaatctgctcgaccaaagccagatccctcagtccacgaacccgtatgccattcgcgtgaaggggctgtctgaggcgctgagcaaggatgagctcgtcatcgctctgcttcatattgccaaaagacggggaatccacaagattgacgtgatcgattccaatgacgatgttggcaacgaactgtctaccaaagagcagctcaataagaacagcaaactgcttaaggacaagttcgtgtgccaaattcagctggaacgcatgaatgagggccaggtcagaggggagaaaaaccggtttaagacagccgatatcatcaaagaaattatccagctcctgaatgtgcaaaagaacttccatcagctggacgagaattttattaacaaatacatcgaactcgttgagatgcgcagagaatatttcgagggacccggcaaggggtccccttacggatgggagggcgatcccaaggcttggtatgaaaccctgatggggcactgtacatactttcctgacgagcttcggagcgtgaagtacgcctattctgctgacctgttcaacgccctcaatgatctgaacaatcttgtcattcagagagacggactgtccaagctcgaataccatgagaaatatcacatcatcgaaaacgtgtttaagcagaaaaagaaacccaccctgaagcaaattgcgaatgagatcaacgtgaatcctgaggatattaagggctaccgcatcacaaaaagcggcaagccgcagttcaccgaatttaaactgtatcacgacctcaagtctgtcctgttcgatcagtccattcttgagaacgaagacgttctggatcaaatcgccgagatcctcacgatttaccaggacaaagatagcatcaagtctaagctgaccgaacttgacattctgctcaatgaggaggataaagaaaacatcgctcagctgacagggtataccggaacacatcggctgtccctcaagtgcattagactggtgcttgaggaacagtggtacagctcccgcaatcaaatggagatctttacccacctgaacattaaacccaagaaaatcaatctcacggccgctaacaagatccctaaggccatgattgacgagttcatcctgtctcccgtggtcaaacggacattcggccaggcgattaatctgatcaacaagattatcgaaaaatacggggtgcctgaggacatcattatcgaacttgccagagagaacaatagcaaggataaacagaagtttattaacgaaatgcagaaaaagaatgagaacacccgcaagcggatcaatgagattatcggaaaatatggcaaccaaaatgctaagagactcgttgagaaaatccgcctgcatgacgaacaggaagggaagtgtctgtactccctcgagagcattcccctggaagatcttctgaacaatccgaaccactatgaggtggaccacatcattcctcggtctgtctccttcgataatagctaccataacaaagtgctcgttaagcagtctgagaatagcaagaaatccaacctgacaccctatcagtactttaattctggaaagagcaaactgtcctataaccaattcaagcagcacatccttaacctcagcaaatctcaggacagaatttccaagaagaaaaaggaatacctgctggaggaacgcgatatcaataaatttgaggtgcagaaggagttcatcaaccggaatctcgtcgacaccagatacgccacccgggaactgacaaactatcttaaggcttactttagcgccaataacatgaatgtgaaggtcaagacgattaacggctctttcaccgattatctgcgcaaagtgtggaagtttaaaaaggagagaaatcatggctacaaacaccatgccgaagacgctctcatcattgcgaacgccgatttcctgtttaaggagaataaaaagctgaaggctgttaactccgtgcttgaaaaacctgagatcgagagcaagcaactcgacattcaggtcgattccgaagacaattattctgagatgttcatcattcccaaacaggtgcaagacatcaaggattttcggaacttcaaatacagccacagagttgacaagaagcccaatcgccagctgatcaacgatacactgtattccacccggaaaaaggacaactctacatacattgtgcagaccatcaaagatatttacgccaaggacaatacgacactcaaaaagcagttcgataagagccctgaaaaatttctgatgtatcaacacgacccgagaaccttcgagaaacttgaagtcatcatgaaacagtacgccaacgagaagaatcccctggctaaatatcatgaggaaaccggggagtacctcacaaagtattccaagaaaaacaatggacctattgtgaaaagcctgaaatacatcggcaacaagctggggtctcaccttgatgtgacccatcagtttaaatccagcacaaagaagctcgttaaactgtctatcaagccctatcgcttcgacgtctacctgacggataaaggatacaagtttattaccatctcctatctcgacgtgctgaaaaaggataattactattacattcctgaacagaaatatgacaaacttaagctgggcaaagccatcgacaagaacgcgaaattcattgctagcttttacaagaatgatctcatcaaactggacggggagatctataagattatcggcgtgaactctgatacaagaaatatgattgaactggaccttcccgatatccggtacaaggagtactgcgagctgaacaatattaaaggagaaccgcgcatcaagaaaaccattggcaagaaagtcaacagcatcgagaagctcacaaccgacgtgctggggaatgttttcacgaacacccaatatacaaagcctcagctcctgtttaaaagaggaaattga

SEQ ID NO: 3805 - RNA, 3165 nt, synthetic construct
  misc_feature 1..3165: note = Cas9 variant
  source 1..3165: mol_type = other RNA
atgaagctgacacccctcaactacatcctgggccttgacctggggattgccagcgtgggatgggctgtcgttgagatcgatgaacaggagaatcctctcggcctgattgacgtgggggtgagaacattcgatcgggccgaagtcccgaaaacgggagagtcccttgcgctggctcgcagactcgcccggtctgcccgcagactggtgaagcggcgcgctgacagaatcaaaaaggccaaacggctgctcaaggctgaaaacattctgcttagcgccgatgagcacctccccaatgacgtttggcaactgcgcgtgaagggcctggatcagaaacttgagagacaggaatgggcggccgtcctgctccatctgctgaagcaccgggggtatctctcccagcgcaaaaacgagtctaagagcgaaaataaagagctgggagcccttctgtccggcgtggagaccaaccatcaaatcctccagtctgctgaatacagaacccctgctgagatcgccgttaagaagtttcacgtggaagacggccatattcggaatcagcgcggggcgtatacccacacattcagcagactggatcttctggccgagatggaactcctgtttcagcggcaaaccgacctgggaaacccccacacatccgctaaactcctggagaatcttaccgccctgctcatgtggcagaagcctgctctggccggcgaggccatccttaaaatgctggggaagtgcacgttcgaacccaccgagtacaaagctgcgaagaacagctattctgccgaaagatttgtctggctcacaaaactgaataacctgcgcattctcgagcagggagctgaacgggccctgaccgataatgagagattcgcccttctggaccagccttacgagaaggctaagtttacatatgcccaagcgcgcaccatgctcgctctgccggatgaagccatcttcaaaggcgtgcggtaccagggggaggacaagaaagccgtggaaacgaagacaattctgatggagatgaaggcttaccatcagatcagaaaagcccttgaaaacgctgacctcaaggccgagtggaatgagctgaaaaacaactccgaactgctcgatgacattggaaccgcgtttagcctgcacaagacagatgaggacatctgtcgctatcttgatggcaaactgtctgaatccatcctcaatgccctgctggagaaccttaatttcgacaagtttattcaactcagcctgaaagctctgcagcagatcctccccctgatgcttcagggccaacggtacgatgaggccgtctctgctatttatggggaccattacggaaagaagtccgccgaaatcaacagactgctccctaccattcccgcggatgagatccgcaatcctgttgtgctgcggaccctgacacaggccagaaaagtgatcaacgctgtcgtgcgcctttatggcagccccgcccggattcacatcgaaacggggagagaggttggaaagtcctaccaggaccggaaaaagctcgaaaaacagcaagaggataatcgcaagcagagagagtctgctgtgaagaaattcaaggaatattttccgaacttcgtcggcgagcctaaagggaaggacattctgaaaatgcggctgtacgaactccagcaggccaagtgcctgtacagcggaaaatcccttgagctgcacagactcctggaaaagggctatgtggaggttgaccatgccctgcccttcagccgcacctgggatgactcttttaataacaaggtgcttgtcctcgctaatgagaaccaaaataaaggcaacctgacaccttacgaatggctggatgggaagaataactccgagcactggcagaacttcgtggcgcgggtccagaccagcggattttctcataccaaaaagcagagaatcctcagccacaaactggacgaaaagggcttcattgagcgcaatcttaacgatacaagatatgtggcccggtttctgtgtaatttcatcgctgacaacatgctcctgacggggaagggaaaacgcaaggtttttgcctccaatggccaaatcacagccctgcttagagggcggtggggcctgcagaaagtgcgcgatgacaacgatagacatcacgctctcgacgccgtcgtggttgcgtgctctaccgtggtcatgcagcaaaagattacccggttcgtgcgctacgaagagggaaatgtgtttagcggcgagagaatcgatcgggaaacaggggagattatccccctgcacttcccctccccttgggctttcttccgcgaaaacgttgagattagaatctttagcgagaatccgaaactcgaactggagaaccggcttcccgactatcctcagtacaatcatgaatttgtccagcccctgttcgtgtctagaatgcctacccgcaagatgacaggacagggccacatggagacggtgaagtccgccaaacggctcgatgaagggctgagcgtcctgaaggtgccccttacccaactgaaactctctgacctggagagaatggttaaccgcgagcgggaagtgacactctatgagtccctgaaggccagacttgaacagtttggaaatgacccggctaaagccttcgcggagccttttcataagaagggcggggctgtcgtgaaagccgttcgcgtggaacagacccaaaagagcggcgtcctggtgcgggatggaaacggcgttgccgacaatgcttccatggtgagagtcgatgtgttcacaaaagggggaaagtactttctcgtgcccatttacacctggcaggtcgccaaaggcatcctgcctaacaaggctgttacggccaacgtggacgagatcgattggctggagatggacgaatcttatcagttcatttttaccatgtaccccaatgatcttgtgaaagtcaagctgaagaaagaggagttctttgggtattacggaggcctcgaccgcgcgacaggggccatcgtgattaaggaacacgatctggagaaaagcaagggcaaacagggaatctatcggattggcgttaagctcgctctgtccttcgaaaagtaccaggtggacgagcttgggaaaaacatcagaccttgtcggcccaccaagcgccaacacgtcagatga

SEQ ID NO: 3806 - RNA, 3165 nt, synthetic construct
  misc_feature 1..3165: note = Cas9 variant
  source 1..3165: mol_type = other RNA
atgaaggagaaatacatcctgggcctcgacctggggattaccagcgtgggatatggcatcattaacttcgaaacaaagaaaatcattgatgccggggtgagactttttcccgaggctaatgttgacaacaatgaaggacggcgctccaagagaggctctcggcgcctgaaaagacggcgcatccacagactcgagcgggtgaagctgcttctgacggaatacgatctcatcaacaaggagcagattcctaccagcaataacccgtatcaaatccgcgtgaaagggctgtccgagattctgtctaaggacgaactcgccatcgcgctgcttcatctggctaaaagacggggcattcacaatatcaacgtcagctccgaggatgaagacgcctctaatgagctcagcacaaaggagcagattaaccgcaataacaaactgcttaaggataagtacgtgtgcgaagttcagctgcagagactcaaagagggacaaatccggggcgaaaagaatcgcttcaaaaccacagacatcctgaaggagattgatcagctgctcaaagtgcagaaggactatcataacctggatatcgactttattaatcagtacaaagaaatcgtcgagaccagacgggagtatttcgaagggcccggacaaggctccccttttgggtggaacggagatcttaagaagtggtacgagatgctgatgggccactgtacatacttcccccaggaactcagaagcgtgaaatatgcctactctgctgacctgtttaacgcccttaatgacctgaacaatctcattatccagcgcgataactccgagaagctggaatatcatgagaaataccacatcattgagaatgttttcaagcagaaaaagaagcctaccctgaaacaaatcgctaaggaaattggggtgaaccccgaggacatcaaaggatatcggattaccaagagcggcacgcctcagtttacagagttcaaactctaccacgatctgaagtctatcgtctttgacaagtccatccttgaaaatgaagccattctggatcagatcgcggagattctcaccatctatcaagacgagcagagcattaaagaggaactgaacaaacttccggaaatcctgaatgagcaggataaagccgagattgctaagctcatcggctacaacgggacacatagactgtctctgaaatgcatccacctcattaatgaggaactgtggcagacctcccgcaaccaaatggaaatcttcaattaccttaacattaagcccaataaggtggacctgagcgagcagaacaaaatccctaaggatatggtgaacgactttattctctcccccgtcgttaaacggacgttcatccagtctatcaatgtgattaacaaggtgatcgaaaaatatggcattcctgaggatatcattatcgagctggccagagaaaataacagcgacgaccgcaagaaattcatcaataacctgcagaagaagaatgaggctacacggaaaagaattaacgaaatcattggacaaaccgggaatcagaacgccaagcgcatcgtcgagaaaattcggcttcatgatcagcaggaaggaaagtgtctctactccctggagagcatcgcgctgatggacctcctgaataacccccaaaattatgaggtggatcacatcattccgagatctgttgcctttgacaactccatccacaataaagtgcttgtcaagcagattgaaaacagcaagaaaggcaaccgcacaccttaccagtatctcaattctagcgatgctaagctgtcctacaaccagttcaaacaacatatcctgaatctgtctaagagcaaagaccggatttccaagaagaaaaaggattatcttctcgaggaaagagacatcaacaaatttgaggtgcagaaggagttcattaatcggaacctggttgatacccgctacgccaccagagaactgacaagctacctcaaggcttatttttctgccaataacatggacgtgaaggtcaagacgatcaatgggtccttcaccaaccatctgcggaaagtgtggagatttgataagtaccgcaatcacggatataaacaccatgccgaggacgctcttatcattgcgaacgccgatttcctgtttaaggaaaataaaaagctccagaacacaaataaaatcctggagaagcccaccattgaaaacaacacaaagaaagtcaccgtggagaaggaggaagactacaataacgttttcgagacgcctaaactggtggaagacatcaagcaatatcgggattacaaatttagccacagagtcgacaagaagcccaatcgccagcttattaacgatacactctattctaccagaatgaaagacgagcacgattacatcgtgcagaccatcacagacatttacggcaaggataataccaacctgaaaaagcagttcaataaaaaccccgaaaagtttctgatgtatcaaaatgaccctaagacattcgagaaactctccatcattatgaagcagtacagcgatgagaaaaacccgctggctaagtattacgaagagacgggcgaatatcttaccaaatactccaagaagaataacgggcccatcgttaaaaagattaaactgctcggaaataaggtgggcaaccatctggacgtcacaaataaatatgagaactctaccaagaagctggtgaaacttagcatcaagaattaccggttcgatgtgtacctcacagaaaaagggtataagtttgttaccatcgcctacctgaacgtcttcaaaaaggacaactattactatattcctaaagataagtaccaggagctgaaggagaaaaagaaaatcaaggacacggaccagtttattgcctccttctataaaaatgatctcatcaagctgaacggagacctttacaagattatcggcgtcaattctgatgaccgcaacattatcgaactggattactatgacatcaaatacaaggattattgcgagattaataacatcaaaggggaacccagaattaagaaaaccatcggcaagaagacagagagcattgaaaaatttaccacagacgtgctcggaaatctgtacctgcactccaccgagaaggctcctcaacttatcttcaaacggggcctgtga

SEQ ID NO: 3807 - RNA, 3165 nt, synthetic construct
  misc_feature 1..3165: note = Cas9 variant
  source 1..3165: mol_type = other RNA
atggagaacaagaatctgaactacatcctcggcctggaccttgggattgccagcgtgggatgggctgtcgttgaaatcgatgagaaagaaaatcccctgagactcattgacgtgggcgtgcggaccttcgagcgcgccgaagtccctaagacaggggagtccctggcgctttctagacggctggctcgcagcgccagacggctcacgcagcgcagagtggcccggctgaaaaaggctaaacgcctgctcaagtccgagaacatcctgctttctaccgatgaaagactgccgcaccaagtttggcagctccgggtggagggactggaccataaacttgaacgccaggagtgggccgctgtcctgctccacctgattaagcatagaggctatctgagccagcggaagaatgagtccaaatctgaaaacaaggagctcggggccctgcttagcggagtggataataaccacaaactgctccaacaggcgacataccgctcccccgccgaactggctgttaagaagtttgaggtggaagagggccatatcagaaatcagcagggcgcctatacccacacattcagccggcttgacctgctcgctgagatggaactgctgttttctagacaacagcacttcgggaacccttttgcctccgagaaactcctggaaaatcttaccgcgctgctcatgtggcagaagcccgccctgagcggagaggctatccttaaaatgctgggcaagtgcacattcgaagatgagtacaaagccgctaagaacacctattctgccgagcgctttgtctggattacgaaactcaataacctgcggatccaggaaaatgggctggagagagccctcaacgacaacgaacgcctggctcttatggagcaaccttacgataagaatcggctgttctattcccaggtgagaagcattctcaagctgtctgacgaagcgatctttaaaggactgcgctactccggcgaggataagaaagccattgagaccaaggctgtgcttatggaaatgaaagcctaccatcagatccggaaggtcctcgaggggaacaatctgaaggccgaatgggctgagctgaaagccaaccccacactcctggacgagattggaaccgcgttcagcctttataagacagatgaagacatctccgcttacctggccggcaaactctctcaacctgttctgaatgccctgcttgagaacctcagctttgacaagttcatccagctgtccctgaaagctctctataagctgcttccgctgatgcagcagggcctcagatacgatgaagcctgtcgcgagatttatggggaccactacggaaagaaaaccgaagagaatcatcactttctgccccaaatccctgctgatgagattcggaaccccgtggtgctgagaacgcttacacaggcccgcaaggtcatcaatggcgtggttcggctctatgggagccctgcgcggattcacatcgaaaccggaagagaggtgggcaaatcttacaaggaccgcagagaactggagaaacggcaggaagagaacagaaagcagcgcgagaatgccatcaaggagttcaaagaatacttcccccattttgctggggaaccgaaggccaaagatattctgaagatgcggctctataaacaacagaacgctaagtgcctgtactccggaaaacctatcgagcttcacagactgctcgaaaagggctatgtcgaggtggaccatgccctgcccttcagccgcacatgggatgactcttttaataacaaggttctggtgcttgcgaatgagaaccagaacaaaggcaatctcacccctttcgaatggctggatgggaagcacaacagcgagagatggcgggcctttaaagctctggtcgaaacctccgccttcccctacgctaagaaacagcgcattctctctcaaaagctggacgagaagggatttatcgagagaaatcttaacgatacacggtatgtggcccgcttcctgtgtaattttattgccgacaacatgcatctcacgggcgaagggaaaagaaaggtcttcgctagcaatggacagatcaccgcgctgctgcggtcccgctggggccttgccaaaagcagagaggacaacgatcggcaccacgctctggacgccgtggttgtggcctgctctacagtcgctatgcagcagaagatcacccgctttgtgagattcgaagccggggatgtttttacaggcgagcggattgacagagaaaccggagagatcattcccctccatttccctacgccgtggcaattctttaaacaggaggtggaaatccgcattttctccgataatcccaagctggagctcgaaaaccggctgcctgacagaccccaggcgaatcacgagtttgtccaacctcttttcgtgagccgcatgcccacacggaagatgaccggccaggggcatatggaaaccgtgaaatctgctaagagactgaacgagggaatctccgttattaaaatgccgctcacaaagctgaaactgaaggatcttgagctgatggtcaatcgcgaacgggagaaggacctctacgataccctgaaagccagactcgaagcctttaacgacgatcctgctaaggccttcgcggagccctttatcaaaaagggcggggctatcgtgaaaagcgtgcgcgtcgaacagattcagaagtccggagtgctggttcgggagggcaatggggtggccgacaacgcctctatggtcagagtggatgttttcacaaaaggcggaaagtattttcttgtgcctatctacacgtggcaagtcgctaagggcattctgcccaacaaagccgctacccagtacaaggacgaggaagactgggaggtgatggataatagcgccacattcaaattttccctccaccctaacgacctggttaagctggtgaccaaaaagaagacaatccttgggtatttcaatggactgaaccgggcgaccggcaatattgatatcaaagaacacgacctcgataagtctaaagggaagcagggaatctttgagggcgtcgggattaaactggccctcagcttcgagaagtaccaggtggacgaactgggcaagaacatccgcctttgtaaaccctccaagagacaaccggtgcggtga

SEQ ID NO: 3808 - RNA, 3168 nt, synthetic construct
  misc_feature 1..3168: note = Cas9 variant
  source 1..3168: mol_type = other RNA
atgaacaattacatcctgggcctcgacattgggatcaccagcgtgggatatggcattgtcgattccgacacaagagagatcaaggatgccggggttcggctgttccccgaagctaacgtggacaataacgagggacgcagatctaaacggggcgcccgcagacttaagcggcgccggattcacagactggatcgcgtgaaacatctcctggcggaatacaatcttctggacctcacgaacatccctaagagcaccaatccgtatcagatcagagtcaaagggctgaacgagaagctgtccaaggatgaactcgtgattgctctgcttcacatcgccaaacggcgcggcattcataatgttaacgtgatgatggacgataatgactctggaaacgagctgagcacaaaggatcaactcaaaaagaatgccaaagctctgtccgacaagtacgtctgcgagcttcagctggaaagatttgagcaggattataaggtgcggggcgaaaagaaccgcttcaagaccgaggactttgttagagaggcccggaaactcctggaaacacagtctaagttctttgagatcgaccaaaccttcattatgagatacatcgatctggtggaaacacgccgggagtattttgaagggcccggaaaaggcagccctttcgggtgggagggaaatattaagaaatggtttgagcagatgatgggccactgtacctacttccccgaagaactcagatccgtcaagtacgcttatagcgccgaactgtttaacgcgcttaacgacctgaataacctcgtgatcacgcgcgatgaggaagccaagctgaattacggggagaaattccagatcattgagaacgtgtttaagcagaaaaagacccctaatcttaaacaaatcgctaaggaaattggagtctctgagacagacatcaagggctatcgggttaacaaatccggcaagcccgagttcacccagttcaaactgtaccatgatctcaagaatatttttgaggacagcaaatatctgaacgatgtgcagctgatggacaatatcgccgaaatcattacaatctaccaggatcctgagtctattatcaaggagctcaacctgcttccggaactgctctccgagaaggaaaaagagaagattagcgctctgtctgggtatgccggaacccacagactttccctgaaatgcatcaatctcctgctggacgatctctgggagagctccctgaaccaaatggaacttttcacgaagctgaatctcaaacccaagaagatcgacctgtctcagcagcacaaaattcctatcaagctggtggacgattttattcttagccccgtcgtgaaacgcgcgttcatccaatccattcaggttgtgaacgccatcattgacaagtacggcctccctgaggatatcatcattgaactggctcgggagaataacagcgacgatagacgcaaatttctgaaccagctccagaagcaaaatgccgaaacacggaaacaggtcgagaaggtgctgagagagtacgggaacgacaatgctaagcgcatcgttcagaaaattaaacttcataacatgcaggaaggaaaatgtctgtattctctcaaggatatccccctggaggacctgcttaaaaatccgaaccactacgaagtggatcatattatccctcggtccgtcgccttcgacaatagcatgcacaacaaggtgctcgtcagagccgaggaaaattctaagaaaggcaaccggaccccctatcaatacctgaatagctccgagtctagcctgtcctataacgagtttaagcagcacatcctcaatctgagcaaaacaaaggatcgcattaccaaaaagaagagagaataccttctggaggaacgggacatcaacaaatatgatgtgcagaaggagttcattaatagaaacctcgttgacacccgctacgctacacgggaactgacgtctctgcttaaagcgtacttttccgccaacaatctcgacgtgaaggtcaaaaccatcaacgggagcttcacaaattatctgagaaaggtgtggaagtttgataaagaccgcaacaagggatacaaacatcacgctgaggatgccctgattatcgccaatgctgacttcctctttaagcataacaaaaagctgagaaatatcaacaaagttcttgatgccccttctaaggagattgacaagaaacgggtgaccgtccagtccgaagatgagtataatcaaatgttcgaagacacacagaaggcgcaggctatcaaaaagttcgagattcgcaaatttagccacagagtggataagaagcccaaccggcagctgatcaaagacaccctctactccacgcgcaatattgatggcatcgagtatgtggttgaatctatcaaggacatttacagcgtcaacaatgataaagtgaagacaaaattcaagaaggacccccatagactgctgatgtatcggaacgaccctcaaacctttgagaaattcgaaaaggtgtttaaacagtacgagtccgaaaagaatccgttcgccaaatactatgaggagaccggcgaaaagatccgcaagttttctaaaacagggcagggaccctacattaacaagatcaaatatcttagagagcggctcggccgccactgcgatgtcaccaacaagtacattaatagcagaaacaaaatcgtgcaactgaagatttattcctaccggttcgacatctatcagtacgggaataactacaagatgatcacaattagctatatcgatctggaacagaaatctaattactattacatttccagagagaagtatgaacagaaaaagaaagacaagcaaatcgatgacagctacaaatttattggatctttctataagaacgatatcatcaattacaacggcgagatgtaccgcgttattggggtgaatgactccgagaagaacaaaatccagctcgatatgattgacatcagcattaaggattatatggaactgaataacatcaaaaagacgggcgtcatctacaaaaccattggaaagtctacaacccacatcgagaagtatacaaccgacattcttggcaatctgtacaaagccgctcctcccaagaaacctcagctcatctttaagcgggggatggaatga

SEQ ID NO: 3809 - RNA, 3168 nt, synthetic construct
  misc_feature 1..3168: note = Cas9 variant
  source 1..3168: mol_type = other RNA
atgacccccatcagcgagtcccttctcttcggcctggacgtggggatttctagctgcggatgggccgtccttaagcactccgatacaacgggccatatcgaagctctggggtcttggtgttttaacgcccctgagaccaaaacagaaagaaccccgacaaatcagattcggcgcagctccagactcctgcggcgcgttgtgagacggcgcagaaaccggatgaccgagatccgcagacttttcgcgcggcacggactgattgacaatgatcgccccgacgctctcagacaacctgccatcgatccctgggaaatgcggggccaggggctggaccgccagctgacacctgaggagtttgccgtggctctcgcccatatcgctaagcacagaggattcaaatctagcgccaagcgggtcaaatccaacgcgagccccgatgactctaagatgctggccgctcttgaaaagaccaaagagctgtccgcccagtacagaacgattggcgaaatgtttgctcgcgatagcgcctatgtgcaacggagacgcaatcgggacggcctcttcgatagaaccatctctcgcgacgatctgattgacgaggcgaagatcctttttgaccggcagagaaaactggggaaccctgttgcctccacagagattgaagaggctttcacccgcatcgccttttggcagaatccgatgcaggatagcggagtgctcgtcgcttcttgccccttcgaacctaaggagaaacggtccagcagattttccccctctttcgaacgctttcggctgctgtgtagactcattaacctgcgggtgacagacggccctgaggagcgcccccttaccgaagaggaactgagactcgcctacgagcatgccgggaagacgcggaagctgacagctgcggccatcagaaaacttatcggactgcgcgatgaccaacacttcaccacaattccgcctgaacaggagaagcaggatatcaccagccggaccggcgagacattcgctgggacggccacctttagatccgttctcggagaaagcctgtggcgccagctgctcccccaccctgagtggctggacaatgccgcttggattatctctttccatgaacttacagagaccattatcaaaaagctgggcgaaatcggcctccccgtggaggcctatgagctgatttgcgatgcgcttaaatccgacaagagcccctttgctaaattcaagggggcctctagcctgtccgataaggccgtcagagctctcatcccttacctgcaacagggactgacatatgacaaagcctgtcagaaggctggctacgatcacgccgcgtctcggtttagcgggcgcgccaccattgacacgaaagctaagttcaacgccctcatggctgaagtgagagactccatcgccaatccgattgcgcggaaagccctgagcgagggaatgaagcaactttgggctatgcgcaacagatggggcctgcccggggccatctgcatcgaactcgctcgggatgtgggaaattctctggagaagcgcaaagagattgaaagaaacctgaagacaaccgccaaacagcgggcccgcgagagagaagaggcttgtgaacttctcaatctgaaggaggtctccagcgacatcctgctccggtatagactgtggaaagagcagggcggccgctgctgttactctgggaagtccattacccctgatatgcttatggcgcaggacaaccggatccaaattgatcatatcctgccctggagcagatttggagacgattcctactctaacaagggcctctgcctggccaaagaaaatcaggctaagaaaaaccagacaccttatgagtggattcacgggcagggaaccacagcccaaaaggaacagtgggacaaattcgttgccgatgtggagagccgcaagaatacgaagggcctgaaaaagcggaactttcttctcaaagggtccaaggaaatcgaggagagattccgctctcggaatctgaacgacaccagatacgctgcccgcctgatggtggaagcggctcggctcctgtatcccgccggccagagaggagagaaaggcgggacacggcgcgtctttaccagaccgggagcccttacagctgccctgcggcacgcgtggggcgtggaaagcctcaagaaaatcgatggggagcgcctgcatgacaatagacaccatgctctggatgccgccattgttgctgccgtgtccgaagctgagatccagaagctgaccaagagcttccaagagtgtgaacagaaaggactctctcggcctatgagagacgtcgcgcccccttgggacggctttcgcgatcagctgaaggagaaatacgaaacgattttcgtggcccggcccgagagacagcgcgcccgggggcaaggccacgaggctaccatcagacaggttcgcgaagaggaaacaggacctgtgatttatgagcggaaggccgtctccgctctgaccctcgccgacctggccaaaatcaaggatcccgacagaaacgctggccttatcgcgagcctgcgccagtggattgaagccgggaagccggctgataaacctcccagaacaccctgccatcaatctgccgccggacacgagatccggaaggtgcgcctcgctaccattatcacgcctgccgtcccggtgagaggcgggatggcgaaacggggagagatgacacgcgttgacattttcaaggtgatcggcaaaaaggggaagcccgaatggtacatgatccctatttatccccaccagatcatgaatagatcccagtggcctgctccccctaacaaagccgtcgtggccggcaagagcgaggctgattggcccattatgggagccgaagcgcagtttcaattctctctgtacccgtgcagctacgttcggctgtttaaagagggcaccgtgatcgaagggtatttctgtggatgccatagatcccgcgcttacattacacttgccctcagcaccggcgccgctcctctgcagaaggggatcggaatcaaaacccaggagcacattcagaagttttctgtcaatcggttcggcgagctgtcccccgtgaagcaagaaacaagaacgtggcatggggtggcctgtaccagccctgaccagcacgattga

SEQ ID NO: 3810 - RNA, 3171 nt, synthetic construct
  misc_feature 1..3171: note = Cas9 variant
  source 1..3171: mol_type = other RNA
atgaaggccctgaactacatcctcggcctggaccttgggattgctagcgtgggatgggccgtcgttgagatcgatcagaatgaactgcccattagactcatcgacctgggcgtgcggaccttcgagcgcgcggaagtgcctaaaacaggggattcccttgctctggccagacggctcgcccgctctagcagacggctggtccgcagacgggctgtgcgcctgctcaaggccaaaagactgcttaagcaagaggggattctgcaggctgacgattttcactcctctcatctcaaaccgctgcccaacaatccttgggaacttcgggttaagggcctgaaccacctcctggaccgcaaggagtgggccgcggtgctgctccatctgcttaaacacagagggtatctgagccagcggaagaatgagtccaaaacggataacaaggaactcggagccctgcttaaaggcgtctctgagaatcgccagctgctccaagctcaggccttcagcacccccgctgaaatcgccatcaagaagtttcagcaggaggagggccatattagaaaccaacggggagcgtactcccacacattcgacagaaatgatctgctggccgaactccgcctgctttttcagaaacagcgggagttcaacaatccttataccagccagtctctggaacaagctatcgccgagctcctgatgtggcagaagcccgctctttccggagaagccattctgaaaatgctcggcaagtgcacatttgagcctagcgagtacaaagccccgaagaactcttattccgctgaatacttcgtgtggctgaccaaactgaataacctcagaatcctggagaatggggcggaccgcggacttacagccgaggaacggcagctgctcattaaccaaccctttgaaaaggctaagttcacctatgcccaggccagaaaactgctggagcttagcgatctcgctatctttaagggcgttcgctacgggaaagacaacgccgagtctgcgacgctgatggaaatgaaggcttggcacgccattcggaaagccctggagtccaatggactcaagaccgaatggaacggcctgaagacaaaacctgagcttctggataagatcggcaccgctttcagcatctacaaaacagacgaagacatttcccagtatctcaatggggagctgtctcccgccgtgctgaacgctctcctcgagaatctgagctttgataagttcatcagactgtccctccagagcctggccaaaattcttcctctgatggaacaaggactccgctacgacgaggcgtgtaagcaggtctatggcgatcattacgggaagaaagaacagctggagctgcggttccttcccaagatcccggtggaggacattagaaaccctgtggtcctccgcaccctgtctcaggcccggaaagttatcaatggagtggtgagactgtatggctcccccgctcggatccacattgaaacggggcgcgaggtcggaaagagcttttctgaaagacgggatatcagcaaaagacaagaggaaaaccgcaatgagcggcagagagccgtggagaagttcaaggaatttttccctcattttgttggcgagcccaaagctaaggacattctcaaaatgcgcctgtacgaacagcagcacggcaagtgcctttattccgggaaagagctggatctcaacagactgctggaaaagggatacgtggagatcgaccacgcccttcccttctctcggacatgggatgacagctttaataacaaagtcctcgtgctggcgtccgagaatcaaaacaagggcaatcagaccccttacgaatggctgaacgggaaggagaacgccgaacgctggaaactcttccaggctctggttaatggaagcagatttccgtattctaagaaacagcggattcttacaaagtacctggatgaggacggcttccgcgaaagaaacctcaatgacacccggtatgtggcccgctttctgtgtaacttcatcgaggataatatgcaactggtcgggcagggcaaaaagagagtgtttgcttccaacggacagatcaccgcccttctgcggcgcagctggggcattcaaaaggtcagagaggacaatgatcggcatcacgccgtggacgctgttgtggtcgcgtgctctacaagagccctccagaaaaagatcacggattacgtgcgctataaagaaatgaacgttttcaccggggagaagattgaccaggaaacaggagagatcattaaattccattttcccgagccttggaagttctttcggcaggaagtggagatcagagtcttctccgaaacccccgctgaggatgtggtgattgccctgcctgaccgcccccaagccaatcacgaatttatccagccgcttttcgttagccgggctcctacaagaaagatgaccggccaggggcatatggagacgatcaaatccgccaagcgcctggcggagggactttctgtcagccgggtgcccctgacacagctcaaactgaaggatctggaaaacatggtgaatagagagcgcgaaaaagctctttacgaggccctgaaggtccggctcgaaaagtttaacaatgaccctgccaaagccttcgctgatcccttttataagaaaggcgggcaacaggtgaaggcggttagagtggagcaggtccagaaatccggcgtgctggttcggcaagagaacggagtggctgacaatgcctctatggtccgcgtggatgttttcattaagggcgggaaatactttctcgtgcctatctacacctggcaggtcgccaagggcattctgcccaacagagctgccacccagggaaaggaagaggaatattgggacatcatggacgagacagctattttccaatttagcctttaccagaacgatctgatcaaactcgtgaccaagaaaaagacaatcttcgggtatttcaatggactgaaccgggccacgtccaatattaacatcaaagaacacgacctggataagagcaagggcaaagacgggatttaccttgaggtgggcgtcaagctggcgctctctctggagaaatatcaggttgatgaactcggaaagaatatccagccgtgtcgctccatgaaaaagagacctcccgtgcggtga

SEQ ID NO: 3811 - RNA, 3171 nt, synthetic construct
  misc_feature 1..3171: note = Cas9 variant
  source 1..3171: mol_type = other RNA
atgcccaagcagaaaagcaccagataccggctggccctcgacctgggctccacatctcttgggtgggctgtgctgcgcctcaacgagcaacacgaacctaatgccatcattagagcgggagtccggatcttcagcaacggccgcaatccgaaggatgggtcctctctggctgttacgagacgggccgcccgcgctatgagacggcgcagagaccggcttctgaaacgcaaggccagaatgatgaacaaactcgtggagtatggatttttccccgctgatgtggccgaacggaagaagctggagcgcattaatccttacgaactgagagcgaaaggcctcgacgctcccctgacccctggggagtttgcccgggcccttttccatatcaaccagagacgcggatttaagagcaatcggaaaacagataagaaagagaacgactccggcgctctgaaggccgcgatttctcacctcagacagcagctgcatgaacgcaaggcccggaccgtcggcgagtggctttggcaaagactgcaggctgggctcggaacacgcgcccggtatagagaaagccgcgtggctcaggccaatggcaaaacccggatcgagaagtcctacgatctgtatgttgacagacagatgatcgccgaggagttcgatgctctgtgggcggcccaagctgcctttaacccccagcagttcagcgagcaggcccgcggggaactccgggacgtgctgctttttcaaagagatctgcggcctgtccgcccgggaagatgcacactcctgcccgacgaggaacgggctcctcttgccctgccctctgtgcagagattccgcattctccaggaggcgaatcaccttcggctgctccatcctgatctgagagaggaacccctttccctggctcaacgcgacgccgttgtggacgccctcgagcacaacagcaaaagaacctttgaacagctgcggaagctgctgaaactcaatggcacggtcaagttcaacctggaggatgaaaaacgcaaggagctgaaggggaatgctacctctgccacactctccaaagacggactgtttggcgagaactggtggaaccttgatgaagctctgcaggacgccatcgtgtggcagctcgtgagcgagcaatctgaagagaagctgcagaattggctgcaggcgaacaccggcgtcaatgccacacaggctgaaaccattgccaacgctgggcttccggagggatacggctccctcagctataaagccctggcgagaatcattcctgccctgcgggggacggaggttgctaatggaatcgatgtgccccgcacatacgaccaagccgtgcaggctgccggcttcgcccaccattccgatctcgactctgggttcgattttgaacacagccatgacgaggtcgaaagaattggagagcgggtgatcgcttccaccggcgaggttaagcctgtgttcgcgtttaaacagctgccctactatggcaaggcccttcgcagacacgtcgctttcgccaaggaacacccccggaacgaggaagaacgctacgggaaaatcgccaatcctacagtgcatattggactgaaccagctcagagttgtggtcaatgctctgatccggagatatggccgcccgaccgaagtggtcgtggagctggcccgggatcttaagcaaagcagagagcagcgccaggaggaacagaaacggcaagcggactaccagaagagaaacgaacacattcgccgggagatcgcttctatgcatgggtgtgccgaagagagagtttcccacgccgacgtgcagaaatggattctctgggaggaactgagctttgatgtcgctgaccgccggtgcccctattctggagtgcaaatcagcgcccagatgctgctctccaatcaggttgagatcgaacatattctgcctttctctcagacccttgataacagcctgaataacagaacagtggcgatgcggcaagctaatcgcatcaagggcaacagaacgccctggcaggcccgggaggactttgaacgccaggggtggtcctacgatagcattctccagagagccgagcggatgcctaaggctaaaagatatcgcttctctcgggacggctacgagagatggctgaaggaagataaagactttctggcccgcgctcttaacgatacccggtacctctccagagtcgccaagacatatatggagctggtgtgtcccctgggaacccgcgtgatcccgggccaaatgacagcgctcctgcgggccaaattcgggcttaatgacgttctgggactcaacggcgaaaagaatagagatgaccaccgccaccatgctgtcgatgcctgcgtgattggggtgaccgaccagggactgctgcagagatttgctcaggccagcgccgacgctcggggcaacgggcttgagaagctcgtcgagaatatgcctgtgccctgggcgacgtaccgcgatcacgttaaaagagccatccaatgtatctgggtgtctcataagcctgaccacggctatgaaggacccatgatggaggaaacagcttacggcattcggaaagatgggtccatccgccagaagaccaaagccgacggaagcaccggcagagagattacacacctgatccggattaccgaacctacacagaacctgagacatggggtcgatgcccaaggacagcccctcgcttataagggctacgttgggggctccaatgactgcatcgagattacgcagaacgagcagggaaaatgggaaggcaatgtgatcaccacattccaagcctatgatatcgtgcgccggctggggtctaagcagggaccgagacgccttcggcaccctaccctggcgcagacactcgacgtctacggcaagcccaaaaagctggtgatgagactgatgattgatgactgtgttcggcttgagctggatgggaacaaaaagaccctccgcgtggtcaaaatcacgggaaatggccaggtgtttatggctcccgtgcatgaagccaacgtcgacaagagaaatagcgataagaccgaccctttcgcctacgtttccaaatatgctgggtctttccaaaaggccaaagcgcggcgcattacaatcagcccgattggcgagctgcacgaccccggattttga

SEQ ID NO: 3812 - RNA, 3174 nt, synthetic construct
  misc_feature 1..3174: note = Cas9 variant
  source 1..3174: mol_type = other RNA
atgagcgacaagtccaaaatcctgggcttcgatattgggatcacctctattggatgggcctacgtggagggcgaagaactcatcgactgcggggtcagaatttttacaaaggctgaaaaccccaaaacgaaggagagcctggcccttcctcggcgcgaagcgagaggagttcggcgcagactggctcggcgcaaaggcagactcaatgccatcaagcagctgatctgtaaggagttcgggcttaactatcaagattacattgcccaggacggagagctgccgaaggcttatgccggcaaactcatcaatccctacgaactgcggtccaaagctctgcgcgagaagctcgaaaaagaggagctggccagagtgattcttcacatcgcgaagcatcggggctatgggaacaagcacgccaaagaaaccgatgacgctgagtctggaaagattaaaaaggccatcagcaataacgagaaaattctgaatgagaagggctaccagtccgctggggaatatctctaccaggagtttttccaaaaagagcgcctgcaggaagagaagaagggaaacaatacaaccaaagaatttaagaacgtgagaaataaagccggcgattacgagcattgcatcgcgcagacacagatgcaaaacgaacttcggctgatcttcgagaagcagcgcgagtttgggctcaatttctctgaagagtttaaaaagaaggtcctggaaaccgccttctttcagagacctctgaaagacttcagcgataagattggagactgtacatttatcgagggcgctaaacgggcccccaaggattccctcagcgctattgagttcgtggccctgggcagaatcattaacacccttaaaaatctgcagaacacgtctggggaagtttattcccgcgacaagatcaacgagatcctccaaattgtgctggataagggagaaatcagctacaaaaagctgcgggagattctggacatcgaatcttccgtcagattcaaagacagcaagctcgattataccaaagagctgaaggaggccgaaaagacaaaactgtttgagtctaagaatctccagaaattcaagaaagctctgggctcctttgaagggattagccgcgagatccttgactccatcgcgaaggaaattatgatcaccaaagataaggagaagctggccaaagagctcaagaaattccctctggacgaaacacagattcaaaacctttctaatctgagcttttcccagaccatcaacctcagcctggaggctctgtctcagattctccccttcatgcggggagaaagagaggataagtgcctgcgctacgacgaagccgtggagaaagccggccttaaggaggttgctaagaataaatccaaggatgactttctgcctccgctcgaaaactatgagccctacctggccaatcctgtggtcgcgcgggctctgagcgaatatagaaaagtgcttaacgccctcctgcgcaagtacgggaaaatgcacaagatccatattgagttcacgcgggaagtgggaaagtctaaagaggagagaaataagatcgaaaaagagcagaaggaaaactttgccaaaaatcaagaggctcagaagcagtgtgagatcctgggcctccccattaacggcgccaatatcctgaagatgaaactttggcgcgaacagcaagagagctgcgtctactccgggaaggaaattgctatcgatgacctgaaaaaccctgccattctccaggttgatcacatctatccctactctcggagcttcgacgactcctataataacaaggtgctggtgtttagcaaagagaaccagaataagctgaacaaaacaccgttcgaagcgtttggagagaataaggataagtgggagaaaatcctttctctcgcctccaagctgcctaaacccaagagacagcggatttacaacatgcaattcaaagacaaggaacagggcttcctgacccgcaatatcaacgatacagggtatattgctagactcgtcagccagtggaccaagaattgtctgtcttttgagaaactttccgaagacgaggtgagcatcgccggagaaaagggctccaaagttcacgtggaggtcatttctgggagcctgaccgctatgctccggcattactggggcctgggagataagaacagagacaatcaccttcatcacgccgtggatgcgatcatcattgcctattccaacgagaaagttatcaaggctttctctgactacaagaaacaccgcgaacagaataaggccaaattttacgctaaggagattgccgaaagcgagtataaaaagcaaaaggtgttctttgaacctacaaaccatttccggcagaaagtccttgagaagatcgattccatttttgtgagcaaacctcccagaaagcgcgccagaggcgctctccacgaggaaacgttctactcttttgagcggctgtgcaatgacaaagaatatgcgaagaaggagaaaatggattacgggggaaaggccggcatccagaaagctatcgccctggggaagattcgccaagtcggaaccaaaatcgtgtccaacggcacaatggttagagtggacattttccagcataagagcaatgggaaattttatggcgtccccatctacaccatggatttcgccctcggagtgctgccgaacaaggctgttgtgtctggcaaggacaaacagggggtcattaaggactggcttgagatggattccaactatgaattttgtttcagcctgttcaaagacgatctcatcctggtgcagaagaaagagatggaaaaggccgagctgtgctactacacagactttaattctaacaccgcgggaattaagttcgaaaaacacaataacctttatgtgaatctcaacgagaatgagcggaagctgtttacgagcaaagaagttgtcaagggcgggaaaaagaacgtgtggaaggataaaacacccaaggagatcgaacaactggagaaaaatcgcaagatcattggaggcttcgtgaccatcgaagacctcaaaacctttgagaagtaccaggtctcccctctgggggaggtgcagaaggctgatttcgcccccagacaggccattacacttaaaagctctcctaagcatcggatcaacaaatga

SEQ ID NO: 3813 - RNA, 3174 nt, synthetic construct
  misc_feature 1..3174: note = Cas9 variant
  source 1..3174: mol_type = other RNA
atgagcaacagagtgccctaccggctggccctcgacctgggcaccaattccatcgggtggtgccttctggatctcaacggaaatggcgacccttgtggggtccgcagaatgggagttcggattttcccggatggccgcgaccccaagtctaaagagagcctggctgccgatagacggcttgcgcgctccatgagacggcgcagagaccggtatctgcgcagacggtctgctctcatgaacgccctggtggccgctgggctgatgcctgccgatcgcgctaccagaaaggccctcgaaagcgaggacccctgcgaactgcgggcgagagccctttttgagcctctgacggctggacaggtgggccgcgccctcttccacctgaatcaacggagaggctttaaatccaaccgcaaggctgccggggaagagaatgaggcgggaaaaatcaaggccggcatttctgctcttaaggccgaaatcgaggctagcggggaaaccacactgggagcctggctcgccgctcggcatagaaaacgcgagaccgtccgggcgagactggatggcgccggggctaaggcctcctacgagttctatcccgaacgcggactggtgcacgacgagtttcaggccattcggacagctcaggccctccatcaccctgcggttaccgctgaacagtgggatagagtggagagcgtcatcttccgccaacggccgctgagacccgtgcggcctggcaaatgtacactttttcccgaccaggaacgcgccccttgggccctgcccgttgctcaggagttcagaatcctcaccgagattggcaacctgaaactttaccggccgggggaagaacctagagaactgtctgccgatcagcatgctcaactctttgccaagctgtgccgctccgcggacctgacgttcgagaagatccggaaggaactcaaactggaccccggacttaaggtgaatctggagggcgagaaaagagatcgcctcaagggggacgccgtcaccagcgctctgtctgccaaaaagagatttggacctaaatggaacgctcttacacccgatgaccggcgcgatattgtgggcagactgatcgaagccgaggacgaagcggagctcgccgggtggctggaatccgtgcacggactgcccagcgagaatgctgcccacaccgctgcctctcctggcctcccggatggctattgtcggctgtccgagaaggcccttgtcaagctggttcccctcatgcgcgaacagagactgcggtacgacgaggctgtgctggcgcttaacctccatcacagcgatttccgccctgaagggctgctggacgagctcccctattacggagagcctctggaaagatttattgccttcggctccggggagccctctgatccgcctgaacagcatcttggacggttccccaatcctacagtgcacatcggcctgaacgagctccgcaaactggtcaatagaattgtggaacggtgggggaagcccgctgacatcgttgtggagctggccagagaccttaaacgcagccgggatgagagagacaccatccagcgcgaacaagcccagaaccagcggaagaacgaggatagatttgctaaaattaaggaactcggcatcgaccctcgccccgattccatgctgcggctgagactctgggaggaactgccgaaggtcggagtgggccacgtttgcgtgtacacgggggagcctattggaatccgccggcttctggagggcgacgtcgatattgaccatatcctccccttcagcagaacactgtctgatggggccgacaataaaatcgtgtgtgtccggcgcgcgaacagatttaagcgggatcgctccccctgggaggctttcggagtgaccgccgttgacggctatgattgggccgctattgcccaaagagcggaggaactgcctaaaaataagcggtggagatttcttccggacgctatggaccgcttcgagggggaacggggctttctcgatagacagctggtggagacacgccacctgagccgggtcgccagacagtacctcgcctctatcgtggacctgaacaaagttcgcgtggctcccggaaaacttaccgccatgctgcgggctagatggggcctcaataagattctgagcgatgggaacctgaagaatcgctccgaccatagacaccatgccatcgatgcggccgtccttggaatgattgaccagcggctcgtgcaactggtggctcaggccgctgcccgcgccgaggctaacgaactggagagactcttcgatggcctgcctgacccctttgatgggcttgcggccacctctttcggagaccaggttcgggaaaagatccgcggcatcacagtcagccacagagctgagcacgggtggcagggccggatgcataatgatacggcctatggacctgtggaggccgtgaacggcgtccacaccgtggttacaagaaaacccctgtccgggctcaccgctaaggactttcctaatattcgcgatcgggtgctggccaaagcgctggaagaccatgtcgctgccgaggccgctgccggacgcagcttcggcgacgcgcttgggtcttttaagtggggaggccaacccgtgagacgggttagaatgctggatgtgctcgggaacccgatccctattcaggacccctccggcacagtcttcaaggtgtacaaaggagatagcaatgcttggtatgaaatcctgcgggaccctcgcggcagatggaccgggaagattgtttctacgttcgaggcctaccggctccaccgcgaatggctggccgagacaggaggcgattccgggagaggaagcggcgtgtttcttgactgggctgccaaacgggtcgtgggcgaggctgggacacccctgttccgcctctttaagggagatctgctggcccttggcgaagcgccggacagacggatcgtgcgcgtcgttaaattctccgagggacaggtggccctggctctccacctggaagccgggaacctcaaggctagagatgccgacaaaggcgatccttttaagtatcagtactgctctcccgacagcctgcggaagcaagccgctagacctgcgggggtggaccttctgggatacgtccatgataaaggccccctcgagtga

SEQ ID NO: 3814 - RNA, 3174 nt, synthetic construct
  misc_feature 1..3174: note = Cas9 variant
  source 1..3174: mol_type = other RNA
atgagacggctgggcctcgacatcgggaccaacagcattggatggtgcctgatcgaggatgacaagaaaattgtggatatcggcgtccgcattttctccgacgggagagatcccaagtctggagccagccttgctgttgaccggcgcgatgccagagcgatgcggcgcagacgggaccgctacctgggcagacggtccgcttttctccaggccctggtggtgcacgggcttatgcctgccgatgctgacgaagccaaactggtcgctgatcgcgacccgtatcaactcagagccaaggcgctgcatgtggccctggagcccttcgaaatcggacgggctctctttcacctgaatcagcgcagaggcttcaaatctaaccggaaggccgatagaaaggctaatgccggcgaggacgggaaaatcgcggaaggagccaaggctcttgaccaggccatgagcgaggctggcgttgatacactggggcagtttctcgccctgaaagagacgaagcgcgtgcggcttggatccgacggccaagcctacgatttctatcctcagagacgccatattgaatacgagtttgaccggatctggaaagtccagtctgaatatcaccccgctctgctcaccgaggcggccagagctgccctgcatcgcattctgttctttcagcggcctctcaaggcccaagaggtggggttctgtacatttgctggagttaacggcatcgccgcgaatgaaagacgcctgcccaaggctcaccctcttttccagcagcggagactgtacgaggaagtgaaccagctccgcattgtcagcgccggcgccgctgatcggccgctgacccttgacgagagagatcggctgatcctccgcctgcaagacagaaagaaggtgtcctttgatacactggccaaaaaggacctccggctggctgatggggaaagattcaataaagagagcgagaaccgcaaggaacttattggagacgaggtgcgggccgaaatgtctgacaaaaagagattcggcacccgctgggtccactttgggctggatgagcagctcagaatcctggcgaaacttcaggacgaagagaatcccgaggccctgctcgattggctgcggtccgaatatggactggacgaggctgccgctgaaagcgttgccaacgcgcgcctccctgagggctacgggagattcggagaaacagccacccggctgcttctggatgctctcaaagccgaggtgatcacgtacgacaaggctgccctgcgcgcctttggccatcactctgatttcagaaccggcgaggtgctggaccggcttccctattacggggaactcctgacacgcgagattgctcctggaaaacccgaatatggcgatccgctggagagacaatacgggaagatcaccaatcctacagtccatattggactccggcagctggagaaacttgtgaacgcggttatcgccgtgcacggccgccccgaccagattgtcgtggaactggctagagagctcaagctgaatgaaaaggagaaagatgaacacaagcggagaatcaaacgcgacaccgatgccgccatcgctcgggggagaaagctggcctccgagggctttattgacaacggagcgaatcgcatgcttatgcggatctgggaggaactcaaccctgctaaccccctggacagacgctgcccctattgtgccgagcctattggcatccgggccctgttcagcggggaagctgatattgaccatatcatcccgtactctagatccctcgatgacaatgttggaaacaaagtggtcgcccaccgcagctgcaatcgggcgaagggcaacaagacgccctatgagaaatgggggcctcatattgatcccgaaagatgggagcggatctccgaccaggtggctcgcctgcacaagtctaaacaatggagatttggacctgatgccatggagcggattgaccgcgatggcgggttccttgccagacagctgacagacacccagtacctcagccgggtcgctggcaagtacctgagatccctgtatcccacagcccagagcggacgcgtggatgttatcccgggccggatgaccgctatgcttagacgcaaatgggggctcaattctctgctgcctgaccataactacgtggaaaatgagcactccaacgcccccaagaatcggctcgatcacagacatcacgcgattgacgccgctgtcgccgctgtgaccacactgagccttatgcaacagatcgccgacgccgctggacgcgcggaagataagaacctggaccggctctttgaggatattcctcagccctggcctggcttcagagaggaactgggggaggccctgcgctctacgaccgttagccataaagctgaccacggaagaaagcggcgcccctccagagatcgggacgtgacagccgcccgccttcacaatgataccgcttatggcctcacaggggacgtcgccgcggatggcaaaaccccgatcgtggtgcatagagttcctctggcttctctgaagcccgccgacctcatcgatcccctgcggattcctgacccggtccttagagacgccctgtacgctgccacgcgcgatcggacaggaaaagaatttgagcaggcgctcacccaattcgctagacaccatcccctgtttaagggcatccgccgggtgagagtgcgggaacctctgaacgtcattcccatccgcgacgccgccgggagagcttataaagcctacaagggagatgctaatgcccggttcgacgtgtggcgccttcctaacggcaagtgggttagcgatattgtgtccatgttcgacgcgcactgtatggccgataaaagcgacagacggccccatcctgctgccaagaaagtcctgtctctccgccagaatgatatggtggctatcgagagatccggggttacccagatcgcccgggtggtcaagtttagcacaaacggatctattgccctggctgcggacaacgaggccggcgctctcaaagcccgcgatgccgctcccaatgacgtggatccgttcaagtatatcttttccagcgggggcggactgaagaaccttaaagccagacaggttcgggtggaccctctgggcagagtcttcgaccccgggcctcgcgaatga

SEQ ID NO: 3815 - RNA, 3177 nt, synthetic construct
  misc_feature 1..3177: note = Cas9 variant
  source 1..3177: mol_type = other RNA
atgaagaacagctacatcctgggcctcgacgtggggattgcctccgtcggatatggcctgatccactctgatagcaaatccgttattgacgctggggtgagacttttccccgaggccaatgtggaaaacaatgagggacggcgcgcgaagagaggctctcggcgcctgaaaagacggcgcatccatagactcgatcgggtcaagtacctgcttgctcagtatcacctgattatcgacgataaaatccctaagagcaccaacccgtacgccattcgcgtgaaggggctctcctctgccctgagcaaatccgaactggttatcgctctcctgcatcttgccaagagacggggcattcacaatgtgaacgtcgtgatggacgagaatgaaagcacaaacgagctgtctacgaaagagcaactcaaggaaaatgctaaacagctggagaaccgctatgtttgcgaacttcagctggatagactcaatgagcagtacaaggtgcggggagagcgcaacagatttaagaccgaagacttcgtccgggaggccagacaaatcctgacaacccagcagaaatatcatgatattgacgaacactttatcgagcagtacacacaccttctcgaaacccgccgggagtactatgagggccccgggaagggatcccaatacggctgggaaggggatctgaaacagtggtatgagatgcttatgggaagatgtacatacttccctgaagaactgcgcagcgtgaagtatgcgtacaccgccgacctctttaatgctctgaacgatcttaataacctggtgattgcccgggacgaaaacgagaaactcgagtatttcgaaaagtaccatatcatcgagaatgtctttaaacagaagaagtctcccacgctgaaacagattgctaaggaaatcgacgttaaagagtccgatattaagggctacagaatcaccaaaaacgggaagcctcaattcaccagctttaagctgtatcacgacctcaataaaattttcctggataagaaaaaccttgaaaatatcgagctgctcgacgagatcgcctttattctgacactttaccaggatcccctgtctatcaaggaagcgctcgaccagctgcaagatctgctcacagagtccgaaaaagaggccattgctcatctgaacggatataccggcacgcaccgccttagcctgaagtgcctccatctgctgatcgacgagatgtggcagacatcccggaatcagatggaagtgttcaccgcccttaacctcaagcctcagaaataccaactgtctaagcagaaacagattccgaagaaaatggtggaggaatttatcctgagccccgtcgtgaagagatccttcatccagagcattgagatcgttaatacaattatcaagaaatatggcctccctgaagagattatcattgagctggctcgcgaaaagaactctgaggatcggagaaaattccttaatcgcatccaaaaggaaaacgagaatacccggaaacaggtggaagaggtcatcagagagtacgggaaccggaatgccaagggactggtggagaaaattaagctccaccagatgcaggagggcaagtgtctgtattccctgcaaaacatcccccttgacgatctcctgcgcaaccctagccactacgaaattgaccatatcattcccagatctgttagctttgacaattccttcaacaataaagtgctggtcaagcaggaggaaaactctaaaaaggggaatcggaccccgtaccagtatctcaacagcaatgagtccgtgctgagctacgtccagtttaaacaacacatccttaacctgtctaagtccaaggagagaatcagcaaaaagaaacgcgaatatctcctggaggaacgggatattaataagttcgaggtgcagaaagagtttatcaacagaaatctggttgacacacgctacgccacgagagaacttgtgcagctcctgaagtcttatttctccgctaacgatctggacgtcaaggtgaaaaccattaatggcagctttacaaactacctccggaaggcgtggaaattcgataagtcccgcaataaaggatttaagcatcacgccgaggacgctctgatcattgccaacgtttcttatcttttcaagcaaagcaaagaactgaaggaggccaacgctatcctcgaaaataacaatctgtccctgaacaaaaataaggattctaaaaaccttctcaccgagcaggactacagaaagatgtttgagatccctaaacaggtgcaggatattaaggactacaaggatttcaaatatagccaccgggtcgacaagaaacccaatcgccaactgatcaacgattccctgtacagcacaagagaagtgaatgagaaccattatattgtgcagaccgttaaggacatctacgccaaagacaatacgaagattaaggatctctttctgaaaacacctgaaaagctgctgatgtatcagcacgacccccagaccttcgagaaactcatgctggtcatcaagcaatacggggaagagaaaaaccccttcgcgaagtattacgaggaaaatggagagtacctgaccaagtatgctaaaaacgaaaagggccctacaatcaaacggcttaagtacattggcaaaaaggtggggacccatctggatatctctacaaatttttccggagccaagcgcaaagtggtccagctcagcattaagccgttcagatttgacgtgttccactctaaagccggctatcacatgctgacgctcacctacatggatatcaagaaaaaggagaagcattatcagattctgaaaaacgaataccaggctcttaaggagcggtataaagttccctccgacgcccaatttatcgggagcttctactacaacgatctgatttctatcaatgacgagctctttcgcgtgatcggagtcaacaatagcacaagaaacgtggttgaactgaatatggtggatattaactataaggactactgcgatctgatgggcatcaaaaagacccctcggattttcaaaacaatcaccaagaagacggggaaaattgagaagtattccaccgacatccttggcaatcagtttaaagtcaagcccagcaaatctcctcagctgatcttcaagagaggagtgctctga

SEQ ID NO: 3816 - RNA, 3180 nt, synthetic construct
  misc_feature 1..3180: note = Cas9 variant
  source 1..3180: mol_type = other RNA
atgagacggctgggcctcgacatcgggaccaacagcattggatggtgcctgacacagggccccggggatgaggccgacggaatcgtggatattggcgtccgcatcttctccgacgggagagatcctcaatctggaacgagccttgctgttgaccggcgcgatgccagagcggctcggcgcagacgggaccgctacattggcagacggtccgcctttctggataccctcgtggcccacggcctgatgccggctgacgccgatgaagctaaacttgtggccgcgctggacccctatacactccgcgccagagctctggaggcccctctgacaccccatgaaatcgggcgggctctcttccacctgaatcagcgcagaggatttaagtctaaccggaaggccgagagaaaaaccaatgatgcggacgacggcaagatcgccaccgctgcctacgctcttgatcgcgccatgctggacgggggattcgatacactcggccagtttctgaacgcccaggaaaccaaacgggtcagaatggacggggaggctcaaggatatgatttctaccctcagcgccggcatgtggagtatgaatttgacagaatttggacggagcaggcgaagcaccatcccgcccttctgaccgaaacagctcgctacgccctccaccggatcctgttctatcagagacctctgaaggcccaagttgtgggcaaatgtacctttgtccacagcgaggatcgcctcgctaaggcccatccgctgttccagcagcggagactttacgaggaagtgaatcagctggaggttacaacccccggcgaagcgaaccgcaaactcacgctggacgagcgggatagacttgtgcgggaactgtcccacaagaaagctattgcctttacatctctcgccgctaagatcaagctggagcctgggcagagcttcaataaagcctccgagacccgcacacaactggctggagacgaagtcagagccgtgctcggcgataagaaacggtttgggcccgcgtgggagcatttcgacagagaccgccagtggaccattgtggaacggctgcttgaggaagaggatcctgacgccctgcacgctttcctcacccaagattgcggactggacgatgagcacgccgctgccacagcgaagacgagccttcccgaaggctacgggagactgggagccaccgctacagcccgcatcctcgctgagctgcaggccgaagtcattacctatgacgaggccgttagacggtgtggctggcatcactctgatcatcgcacaggcgaaatcctgccgcagctcccttactatggggagctgcttaccagagacattccccctggaacgcaggatcccaacgatccccctgagaaacggtggggccgcatcacaaatccgaccgtgcacatcgggctgaaccaagtgagacagctcgtcaatgctattgtggcggttcatggacggcccgaccagatcgtggtcgaactggcccgcgagctgaaacttaacgaaaaggacaaggaggagcacaatagacggattcgcagagataccgctgccgccatcaagcggtccgaaaaactcacacaggagggctttcctgacaccggggctaacagaatgctgctgcgcctctgggaagacctgaatcccgccaaccctcttgatcggagatgcccctactgtggcgcgccgatcggaatgcgcgctctgttcgccggcgaggccgacgtggatcacattatcccttatagccggtctctcgacgattccgctgggaacaaggttgtggcccatagaagctgcaatcgcgcgaaaggaaaccggacaccctacgaaaagtggtctgacgatcctgacagatgggatgctattacggcccaagtcgcccgcctgcaccggtccaaacagtggagatttggccccgacgctatggcccgggtggagaaggatgggggattcctgagccgccagcttaccgacacacagtatctctccagactggctggccggtacctgtctagcctctaccctaccaaggaggaagggtccgtctatgtgatccccggccgcatgacagccatgctgagacggctttggggactgaatgatattctcagcgaccataacatcgttgagaataaacactctaacgcgccgaagaatagactggaccaccgccatcacgccatcgatgctgccgtggtcgctgtgtccacccggagcctgatgcaaagaattgcccgcacggccggccaggctgaagaccggaaccttgatagactctttgaggggctggaccctccctggcccggattccgcgatcagctgcgggacagactcctggcggttaccgtgtctcataaagccgatcacggccgcacagggacccctgtcccgggaaaggacgctacagccggcagacttcataatgataccgcctacgggctgacgggcgaaacaagcgctaaaggactccccatcgtggtgcaccgggttcctctgacctccctgaagcccgccgacattacagatcctgaccgcatccccgaccctgtccttagagatgcgattgagcgggctaccgccggcaagatggggaaagactttaccgatgccctcgctaagttcggacgctctggcgcccaggagacagacagaaaaggggaacggctgtttagaggaacgcgccgggtgagagtgcgcgagcccctgggcgtcatcccgattgcggatgctagcgggcgggtgtataaggcctacaaaggcgactccaacgccagattcgatgtttggcggctccctgacggaaagtgggtgagcgatatcgtctctatgtttgacgctcaccgccccgatcaaggcgacagacggcctcatcccgccgctaagaaagtgctgtcccttcgccagaatgatatgatcgccattgaaagagacggggcgccgcgggagatcgttcgcgtggtcaagttcagcaccattggatctgtgcagctggccgctacaaccgaagccggccctctcaaagctagagacgcctcccctcccgatgttgacccctttcggtatatcaacagctccgccgggggactgaagaaaattaaggctcgccaagtgagaatcgatcccctgggccggatcttcgaccctggcccgagatga

SEQ ID NO: 3817 - RNA, 3180 nt, synthetic construct
  misc_feature 1..3180: note = Cas9 variant
  source 1..3180: mol_type = other RNA
atgatcgagcggattctgggcgtggacctcgggatcagctccctgggatgggccattgtcgaatacgataaggacgatgaggctgccaacagaatcattgactgcggcgttcgccttttcaccgcggctgaaacacccaaaaagaaagagtctcctaataaggccagacgggaagcccgcgggatcagacgggtgctgaaccgcagacgggtgcgcatgaatatgatcaaaaagctctttctgagagctggacttattcaggatgtcgacctggatggcgaagggggaatgttctatagcaaggccaaccgggctgacgtgtgggagctccgccacgatggcctgtacagactgctcaaaggcgacgaactggcccgggttcttatccatattgcgaagcaccgcgggtataaatttatcggagatgacgaggccgatgaagagtccggcaaggtgaaaaaggctggggtcgtgctgagacaaaatttcgaggccgctggatgtcggacggttggcgaatggctctggagagagcgcggggccaacggaaagaaacggaataagcatggcgactacgaaatttctatccacagagacctgcttgtggaggaagtcgaggcgatttttgtggcccagcaggagatgcgcagcaccatcgctacagatgccctgaaagctgcctatcgggaaatcgccttctttgtgagaccgatgcagcgcattgagaagatggtcggccattgcacctacttccccgaggagcggagagctcctaaatccgcgcccacagccgaaaagtttatcgctatttctaaattctttagcaccgttatcattgacaacgaggggtgggagcaaaagatcatcgaacgcaagacactcgaggaactgctggatttcgccgtgtcccgggagaaagtggaatttagacacctccgcaagttcctggaccttagcgataatgagattttcaaaggactgcactataagggcaaacctaagaccgccaagaaacgggaggctacgctctttgaccccaacgaacctaccgagctggaatttgataaggtcgaggccgagaaaaaggcgtggatctctcttagaggggctgccaaactgcgggaagccctcggaaatgagttttacggccgcttcgtggctctggggaagcatgccgacgaagctacaaagattctgacctactataaagatgagggacagaagagacgggaactcacaaaactgccgcttgaggccgagatggttgaaagactggtgaagatcggcttttccgacttcctcaaactgagccttaaggcgattcgcgatatcctgcccgccatggagtctggcgctcggtacgacgaagccgtcctcatgctgggggtgcctcacaaggagaaatccgctatcctgccccctctcaacaagaccgacattgatatcctgaatcccacggttattagagcctttgcgcagttccgcaaagtggccaacgctcttgtcagaaagtatggagcctttgaccgggtgcatttcgaactggctcgcgagatcaatacaaaaggcgagattgaagatatcaaggagagccagagaaagaacgaaaaggagcggaaggaagccgccgactggattgctgagacctcttttcaagtcccgctcacacgcaaaaacatcctgaagaaaagactgtacatccagcaggatgggcggtgtgcgtataccggagacgtgattgagcttgaacgcctcttcgatgagggctactgcgaaatcgaccacattctgcctagatcccggagcgccgatgactcctttgctaataaggttctgtgtctcgcccgcgccaaccagcaaaagaccgatagaacaccctatgagtggttcgggcacgacgctgcccggtggaatgcgttcgagacgagaacctctgctcctagcaaccgcgtgcggacaggcaagggaaagatcgatagactgcttaaaaagaattttgacgaaaactccgagatggccttcaaagaccgcaatctgaacgatacccggtacatggccagagctattaagacatactgcgaacagtattgggtctttaaaaatagccataccaaggcccccgtgcaggttcgctctggcaagctcacgtccgtgctgcggtaccaatgggggctggagagcaaagacagagaatctcacacacatcacgcggtcgatgctatcatcattgccttcagcacccagggaatggtgcagaaactttccgagtattaccgctttaaagagacccatcgggaaaaggagagacccaaactcgccgtgcctctggctaacttccgggacgccgttgaagaggctacacgcatcgaaaataccgagacagtcaaggagggcgtggaagtgaagagactgctcatttctcggccgccccgcgccagagtcacggggcaggcgcacgagcaaaccgccaaaccttatccccggatcaaacaggtgaaaaacaagaaaaagtggagactggctcctattgatgaagagaaatttgagagcttcaaggccgaccgcgttgcttccgccaatcagaagaacttttacgaaacaagcaccatcccccgggtggatgtctatcacaaaaagggaaaattccatcttgtgccgatctacctgcacgagatggttctcaatgaactgcctaacctgtctcttggcacaaaccccgaggccatggacgaaaatttcttcaagttttccattttcaaagatgacctcatcagcattcagacccaagggacgcctaagaagcccgctaaaatcattatgggctacttcaagaacatgcatggagcgaatatggtgctgtcttccatcaacaatagcccttgtgagggctttacctgcacacccgtctccatggataaaaagcacaaagacaagtgtaagctgtgcccggaggaaaacagaatcgccgggcgctgtctccagggattcctggattattggtctcaggagggccttcggcctcccagaaaagaatttgagtgcgaccagggggtgaagttcgctctggacgttaaaaagtaccaaattgatcccctcggatattactatgaagtgaaacaggagaagcgcctgggcaccatccctcagatgcggagcgccaagaaactggtcaagaaatga

SEQ ID NO: 3818 - RNA, 3180 nt, synthetic construct
  misc_feature 1..3180: note = Cas9 variant
  source 1..3180: mol_type = other RNA
atgagcaagagactgcggtaccgcctcgccctggaccttggcaccaactccatcgggttctgcctgctcgatctgaatggagacggcagaccctgtggggtgcggcgcatgggagtcagaatttttcctgatttctctaaacttcagcaaagcctggctgccgaccggcgcctcgcgagatccatgcggcgcagacgggatcgctatctgagacggcgcaaggctctgatgaacgccctcgttgccgctgccctgatgccggctgaccccaaagccagaaaggcgcttgaggccctggatccttacgaactccgggctgccgctgtggccggccccctgcctgcgcaccagcttgggagagccctgtttcatctcaatcagcgccggggattcaaatctaacagaaaggctgccggcgacgagaatgaagctggcaaggtgaaaagcgggatctccgccctgaaggccgagctggctgcgtctggagccggcacactcgggcagtggctggctgcccgccacgccaaccggcaacccgtcagagctcgccttacgggaaccggcgccaaagcgacatatagcttttaccctgaacgggctctggtgcatgaggagttccaggccattagagccgctcaggccccgcaccatcccggggttaccgctgaacagtgggatcgcatcgagtccgtgatttttcaccaacggcctctcaagcccgtcaaacctggaaagtgcacactgtatcccgaagaggagagagccccgtgggcgcttcctatcgcccagcgcttccggatcctgcacgaactccataatctgagaattgtgcggcccggccagggcgaggaagggctgagccctgctgactttgatcgcttctttgacagactctgtcggaagggagatctgaccttcaaaacacttgccaaggagctgaaactccctcccgacgctagaatcaacctggaagacgataagcgcgaccggcttaaaggcgatgccaccgcggacgccctgtctgctgagaaggggaaaagacgcagaattggagccgcttggcactcctttcccgccgatcggcagcgcgagatcgttggcagactcattgacgccgaagatgagggggaactggctgcgtggctggtggaggaactcggactgccgtgggaggtcgccatccttacggctgagcggcccggcctgcctgacggctactgccgcctcagcgaaaaggccctggagcaagtggtgcccctgatgcatgaggaacaccttccttatgatgaagccgtcagagctctcgggctgcaccattctgaccaccggaccggagagttcctggatgagctcccctactacggcctgccgcttgaacgcttcattgcctttgggacaggagaggcggacgaccctcccgaactgagaatcggccggttccctaatcccaccgttcatgtggctctcaacgagctgcgcagagtggtcaatcggatcattagacgctgggggaagcctgaggaaatcgtggttgagctggcccgggatcttaaacagtccagagccgaccgcgataagacacagcgggaacaagctgacaaccagaaaaagaattggaccagaacgcagcagctccgcgagctgggcatggaacccacaggagaggccctgctccggctgagactttgggaggaactgccgcgcattggcagcgcgcacgtgtgtgtctataccgggcaacctatctctatgacacagctcctgcagggagatgtggacgttgatcatattctgcccttttcccggacccttgctaacggcgccgacaataaaatcgtgtgccacagacgggccaaccgcatcaagagaaaccggaccccctgggaggctttcggggtcgtgagcgccgatggatacgactgggctgccattgcggaacgcgccgagtccctccctaagaataaaagatggcggtttctgccgaacgctatggaaagattcgagacagagcgcggctttatcgatcggcagctggtcgaaacgagacacctctctcgcgtggcccgggagtatctggggtgtattgttccccttgaaaaggtgagagctgcccctggccgcctgaccgccatgctccggggaagatggggcctgaatagcatcctgtccgacgctaaccttaaaaatcgcagcgatcatagacaccatgcggtcgacgccgctgtgctcggggttattgaccaacggctggtgcagcgcgtcgccgatgccgctaagagagccgaggaaaaagagctggagaaactcttcgacggactgcccgatccttttgaaggccttcccgggccttctttccgggaccaggtgcaggagcgcgcgcaaggaatcatcgtgtcccacaagcccgaacacggctggcaggggagaatgcataacgatacagcttacggcccggttgagcggctgcctgacggaacccacagagtcgtgacacgcaagcccctcggcagcctggccgagaaggattttgggaatattcgggacagagccctggctgccgcgcttgaacgccatgtggctgagcaggccgcccagggacggtctctgggcgaagctctcagctgcttcacctggacagggggagaggtcagacgggtgcgcatgctggataaactcggctcccctgttgccgtgcaagacgatgacgggcacacgtttaagctgtataaaggcgattctaacgcttggtacgaaatccttagagacggacggggccgctggaccgggagaattgtcagcacctatgaggcctaccggctgcatgcggagtggctcgccgaacgcggagacggcgggagatccgatgctgccttccccgactgggctgcccggcgcctgtgtgccggaatcggcaagccgctgttcagactttttaagggcgatatgctggctttcgggacagcgcctaatcgggagattatgaaagtggttaagtttagcgaaggaagaatcgtgttcgccggccaccgcgaggctgggaacctcaaagaacgggacgccgataaggacgatccctttaaatacagaacctgctctcctgaggccctgcgcaaggctcaggcccggcccgtcggagtggaccccgcgggcttcgttcacgatagagggcctctcgagtga

SEQ ID NO: 3819 - RNA, 3180 nt, synthetic construct
  misc_feature 1..3180: note = Cas9 variant
  source 1..3180: mol_type = other RNA
atgggcatcagattcgcctttgacctggggaccaacagcattggatgggctgtgtggcggacaggccccggggtcttcggagaggatacggccgcgtccctcgacggctctggggttctgatctttaaggatggacgcaatcctaaagacggccagagccttgctaccatgagacgggtgccgcgccaatccagaaagcggcgcgatagattcgtgctgcggcgcagagacctcctggccgcccttcggaaagctggcctgtttcccgtcgatgtggaagaggggcgcagactcgccgctacagacccttaccacctccgggccaaggcgctggatgaatctctcacaccccatgagatgggacgcgttattttccacctgaaccagagacggggctttagaagcaatcgcaaagccgaccggcaggatagagaaaaggggaagatcgctgagggatccaaacgccttgccgagacactggctgccaccaactgccggacactcggcgagttcctgtggtctagacatcgcgggacccctcggacgagaagccccacccgcattcggatggagggagaaggcgcgaaggccctttatgctttttaccctacaagagagatggtgcgcgccgagttcgaacggctgtggaccgctcagtccagatttgccccggacctcctgacacccgagcggcacgaagagatcgccggcatcctgttccgccaaagagatctcgctcctcccaaaattgggtgttgcacctttgaacctagcgagcggagactgccccgcgcgcttccgtctgtcgaggcccggggaatctatgaaagactggctcatctccgcattacgacaggccctgtgtccgacagagggctgacccggcccgagcgcgacgttcttgccagcgccctgctcgctggaaagtctctgacattcaaagccgtgagaaagaccctgaagatcctccctcacgcgctggtcaatttcgaagaggctggcgaaaaagggcttgatggagccctgaccgccaagctcctgtccaaacccgaccactacggcgctgcctggcatggccttagctttgctgagaaggatacattcgtggggaaactgctcgacgaggccgatgaagaacggctgattcgcagactggtgacggaaaaccggctctctgaggacgcggcccgcagatgtgcttccatccccctggccgatggatatggccggcttgggcgcaccgctaatacagaaattctggccgcgctcgtcgaggagaccgacgaaacaggaaccgttgtgacgtacgccgaggctgtgagacgggccggcgaaagaacagggcgcaactggcaccatagcgatgagcgggacggcgtcatcctggatagactgccttattacggagagatccttcagcgccacgtggttccgggctccggggaacccgaggaaaagaatgaggctgcccggtggggaagactcgccaaccctaccgtgcacattggcctgaatcagctgcgcaaagtcgtgaaccggctcatcgctgcgcatgggagacccgaccagattgttgtggaactggcccgcgagcttaagctgaatcgggagcaaaaggaaagactcgaccgggagaaccgcaaaaatagagaagagaacgaacggcgcaccgctatcctggccgagcacggacagagagatacagccgagaacaagattcggctgagactttttgaggaacaggctcgcgccaatgcgggcatcgctctctgcccttacaccgggcgggccatcggcattgccgaactgttcacatctgaggtcgaaatcgaccatattctgcccgtgagcctcacgctggatgactcccttgctaacagagtcctgtgtcgccgggaggccaatagagagaaacgccggcagaccccgtttcaagcgttcggagctacccctgcctggaacgatatcgtggccagagctgccaagctgccccctaataaacgctggagatttgaccccgctgccctggaacggttcgagcgcgaaggcgggtttctgggaagacagcttaacgagaccaagtatctcagccggctggcgaagatttacctgggcaaaatctgcgatcctgaccgcgtttatgtgacacccgggaccctcacgggactgcttagagcccggtggggccttaattctatcctctccgatagcaacttcaagaatagatctgaccaccgccatcacgctgtcgatgccgtggttattggggtgctgacccggggcatgatccagagaattgctcacgacgccgcccgcgctgaggatcaagacctggaccgggtctttagagatgtgccggtgcctttcgaagactttcgggatcatgttcgcgagagagtcagcacaatcaccgtggcggtgaaacccgaacacggaaagggcggggcccttcatgaggacacatcctacggactcgtccccgataccgaccctaacgctgccctgggcaatctggtggttcggaaaccgattcgctctctcacggccggggaagtggatagagtccgggaccgcgctctgagagcccggcttggagcgctggctgcccccttccgcgatgagagcggcagagtgcgggacgccaaggggctcgctcaggccctggaggcgttcggcgctgaaaacggaatcagacgcgttcggattctgaagcctgatgcctccgtggtcacaatcgccgacagacgcaccggcgtgccctatcgggctgttgcccctggggagaatcaccacgtggatatcgtccagatgagagacggaagctggcgcggctttgctgcctctgtgttcgaagtgaaccggcccgggtggagacctgagtgggaagtcaaaaagctgggaggcaaactggttatgcgcctccataagggcgacatggtggagctgtccgataaagacgggcagcggagagtgaaggtcgtgcaacagattgagatcagcgcgaatcgcgttcggctctctccccacaacgatggaggcaagctgcaggacagacatgccgatgctgacgatccgtttcgctgggaccttgccacaattcctctgctcaaagatagagggtgtgtggctgtccgggtggaccccatcggagttgtgaccctgcgcagatccaacgtctga

SEQ ID NO: 3820 - RNA, 3183 nt, synthetic construct
  misc_feature 1..3183: note = Cas9 variant
  source 1..3183: mol_type = other RNA
atggccgtcaagagcctgaactacatcctcggcctggaccttgggattgcttcctgcggatgggccgtggttgagatggatgaacaggagaatcccctgagactcatcgacgtgggcgtgcggaccttcgaagaggcggaaaaccctaaagatgggtctagcctggctgagacacgcagacttgcccgggcccaacgcagactgatttcccggcgcgctaatagaatgaacaagctccggcgcctgctgaaacaggagaatgtcctccaggccaacgactatgatgaaaagggactgatcattggccttccgaatcaggcttgggagctgagagcccaagggctcgaccggaaactggaacccaaggagtgggcggccgtgcttatccacctggttaagcatcgcggatacctctctcagcggaaaaacgagagccagacggctgataaggaactgggcgccctgctctccggcatgaatcacaaccatcagctgcttcaatctcagagcaatcagtatagaacccctgctgagctggccatcaaacagtttgcgacacaagacgggcacattcgcaaccagagaggagcctacacccatacattcaatcggctcgatctgcagaacgaacttaatcaactgtttgacgctcagaccagactcggcaacccccacgtgtccgggagcctgaagacagccatcaacgatctgctcatgaatcagaaagctgccctgtctggagacgccattcttgagatgctgggccgctgtaccttcgaaccttccgagtataaggctgcgaagaacacgtacagcgccgagcggtttgtctggctcgggaaactgaccaatcttagaatccaggataacggactggaatctgctctctcccgcgagcaacgggaactgctgctcaatgagccctataacaagacaaaactgacctaccaacaggtgagaaaacttctgcgcctccctgaaacagccttctttaagggcctgcggtacggcaaggacaatgccgagagcgctaccctgatggagatgaaatcttatcacgccattagaaagtcccttgaaaacaagagcctcaaatccgagtgggaaaagctgaaaacgcagccgaagctgctcgacctgatcgggacagcgttctctatttacaaaaccgatgacgagatcgctggatgccttaagaatcagctgcccgaaaacgttatcattgccctccaggagcagctgaattttagcaacttcatggagctgtcccttaaggccctcgaaaaactgctgcctctcatggagcagggcctgcgctatgatgaggcttgtacacaaatctacgggaatcggcatgaaaagattgccgacaaaaccgagaagtttcttcccaacatccctgctgataaactgagaaatcccgtggtcctccgcaccctgacacaggcccggaaggtgattaacgcgatcatcagacggtatggaagcccggcccgcgtgcacattgaaacgggcagagaggtcgggaagtctttctccgaccgggataaactgaagaaacagcaggaagagaaccaagaacagagacgccgggctatcgacgagtggaagcagtttttccctaatgccgctcatgagcccaaagccgttgatattcttaagctcagactgtaccaactgcagcagggaaagtgcctctatagcggcctgcctatcgacgtgcgcagacttcccgaaaaaggctacgtggagattgatcacgcgctgcccttctctcggacctgggacgacagctttaacaataagatcctcgtcctggcctccgaaaaccagaataaagggaaccaaacaccttacgagtatctgcgcggagctgataattctgaaagctggagacttttcgtggagaacgttcagaattgtcagttttccccgaacaagaaacagaagatcatggccaaacaactcgacgagaagggcttcctggaacggaatctgaacgatacccgctacgtgagcagatttctctgccagttcatttctgagtatctgcaccttacagggaaggggaaaaagcgggtctttgcttccaatggccagatcaccgccctgctccgcgggagatggggcctgagcaaaaaccgggaagagaatgaccgccatcacgccgtggatgctgttgtggtcgcgtgttctacggtggccatgcagcaaaagattacacagttcgtcagataccagaaaggaaacgtgtttaccggcgaacggatcgacaaggagaccggggaggttatttccatccatttccccacaccttgggaacactttagagaggaagtgatgattcgcgtcttcgatgacaaccccctgcggacccttcctgagaagctgcccaatagaccggaggctctccatgaatatgtgatgcctctgtttgttagccgcatgcccacacggaaaatgacgggacaaggccacaaggagaccatcaaatccgccaagagactcgatgagaaaatctctgtgctgcgcgtccctcttacacagctgaagctcaacgacctggaaaatatggtgaaccgggaaagagagcccgccctgtacgaggctcttaaggcccgcctggaacagttcaaaaatgatcctgcgaaggctttcgccgagccctttttcaaacagggaggacaacaggtgaaggccgttcgggtcgaaattgtgcagaaaagcggcatgctcctgagaaagatcaacggggtggctgacaatggctccatggtccgggtggatgtttttgagaagtctggaaaattctatctcgtgccgatttacgcctggcaggtcgcggaaggcatcctgcctaaccacgctgtggttcatagcaaggacgagtccgactggattcttatggatgagagctaccactttaaattcgccctgtataagaatgacctcctggaagtgcaaaccaaaaaggggtgcatcatgggatactttgcctctctggatcgcgctacaggcgccatcaccattagagagcatgaccgggataaaaagaagtgtaaagacggggaacaccgctccatcggagtcaagatggctagctctttcaagaaacttcaggtggatgagctgggcaaaaacattcacgaaacgagatcccggaagagacccaatatcgggtga

SEQ ID NO: 3821 - RNA, 3186 nt, synthetic construct
  misc_feature 1..3186: note = Cas9 variant
  source 1..3186: mol_type = other RNA
atgcacaccctgccctacacactcggcctggacatcgggattgccagcgtgggagctgcccttctgtccgatgagtctatcctcggcatgcatgtcagaacgttcagcgcggctgaaaccgacaaggagggggatcctctgaacaaaattcggcgcgaagccagatccgcccggcgcagaatccggcgcagagctcaccggcttctgcgcctcagacggctgctgaagcgcacaggactcatttctgacaccagcctggaggttcttaaaacatccaagaccccgtggcagctgagatctgaaggcctcgatcggctgcttagcccctccgagctggccgctgccctctatcatatcgtgaaacaccgcgggtttcaaagcaatagaaaggcggagctgaagacagacgccaaagctggacagatgctgtctggcgtgtccgccaaccagcagctcatgcgggataagagctacagaaccatcgctgaaatggtctgcaaagacgatgccttcaaggaccataaacgcaataagggcgggtcttatcggaacacgtttgcgagatccgatctggccgacgagcttaagaccctgctcaaaaagcaacgcgaatacgataatcctctggctacacccgagcttgaggaagccgtgcacaccctgctcatggctcggagacctgttttcaaagacgacgatattgagaagctggtgggattttgtacattcgaacacggcgagaaacgcgcccccaaggccgcttttagctctgaacggttcatctggctggggaaactcaacaatctgagacttatttatcctggagagcagcgctccctgaccccggaggaacggagccagatcattaacctcccctttacgcaggcgtccgtcaagttctctcaaatcagaaagaaactggaccttcctgagtacgtgcgctttaatctggttcggtataagcccggcgaagagacaagcaaatccgaaaccgccacattctttgaggctaaggccttccatgagctcagaaaaacctaccgggaaagcgggatttctgagctgtgggaacgcgatcagcacgaccctcagagactggatcagatcgccaccgctatcgccgtgtaccgggacgatgagagaattagaaacgaactcagcccccatacaatcgagaatgaggtcgtggaagcggtgctgaactgcgacttcacgcaatttattaatcttagcctgaaggctctcaacaagatcctgccgtatatggagcagggacagcggtacgatgaagcctgtacctctgccggctatcaacaccacagccctcagcagaatgaggagaaatccggccgcattccccctcccgacaagaacgtcatccgcaaccccgttgtgtacagatctctgaatcaggctcggaaacttatcaacgccattacaaagcgctatggggctcctgccgcgatccatctcgaaatggccagagatctgagcaaaccgttctccgagcggaagtccattgaacgcgagcaagaaaagtacagaaaacagaaggtgcagctgcggaatgagtatatcgagcactttggaaccgaacccaacggcctcaatctgcttaaattccgcctgtacaaggagcaggacgctcaatgcgcctacacacagaaagctctcgacctgtctagactgaacgaagccgggtatgtcgaggtggatcatattcttccttactcccggagctatgacgattctctcctgaataagaccctggttctcacggaagcgaaccgcgacaagggaaatagaacaccctttgagttcatgggcggggatgaccagtcccagcactggcaaaaatttgtgcggtgggtccagatgaaccctaagatcagacaggccaaacgcaatcggtacctgagaaaggatttcagcgagaaagctgcccgcgaatttcgggacagacatcttaacgatacccgctatatcggacgggagctgaaggctatgattgaatcccacgtgcagtggcaccccgactctaaaagcaaggattgttgcgttgtgctctccggccaactgaccgccctgcttagaggccgctgggggttcaataaggaccgggccgctggagatctccatcacgcggtcgacgccgctgtggtcgccgccgctacaagaggcatgatccagcggatggcccgccattctaaatttcacgagctgaagaacgtgagaaccagctacgcggacccggatacaggggaagttgtgaatctggctgccgcccgggacctcgagaaacacttccctctgccctgggataactttcgcaacgacacgcttgcttatctgaatccttccgccattagcgcggatgagtctgctcaggaaggacatagaggcgtccgggtgtccagagcccccacccgccggaagctcggggccgctcaccaagagacaatcagaagcaaaggcaaggacaacattctgctggaacagggactttctgccgttaagacccctctctccaaactgacactgaagaatatcgagaacatggtgggctacgaggatccccgcaatgctgccctcgtcaaagtgctgcgggaaagacttgaggcgttcgggggagacggcgccaaggctttcgccccgaaccagcctcccgtgtacaaacccagcaagcctgggaagcaggctccggaaattcgctctgttaaaatggccagcaagtccaaaggagccctgcatgtccgggagggcctcgctgatagcgggagaatgatccgcatcgacatttatgaaaccaagaatggctacgtgggagtgcccatctatgtctctgataaagcgagatccaagctgcctaaggcctaccccaaaaagggcgaggaccgggctaactggcctgaggtggatacgaatgacaactttctgttcagcctttattccaccgactggattgaagccaaaacaaagaaagagaccatcgccgggtacgttaagtcttatgatatttttgacggacgcctgctcgtgtacgctcacgataataaaaaggtcgtgagaaagctgacactcagcgccctggcggaccttcaaaaactgcatgtttccatcctcggcgatctgtacaaagggggaacccccaagtgttctcctctgcggaagggccaggaactttga

SEQ ID NO: 3822 - RNA, 3186 nt, synthetic construct
  misc_feature 1..3186: note = Cas9 variant
  source 1..3186: mol_type = other RNA
atgctgagactcggcctggacatcgggagcacctccattggatggttcctttaccggatcacaaacggcatgattgccgagatcattgattgcggggtgcgcctgttttctgacggaagagatgctaagacgggcgtcagctccgccgttgaacggcgcaatgcgagagctctccggcgcagacgggaccgctatctgagacggcgcgccgcccttatgagacggctggctgccgctgggctcatgcccgaggatccttctcaggccaaaccgctggaactgctcgacccctaccgcctgagagcggatgcccttgaccggagactggagctcaccgaactgggacgcgctcttttccacctgaaccaacggagaggctttaagagcaatcgccagacagatcggggcaacaatgaagggggaaaaatcatcgacggctccgccagactcgatcaggctatgatggccgtgggggcgcgcacctatggagagttcctgcatctgcggagatctcaggccgaagacctccgccgggtgcctagcgtcagaacacgcctgacccttcggtccgtggatggcgggaaggctgagacaggatacgacttttatcccgacagacggcacctggaagaggagttcaacaaagtttgggccgctcaagccgcccatcaccctgtgctcaccgatagcctgcgccatgaagtctttgagacgattttctttcagagaccccttaaggctcctgcggtgggccggtgtctgttctttccggaacccagactccctcgcgcccaccccctgacccagcggagagttctgtacgagacagtgaatgctctccgcatcagaaccgaatctggcgccgccgtccctctggggaaggagcagcgggacaaagtgattatgcttctggatggaaaggctcccgtgaaagccatcgcgtccgctaagctcagcctgaaagccattgccaagcaccttaagctgcgcgacggccaaacattcaccctcgagaaagggagagattatatcgcttgcgacccggtccgggcctctctgtcccatcctgatcgctttggacccagatggagcgttctggaagctgaggtgcaggccgaaattgtgggccggatccgcgacgatgacgatacgatggcgctcgtcgagtggctgaaacaggtgcacgggcttgacgacgcccatgctagagccacagctgatgcccctctgcccgaaggatacggccggctcggcgagaccgcgacacgcaagctgctggactgtcttaaggccgaggttctcacctactctgaagctgtggggaaagccctggatcagcaccactccgacagacggaccggagagatcctggaaagcctcccctattacggcgaggtcctgcaagctcatgtgattcctgggacaggagaaccgcaccatgatgacatcacgagattcggccgcattaccaaccccacagttcacatcgggcttaatcagctgcggagactcgtgaaccgcattatcgcccggtatggcaagcctgccgagatcgtcgtggagctggctagagatctgaaacagtccaccggacaaaagaaggcggccattgctcttaatctcaaaaaccgcaaggccgccgaagctcggtctgccctgctgacagagtggggcgtccccgacaccggggcgaatagaatgtacgtgcgcctctggcaggaactgcatgaggatcctatgatgcggagatgcccctatacgggaacaatcattagcccgtcccttctgttcagcggcgctatcgacattgatcacatcctcccttactctcggaccctggacgattccaccgccaaccgcacactgtgtatgaaagaggccaatagacagaagcggaacaaaagcccctctgaagctcgcagagacgggatgcggatctgggcccttgaggacgataacctcagacacattcctgaatttaagcgctggcggttcgcggaggacgctatggccagatttgaaggagagcgcgatttcgaggcccgggctctggttgacacccagtatctgagcagaatctccaaggcctacctcgaaacactgtacgatggcgctgacgggaaatctcatgtgtgggtcgtgcccggccgccttacggagatgctgcggagacactggggactcaatggcattctgaccgatcctctgcgcgacgttacaaaggagaaaaacagaatggatcatcggcaccacgccatcgacgcggccgtggtcgctgccaccgatcgcgggcttattaaggctatggccgagcaagccagaacagacgtggatcagggacgggaagctctcgcgagctccatcatgcccccgtggcctggctttcgcgaggccgtggctgcccaggttgacagaattatcgtcagccatcggcccgaccacgggagaatcgatctgaccacgcgcatgaaaggacgggaccagaccacaggccccctgcatagagataccgcctatgggctcacaggccaatctgagaagggagtgcctctggtggtcacccgcgaaccgttcgacaatcttacgcccacaatgattggcaagatccgggatgagcctctgaaagctgccctcgcggctgtgaccgccgggaagaaagacgatgcctttgctgaagccctggcgcacttcagagaccggcccggaccttaccatggcattcgcagagttcggctgatcgagcccatttccgtggtcgaaatccgcgatgctagcgggagagcctataagggatacaaaggcaactctaatcactgctttgaggtgtggcggcttcctgggggcgccatcacagagcacattgtttccaccttcgacgctcatcagcccggaccggaacctcgcccccaccctgccgctaagagactgctccggctgtttaagagcgatatggtgaaactcgacgactccaagttcggccccgtcatcgccaccgtggttatgtttgatcgcaacgggaaaatttctctggtgccgcatacagcgagcaatgccagaaagcggtgtgagaaatataaggaagacctttacctgagattcacggctcgcaccctcatcgaggccggagctcggagaattatcgtcgatgagacaggccacttccgcgaccctgggcggaaaggatga

SEQ ID NO: 3823 - RNA, 3189 nt, synthetic construct
  misc_feature 1..3189: note = Cas9 variant
  source 1..3189: mol_type = other RNA
atggccgagaagcagcacagatggggcctggacatcgggaccaacagcattggatgggctgtgatcgccctcattgaaggccggcccgcggggctggtcgctacaggatcccgcatcttctctgatggcagaaatcctaaagacgggagctcccttgccgttgagcggcgcggaccgagacaaatgcggcgcagacgggatcgctacctgagacggcgcgacagatttatgcaggccctcattaacgtgggcctgatgcccggcgatgctgccgctcggaaggcccttgtgacggaaaatccttatgtcctgcgccagagagggctcgaccaggcgctgaccctgcccgagttcggacgggccctctttcatctgaaccaaagacgcggcttccagtctaatcggaaaacagatagagctaccgccaaggaaagcgggaaagtgaagaacgctatcgccgcgtttcgcgccggaatgggcaatgctcggacagttggggaggcccttgctagacgcctggaggacggacggcctgtgagagcccgcatggtcggccagggcaaggatgaacactacgagctctatatcgcccgggaatggattgctcaggagttcgacgcgctgtgggcctcccaacagagatttcatgctgaggtgcttgccgatgccgctcgcgaccggctgagagccatcctcctgttccagcggaaactgctccccgttcctgtggggaagtgctttctggaaccgaaccagccccgcgtcgcggctgcccttccttctgcccaaagattccggctgatgcaggagctcaatcacctgagagtgatgacccttgctgataaacgcgaacggcccctgagctttcaggagagaaacgacctcctggcccaactggtggctcgccctaagtgtggattcgacatgctcagaaaaattgtctttggcgccaataaggaagcgtaccggttcacaatcgagtccgagcgcagaaaggaactgaaagggtgcgataccgccgctaaacttgccaaagttaacgctctgggaacgcggtggcaggccctcagcctggacgagcaggatcgccttgtgtgtctgctcctggacggcgaaaatgatgcggtgctggccgacgctctcagagagcattatgggctgaccgatgcccagattgacacacttctgggactctctttcgaagatggccacatgcggctgggccgctccgctctgcttagagtcctcgacgccctggagagcgggcgggatgagcaaggactgcccctctcttacgacaaggccgtggttgctgcgggctatccggcccacaccgctgacctggaaaacggggagcgcgatgcccttccttactacggagaactgctctggagatatacacaggacgcccccaccgctaaaaatgatgccgagcggaagtttggcaaaatcgcgaaccctacggtgcatattgggctgaaccagctgagaaaacttgtcaatgctctcatccagcgctacggcaagcccgcccaaatcgtggttgaactggcccggaacctgaaggctggactcgaggagaaggaaagaattaaaaagcagcagacagccaatctggagcgcaacgaacggatcagacagaaacttcaagacgcgggcgtgcccgataatcgcgagaaccggctgagaatgcgcctcttcgaggaactggggcagggaaatggcctggggaccccttgcatttattccggacggcagatcagccttcagagactcttttctaacgacgtccaagtggatcacattctgccgttctccaagacactggacgatagctttgctaataaggtcctcgcccagcatgacgccaaccggtacaaaggcaatcgcgggcccttcgaggcttttggcgccaacagagatggatatgcttgggacgatatccgggcccgcgcggccgtgctgcctagaaataagcggaacagattcgctgaaaccgccatgcaggactggcttcacaatgagaccgactttctggctcgccaactcacagatacggcctacctgtcccgggttgccagacagtatctgaccgctatctgttctaaagacgatgtgtacgtcagccccggccgccttacagcgatgctccgggccaagtgggggctgaacagagtgctggacggagttatggaggagcagggccgccctgctgtgaaaaaccgggatgaccacagacatcacgccattgatgccgtcgtgatcggggctaccgaccgcgccatgctccagcaagtggcgacactggctgccagagcccgggagcaggatgctgaacgccttattggagacatgcccaccccgtggcctaatttcctggaggatgttagagccgcggtcgctcggtgcgtggtgtcccataagcccgaccacggccctgaagggggcctccataacgatacggcctacggaatcgtcgccggcccctttgaggacgggcgctatagagtgcggcacagagttagcctgttcgacctgaagcctggagatctttctaatgtgcgctgtgacgctcccctgcaggccgaactcgagccgatttttgagcaggatgacgctcgggccagagaagtcgcgctgacagccctcgctgagcgctaccggcaaagaaaagtgtggctggaggaacttatgtccgttctgcctatccggccccgcggcgaagatgggaagaccctccccgacagcgccccttataaggcttacaagggagattctaactattgctacgagctgttcatcaatgagagaggccggtgggacggggaactgattagcaccttccgcgccaaccaggccgcttatagacggtttcgcaatgatccggcgagattccggcgctacacagccggcggaagaccccttctgatgcggctctgtatcaacgactacattgctgtgggcaccgccgccgagagaacaatctttcgcgtcgtgaaaatgtccgaaaataagattacgctggctgagcacttcgaagggggaaccctcaagcagcgggatgccgacaaagacgatccttttaagtatctgacaaaatctcccggcgcgcttagagacctgggggctcgccggatcttcgttgatctcattggaagagtgctggaccctggcatcaagggcgattga

SEQ ID NO: 3824 - RNA, 3189 nt, synthetic construct
  misc_feature 1..3189: note = Cas9 variant
  source 1..3189: mol_type = other RNA
atgaacctgaattacatcctcggcctggaccttgggattgccagcgtgggatgggctgtcgttgagatcgatgaacaggagaacccccaaagactgattgacgtgggcgtgcggaccttcgatcgcgccgaagtcctcaagacaggggagtccctggcgcttgctagacggctggcccgctctagcagacggctcgtgaaacgcagagccgaacggatcaagaaagctaagcgcctgctgaaagccgagaatctcctgctttccgctgacgagattctgcctaacgaagcctggcagctcagagttaagggactggatcagaagctggagcggcaggaatgggcggccgtgctgctccaccttctgaaacatcgcggctatctctctcaaagaaagaatgagagcaaatccgagaacaaggaactgggggcccttctgtctggagtcgctatcaatcaccagatcctccagagcgctgagtaccggacgccggccgaaattgcggtgaacaaatttcaggccgaggaaggccatatccgcaatcaaagaggcgcttatacccacacattctcccggctggaccttctggccgagatggagctcctgtttcagagacaggctaccctggggaacccccatacaagcaccaagctcctggaaaatcttacagccctgctcatgtggcagaagcctgccctggctggagaggcgattcttaaaatgctgggcaagtgcaccttcgaacccacggagtacaaagccgctaagaactcttattccgccgaacgctttgtttggctcaccaaactgaataacctgcggatcctcgagcaaggggccgagagagctctgacagataatgaacgcttcgcccttctggaccagccttacgagaaggcgaaactcacctatgctcaggtgcggacactgctgggacttagcgatgaagccatttttaagggcctcagataccaaggggaggacaagaaagccgtcgaaaccaagacgacactgatggaggtgaaggcttaccaccagatccgcaaggccctggagggactcgatctgaaagctgaatggaacgagcttaagaacaatcccgccctgctcgacgaaattggcaccgcgttctctctgtataagacagatgacgacatccaccggtacctggatggcaaactttccgagagcgtgctcaacgccctgctggagaatctcaactttgacaagttcatccagctgtctcttaaagctctgcagcaaattctccctctgatgctgcaggggcagagatatgatgaagccgtctccgctatctacggagaccattatggcaagaaaagcgatgagattgaccgccttctcccgaatatccccaccgatgaaattcggaaccctgttgtgctgagaaccctgacacaggcccgcaaggtgatcaatgcggtcgtgcggctctacgggtcccccgccagaatccacattgagacgggacgggaagttggcaagtcttatcaagaccgcaaaaagctggagaaacagcaggaggaaaacagaaagcagcgggagaatgctgtgaaaaagtttaaggaatacttccctaactttgtcggggagcccaaaggaaaggatatccttaaaatgagactgtacgaactccaacaggccaagtgtctgtatagcggcaaatccctggagctttaccgcctcctggagaagggctatgtggaagttgaccatgctctgccgttcagccggacctgggatgactctttcaataacaaagtgctcgtcctggccaatgagaaccagaataaggggaacgccacaccttacgaatggcttgacggaaagaacaattccgagggctggcagcactttgtggctagagtccaaaccagcgggttctcttatgcgaaaaagcagcgcgtgctgattcaggaactcgatgagaaatcctttatcgagagaaacctgaatgacacacggtacgttgcccgcttcctgtgcaaccacattgctgataatatgcttctgaccggaaagggcaaaagaaaggtgtttgccagcaacgggcaaatcacggccctcctgcggggctgttggggactccagaaggtccgcgaaaataacgacagacatcacgctctggatgccgtggttgtggcgtgctctacaaaaagcatgcaggacaagatcaccaaattcgtcaagtataaagagggccggctttttaaggataagaaagacggggtgtacaagggagaacgcattaatagagagaccggcgagatcatttccctgcatttccccacaccttggaaatttttcaaggaaaacgtggagatccggatttttagcgaaaatcccaaactcgagctggaaaaccgcctgcccgattaccctcagtataatcacgagttcgttcaaccgctttttgtctctagaatgcccacccggaagatgacagggcagggacatatggagacggtgaagtccgctaaaagactggacaagggcctcagcgtgctgaaagtccctctcacccagctgaaactttctgatctggaacgcatggtgaaccgggagagagaaatggccctctacgaggccctgaaagaatgtctggagcagttcgggaatgaccccgctaaggccttcgcggagcctttttataaaaagggcggagctcttgttaaggccgtgcgcgtcgaacaaacacagaaatccggcgtgctggttcggaacgggaacggagtggccgataatgctaccggcagcatcgtcagagtggacgttttcacaaaagggggaaagtactttctcgtgcccatttatacctggcaggtcgccaagggcatcctgccgaacaaagctgtgatccaggggaaggacgagtccgaatgggaggaaatggatgagaatgccgtgttccaattttctatgcacaagaacgacctcattaaagtcaagacgaaaaagggcgagatcttcggatactttaatggcctggatcgcgcgaccgggagcattgaaatcgaggaacacgaccttgagaaatccaagggaaagaacggctctcatcgggggctgggagttaaaacagccttctttctggagaagtatcaggtggatgaactcggcaaaaatattagaccttgccgccccaccaagcggcagcacgtgagatga

SEQ ID NO: 3825 - RNA, 3192 nt, synthetic construct
  misc_feature 1..3192: note = Cas9 variant
  source 1..3192: mol_type = other RNA
atggagaaccacatcaattacagactgggcctcgacattgggatcgccagcgtgggatggtccgtcattaacctggataagaaacggatcgaagaccttggcgttcgcattttcaatgctgccgagcatcccaaggatgggtctagcctggcgctccctagacggatcgctcgcggaagacggcgcctgcttagacggaaagcctatcgcgtgaagagagtgcggaaactgatcgtcgactacaacattctcaccaaggatcagctgaatgacctgtttaagcaaaaatgccagaactccgtgtgggaaatccgcgttaaggccctcgataataaagtgacaaacgaggaatgggctagactgcttattaatctgtgtaagcggcgcggcttcaaatctaacagaaagaatgaggccgacgataaggagacgaaaaaggtcatcaacagcattaaatccaatatcaaggggatgaaagaatctggaagccggaccattggcgagtatatctacacacagaccctctccagcggcgacatctctaagtcctttagaaacaaagatgggcagtataataactgcgtgagccgcaagatgattgaagaggagatcaagattctgttcaaaaagcaacgggaacttggatgtgagtttgcttctgaagagatcgaagagaaatacctggccattttcaactcccagagaccgtttagcaagttcgaggacctcgaaaagatggttggcttttgcacattcgagaaggcgtctaaggaacgccgggcccccaaatgttccatcagcgctgaggaatttgtgctgtatgataatatgaacaagctgtccatcctcaataaaggggacaccagaaagctgacaaacgaggagcgcaaaattatcgtcgaaaatgccttcaagaacaaggagattaaatactctaaacttcggaaaatcctgaatctcagcaacgacgaaagattttccaccctgagctactctaataagacggagctttccaaaaccgaaaacagcaagttcgtggctctgaagggatatcacgagattaaatctgccatcgaaaagagcttcggcaaagatacatggaatcgcgtgaagaacaatcggaccatgctcaacgacatcgcgtacgtcctgtccattgccaaaacagatgaagacatcattaagcagctgtctctcagaaatatccctcgcgagattatcgatgctgttctggggcttagcttttccaaattcagcaacctgtctattaaggccatcgaaaagatcctcccctatctgaaagacggacagcaatacaacgaggcttgcaagtccgccggctatgattttaaagccacctacaatggcgaaaagagctataaacttcctctgattgacatcgatgaaattgtgaaccccgtggtcaatcgggctctctctcagacgagaaaggtgatcaacgcggttattgaccggtacgggtcccctatcggaatcaatattgagctggcccgcgatctggctaagaacttcaaagacagaagcaagatcaaaaaggaacaggaggaaaatcgggccaacaaagagaagattaagaatgagctcaaaatgctgatgaacaaggaaccgacatcctctgagatccttaaatacagactgtggaaggaacagcgcgaggaatgtgcctatagccaagagcggatttacatcgaggacctctttaaagtgggccagtatgaaatcgatcatattatccccttctccagatcttttgacgatagcctgaataacaaggtcctggtgaaggctgccgagaatcagcgcaaagcgaaccggattccttacgaatatttcgggtccgacgaggatagatggtaccgctttgaagtttgggtggagcaaagctctctttccttcaagaaaaagaataacctcctgaaaaagagatttagccgggaggactctatcgagttcaaagatcgcaacctggtcgacacccagtatatttccagatacatcagcaattttatcaagtctcggctcattttcaaggagagcgattccaaacagaaggtgatcacaattaacggacgcgctaccagctacctgagagccaaatggggccttctgaaggtccgggaaaatggggacaaacaccatgccctcgatgctaccgtgatcgccgttgctacacagggaatggtgcaagagatttctaagtattccaaggcccacgagctgaaatacatccgccagggcgacgagttcattgatatcgagacgggcgaaatcgtcaaggtgaaagaccacaagcatctgagcaaagacagacttcccgagccttggctcgggttttcctctgaactgcggctgagactcagcgagaaccccattgaggaactgaagaagtccccgatctctacctatgatgaggagttcattcgcaaaacagttcggcctatctttgtgagcagagtcccctaccgcaaggtgaccggacggcttttcgaagaaacagtgtattcccctaaagcgtttattgacgagggcttcatcgccaagaaaaagctgcaggatctcaccctgaaggactttgagaatatctacaactataattctgataaaaagctgtacgacgctcttagagaacgcctcgaggaatacgggggaaacgccaaaaaggctttcgccgaggaatttcggaaacccacgaagacaggcaagctggggcccattgttaaaagcatcaaggtcaaaaccaagattcctttcaaagatggcatcgacctgaatggaggcaaggtgaaaaaggatgggctcgtgagaattgacatctatgagaaggagggaaaatactatgtcgtgccggtttaccgcctggatatccagcaaggcaacattcccaagaaagcggccgtggctaataaggaagagaaagactggatccttatggatgaatcctataactttaagttcagcctgtacaagaatgacctcatttatatcaaatacgactctaagggggagtactttggatattacgatggcttcgaccggcacaccggggccattacactggagagacatgataactccgaacggtatcgcggcatcggaattaaaaccggcgtcaaggagatcttcaaatacaatgtggacgttctggggagatattacaaggtggctaagtga

SEQ ID NO: 3826 - RNA, 3192 nt, synthetic construct
  misc_feature 1..3192: note = Cas9 variant
  source 1..3192: mol_type = other RNA
atggagaagttccactacgtgctgggcctcgacctggggatcgccagcgtcggatgggctgccattgaaatcgataaagagaccgaaacatccattggccttctggactgcggggttagaacgtttgagcgggcggaagtgcccaagaccggagattctctcgctaaagcccgcagagaggcccggagcacacgcagactgatccggcgcagatcccatcggcttctgcgcctcaagagactgctgaaacgggagattttccgccagcctgaaacctttaaggacctcccgatcaacgcttggcagctgagagtgaagggccttgattctcggctgaatgagtatgaatgggccgctgtcctcctgcaccttgtgaaacatcgcgggtacctgagccagagaaagtccgagatgtctgagacagacagcaaatccgaaatgggacggctcctggccggcgttgcggagaaccaccagctgctccagcaagaacagtatagaacccccgccgagctggctcttaagaaattcgtgaagcattttcgcaataagggcggggattacgcccacacattcaaccggctggacctccaggctgaactgcaccttctgtttcagaaacaaagagagctcggaaatcctttcaccagccccgagctggaacgccaggtcgatgacctgctcatgacgcagcggtctgccctgcagggcgatgcgatccttaagatgctggggcattgtggatttgagcctgaacaattcaaagccgctaagaacaccttttccgccgagagattcatttggctcacaaaactgaataaccttcgcatccaggaccagggcaaggaacgggctctgaccgccgatgagagaacaaaactcctggacgagccctataagaagtccaaactgacctacgcccaagtgcgcaagctcctgtctcttcctcagacggctatttttaaagggctgcggtatgacctcgaacacgataagaaagcggagaatagcacactgatggaaatgaagtcttaccataacatcagacagaccctggagaagtctggacttaaaacagaatggcagtccattgccacccaaccggagatcctcgacgctattggcaccgccttcagcatctacaagacagatgaggacatctcccacgaactgaaaacgtgccgcctgcccgagaatgttctcaacgaactgcttaagaatattaacttcgatggctttatccagctgtctctcaccgccctgcggaaaattctgcctcttatggagcaggggtatagatacgacgaggcttgtacacagatctatggaaatcaccatagcggctccctccaacaggaaagcaagcagttcctgccccacattcctatcgatgacgtgcggaaccccgtcgtgtttcgcaccctgacacaggccagaaaggtggtcaacgcgatcattcggagatacgggtctccggctcgcgttcatatcgagatggcccgggaactcggaaaatccaagagcgatagagaccgcattgagaaacaacagcagaagaataaaaaggaaagagagaacgccgtggctaagttcaaagaggattttcctgacttcgtgggcgaaccccgggggaaggacatcctgaaaatgcgcctttatgagcagcaacacggaaagtgcctgtactctggccatgatattgacatcaatagactcaacgaaaaaggctatgtcgagatcgatcacgccctgccttttagccggacctgggacgattcccagaataacaaggtgctggttcttgggtctgaaaatcagaacaaacgcaatcaaacgcccgacgagtacctcgatggagctaacaatagccagagatggctggagttccaggcccgggtgcagacatgtcacttttcctacggcaagaagcaacgcattcagctggcgaaactcgacgatgaaaccgagaaggggttcctggaaagaaaccttaatgacacccggtatatcgcccgctttatgtgccagttcgtccaggagaacctgtacctcacaggaaaaggcaagagactggtgtttgctagcaatgggggcatgaccgccacactgcggaacctttggggactcagaaaagttcgcgaagataacgaccggcatcacgctctggatgccattgtggtcgcgtgttctacggcctccatgcaacagaagatcaccaaggctttccagagacatgagagcattgagtatgtggacacagaaaccggcgaggtcaaattccgcatcccccagccttgggactttttccggcaagaagtgatgattagagtttttagcgatcagccgtgcgaggacctggtggagaagctctccgcccgccccgaagctctgcacgataatgtcacacctcttttcgtgagccgggcccccaacagaaaaatgtccgggcagggacacctggagaccatcaagtctgccaaacgcctcagcgaagaaaattccatggttaagaagcctctgacgaccctgaaacttaaggacatccccgagattgtgggctacccgtctcgggagcctcaactgtatgctgcgctcaaaacaagactggagacccatgatgacgatcccatcaaggcctttgctaaacctttctacaagcccaacaagaatggggaactcggagccctggtccggagcgtgcgcgtgaaaggcgttcagaacacaggggtcatggtgcacgacggcaagggaattgccgataatgctaccatggtgagagtcgacgtgtatacgaaagccggcaagaactaccttgttcctgtgtacgtctggcaagtggcgcaggggatcctgcccaatcgggctgttacatccggaaaaagcgaggccgattgggacctcattgatgaatcttttgagttcaagttttccctgagccgcggcgacctggtggaaatgatctctaacaaagggagaatcttcggatattacaatggccttgaccgggccaacgggtccattggcatcagagagcatgatctggaaaagagcaagggaaaagacggcgtccaccgcgtgggggttaagaccgctacagcctttaataaatatcatgtggatccgctcggaaaggagattcaccggtgttctagcgagcctagacccaccctgaaaatcaagtccaagaaatga

SEQ ID NO: 3827 - RNA, 3192 nt, synthetic construct
  misc_feature 1..3192: note = Cas9 variant
  source 1..3192: mol_type = other RNA
atggagaaggactacatcctgggcctcgatattgggatcggaagcgtgggctatgggctgattgactacgataccaaatccatcattgacgccggagtcagacttttccccgaagccaacgccgataataacctgggccggcgcgcgaagagaggggctcggcgcctcaaaagacggcgcatccacagactggagcgggttaagtctcttctgagcgaatataaaatcatttccggactcgcccctacaaataaccagccgtacaatatccgcgtgaagggcctgacggagcaactgaccaaggacgaactcgccgtggctctgcttcatattgccaaaagacggggcatccacaacgtcgatgtggctgccgacaaggaggagacagcgtctgatagcctgtccaccaaagaccagattaataagaacgccaaatttctcgaatctcgctatgtttgcgagctgcagaaggaaagacttgagaatgaggggcatgtgcggggagtcgaaaaccgcttcctgacaaaggatatcgtgagagaggctaaaaagattatcgacacccagatgcaatactatcccgaaatcgatgagacatttaaagaaaagtacattagcctcgttgagacccggagagagtactatgaaggccctgggaaaggatccccctacggctgggacgccgacgtgaagaaatggtatcagctgatgatggggcactgtacgtacttccctgtcgagtttcgcagcgtgaagtatgcttacaccgccgatctgtataatgcgctcaacgacctgaataaccttacaatcgcccgggatgacaatcccaagctggaataccatgagaaataccacattatcgaaaacgtgttcaagcagaaaagaaaccctaccctcaagcagattgctaaagagatcggagtcaatgatatcaacatttctggctatcgcgttacaaagtccggcaagccgcaatttaccagcttcaaactgtttcacgaccttaagaaagtggtgaaggatcatgccatcctggacgatattgacctcctgaatcagatcgctgagattctgacgatctaccaggataaagactctatcgtcgccgaactcgggcagctggagtatcttatgtccgaagccgacaagcaaagcatttctgagctgacaggatacaccggcacacactccctcagcctgaagtgcatgaacatgatcattgatgaactttggcattcctctatgaatcagatggaggtgttcacctatctgaacatgcggcccaaaaagtacgagctcaaagggtatcagagaatccctaccgacatgattgatgacgctatcctgagccccgttgtgaagcgctcctttaaacaagcgattggagtcgtgaatgccatcatcaagaagtacggcctgcctaaagatattatcattgaactcgctcgggagagcaactctgccgaaaagtccagatacctgcgcgccatccagaaaaagaatgagaaaacacgggagagaattgaagctatcatcaaggagtatgggaacgaaaatgccaaaggacttgttcagaagattaagctgcacgacgcgcaggagggcaaatgtctctacagcctgaaggatatccccctggaagaccttctccgcaacccgaataactatgatattgaccacatcattcctcggtctgtgagcttcgatgactccatgcataataaagtcctggtgagacgggagcaaaacgctaagaaaaacaatcagacgccctaccagtatctgacctctggctacgccgatatcaagtatagcgtctttaagcagcacgtgctcaacctggccgagaataaagaccgcatgacaaagaaaaagagagaataccttctggaggaacggaacatcaataaatacgacgttcaaaaggagttcattaacagaaatctcgtggatacccgctatacaacccgggaactgacgacactgcttaagacctacttcaccatcaacaatctcgacgtcaaagtgaagacaattaacgggtcctttaccgatttcctgagaaaacgctggggatttaagaaaaatagagacgagggctataagcatcacgctgaggatgccctgatcattgctaacgccgactacctcttcaaggaacataaactgcttaaggagatcaaagatgttagcgacctggcgggggatgaacgcaattctaacgtgaaggacgaggatcagtatgaagaggtctttggaggctacttcaaaatcgaggacattaagaaatataagatcaagaaattttcccaccgggtggataagaaacctaatagacagctcattaacgacacaatctacagcacgcgggtgaaggacgataaacgctacctgattaacaccctgaagaatctttatgacaagtctaacggggatctcaaagaaagaatgcagaaggaccccgagtccctgctgatgtaccaccatgatccccaaacattcgaaaaactcaagatcgttatgagccagtatgagaatgagaaaaaccctctggccaagtactttgaagagaccggccagtatcttacaaagtacgctaaacacgacaatggaccggccattcataagatcaaatattacggcaacaagctggtcgaacacctcgatatcaccaaaaattaccacaacccccagaataaggtggtgcaactgtcccagaagtctttccggtttgacgtctatcagacggataaagggtacaagttcattagcatcgcttatctgacccttaaaaacgagaagaattactatgccatttcccaagaaaaatacgaccagctcaagtctgagaagaaaatcagcaacaatgcggtgtttattggatccttctatacaagcgatatcatcgagattaacaatgaaaagttccgcgttatcggcgtgaactctgacaaaaacaatctgattgaggtcgacagaatcgatattcggcagaaggaatttatcgagctggaagaggagaaacaggtgaactacatgaactccgacagctacctcaagaataatcgcatcaaagttaccattgggagaaagacaaccaacatcgaaaagttccatacggatattctgggaaatatgtataaatctaagcggcctaaagctccccaacttgtgtttaagaaaggctga

SEQ ID NO: 3828 - RNA, 3195 nt, synthetic construct
  misc_feature 1..3195: note = Cas9 variant
  source 1..3195: mol_type = other RNA
atgagcgagtgcgtgaccagacggatcctgggcattgacctcgggatcgcctcctgtggatggggcgtcattgaagttggggaggcttctggaagcatcattgcctccggcgtgcgctgcttcgatgcgcccctgatcgacaagacaggggaacctaaatctgctacgagacggaccgcccgcggacagagacggatcattcgcagacggcgccaaagaatgaacgccgtgcggcgccttctggctgagtttggcgtcctcacaggcagaagcccggatgccctgcaccaggcccttctgcggctctcccagtctgtggctgggagccaggttaccccctggacactgcgcgcggccgctcatgaaagaaagctgaccaatgacgagctcgccgtggtcctgggacacatcgctcggcatagaggcttccgctccaacagcaaaaatgatgggggagccaacgcggccgacgagacatctaagatgaaaaaggctatggaaaccacgcgggagggccttgccagataccactcctttggggctatgattgccagcgatcctaagttcgccgaccgcaaacggaatagagataaggactattctcataccgctaaacgctccgatctggaagacgaggtgcggacaatctttagaagccaaacccgcttcggatctctcgttgcgtccgagaagctgagccaggcctttgctgatgccgccttctttcagcggccccttcaggactccgaagacatggtgggctcttgtcctttcgagcccggccagaaaagaacagctcgccgggcccctagctttgaactgttcagatttctctcccggctggcgaacctgaagctcaccgtcgggcgcgctccggagagacggctgacgcccgatgaaattgcccttgccgctaagggattcggcgagaccaaaaagagcatcacattcaaatctctgagagaggccctcgacctggatcctaatgctcgcttttccggggtggccaaggaaaaagagagcacacttgacgtggcggcccggaccggaggcgctgcctacgggaccaagacactgaaagatgctctcggagacgccccctggagatctctgagccgcatgcctgaaaagctggatagaattgcggagatcctctccttccgggaagacatgaaggccatccgcaacggcctggaggaggtcggccttgatgggctggttgtggacgctctcatgcaagccacggctaatggagattttaaagacttcaccagagccgcccacatttctgctctggcggcccggaacatcattcccggccttcgcgaagggctggtgtatagcgacgcttgcacaagagtcggatacgatcacgccgcccggccggctgtgcctctctcccagatcggcagccccgttacccgcaaggccctgtctgaggcgctgaaacaggtgagagctgtcgcccgggaatatgggcctattgactactttcatatcgagctcgcccgctccatcggcaagagcgctgaagagagaaagaaactgacagatggaattgaggcccggaatgtggaaaaggagaaaagacgcaaggaagcggctgagcaccttggccgggccccctctgacgatgagctgctcagatatgaactggccaaagagcaaaacttcaagtgtatctactccggggaccccattgatcctgctggaatcagcgccaatgacacccgctaccaggttgatcatattctgccgtggtcccggtttggcgacgattcttatgtgaacaaaacgctttgcacagctagaagcaatcagaacaagcgcgggcggacccccttcgaatggtttgacgccgataagaccgaggcggaatggatggagtactccgccagagtcgaggacctcaaagaagtgaagggacgcaaaaagcggaactattctatcaaagacgctgccagcgtcgaggataagttcaaggctagaaatctgacagacacccaatgggccacacggctgctcgccgatgaactgaaacgcatgtttcctcccagagagtgtgaacgggtggttacggtgcgcgctgacggcgggaacgatggcctttccatcgtcgaggagagacgggtgttcaccagacctggagcgattacaagcaagctgcgccgggcctggggcctcgaagggctgaaaaagcaggacggaaaaagagttgaggatgaccgccaccacgctgtggatgccctggtccttgccgctaccacagaatctctcctgaatcggctgaccgtggaggtgcagcagagagaacgcgagggccggcaagacgatatctttcattgctcccagccctggccggggttcagagttgacgtccagcgcacggtgtacggaagcgagaccatgcctggcattttcgtgtctagagccgaacggcgcagagcgcgggggaaggctcacgatgccacagtcaaacagatccgcgacattgacggcgagagaatcgtgtttgaacggaagcccattgagaagctcaccgataaagacctggagagaatccctgttcccgaaccttatggaaaggccgctgatcccaaaaagctgcgcgacgagcttgtggaaaacctccgggcctggatcgcggctggcaaaccgaaggataagcctcccagatcccccaaaggggacattatccgcaaggtccggattgagacaaaagataaggtggccgttgaaatcaatggaggcaccgtggacagaggggatatggcccgggtcgacgtgttccgcaaaaagaacaagaaaggagtttgggagttttacgtgattcctatctatccgcatcaaatcgtcgctagcgccctgccccctaatagagctgtgattgcctacaaggcggagtctgaatggacggccatcgatggctgtttcgagtttgcttggagcctgaaccccatgtcctaccttgaactcgtgaaaagcaatggggagctgattgaaggctatttccggtctatggaccgcacaaccggagccatcaacctgtcccctatgagcacaaattccgagaccattagatctatcggcgtcaagaccctcagctcctttcggaaattcacagttgaccgcctggggagaaagtttgagatcccccgggaagtgcgcacgtggagaggagaggcttgcacctga

SEQ ID NO: 3829 - RNA, 3195 nt, synthetic construct
  misc_feature 1..3195: note = Cas9 variant
  source 1..3195: mol_type = other RNA
atgaagagaaccagcctgcgggcctaccgcctcggcgtggacctgggggctaactcccttggatggttcgtcgtttggctggatgaccacggccagcccgaggggctcggacctggcggggtgagaatctttccggatggacggaatccccaatctaaacagagcaacgccgcgggccgcagactggctcggtccgcccgcagacggcgcgacagatatcttcagcggcgcggcaagctgatggggctcctggtgaaacatggactgatgcctgccgatgaacccgctagaaagcggctcgagtgcctggacccttacggccttcgcgccaaagctctggatgaagtcctccccctgcaccatgtggggagagcccttttccacctgaatcagcggagaggactctttgcgaaccgcgccattgagcaaggcgacaaggatgcttctgccatcaaggctgccgcggggcggctgcagacaagcatgcaggcctgtggagctagaacgctgggcgaatttctcaatcgccggcatcagctgagagccaccgttcgcgctcggtcccctgtgggcggggacgtccaagccagatatgagttttacccgacacgcgccatggtggatgctgagttcgaagcgatttgggccgctcaggctccccaccaccctaccatgacagccgaggctcatgacaccatccgggaagccattttctctcagagagcgatgaaacgccccagcatcggaaagtgctcccttgatcctgctacaagccaggacgacgttgatggcttccggtgtgcctggtctcaccccctggcccaaagatttcggatctggcaggacgtgcgcaacctcgctgtcgtggagaccgggccgacgtccagcagactgggaaaagaggatcaggacaaggtggcccgggcccttctgcaaaccgatcagctctctttcgacgaaattagaggcctgctggggctcccttccgatgcccgctttaatctggagagcgaccggagagatcatcttaaaggagacgcgacaggcgccatcctgtctgctcgcagacacttcggccccgcctggcacgatcggtccctcgaccgccagattgacatcgtcgctctgcttgaaagcgccctggatgaggcggccattatcgcttccctcgggaccacacattctctggacgaagccgctgcccagagagccctgagcgctctcctgcctgatggatattgccggcttggcctgcgcgcgattaagagagttctccccctgatggaggccgggcggacctacgctgaggccgcctccgctgccggatatgaccacgcgctgcttcccggcgggaagctcagccctacgggctacctgccgtactatggacaatggctgcagaacgatgtggtgggctctgacgatgaacgcgacacaaatgagagacggtgggggcgcctccccaaccctaccgtccatatcggaatcggccagctgagacgggtggttaatgaacttattagatggcacgggccccctgctgagatcacagtggaactgacccgcgatctcaaactgtcccccagaagactggccgagcttgagcgcgaacaggccgagaaccaacggaagaatgacaaaagaaccagcctcctgcgcaagctgggactcccggcttctacacataacctgcttaaactgcggctctgggatgaacagggcgacgtcgccagcgagtgtccttacacgggggaagcgattggcctggagagactggtgtccgatgacgttgacatcgatcaccttattcccttttctatcagctgggacgattccgctgccaataaggtggtctgcatgcgctatgccaaccgggagaaaggaaacagaacccctttcgaggctttcggccaccggcaggggcgcccctacgactgggccgatatcgctgaaagagccgcgcggctccctcgcggaaagagatggcggtttggccccggggccagagctcagttcgaggaactgggagactttcaagcccgcctgctcaatgagacaagctggctggctcgggtggccaagcagtatcttgccgctgtcacccatccgcaccggattcatgtgctgcctggccgcctcacagcgctgctgcgggccacctgggaacttaacgatctcctgcccgggtctgacgatagagctgccaaatcccgcaaggaccaccggcaccatgccatcgatgctctggttgccgcgctcacggaccaggctctgcttagacgcatggccaatgcccacgatgacacaagacggaaaattgaggtgctgctcccctggcctaccttccgcatcgacctggaaaccagactgaaggctatgcttgtcagccataaaccggatcacggcctgcaggcccggctccatgaggacacagcgtacggaaccgtggaacaccccgagacagaggatggcgctaacctggtttatcgcaagacgtttgtggacatttctgaaaaggagatcgatagaatccgggacagacgcctccgggatctggtcagagcccacgtggccggggaacgccaacagggaaaaacccttaaggctgccgtgctgtccttcgctcagcggagagacattgccggccatcctaatgggatccggcacgttcgcctcacaaaaagcattaagcccgattacctggtccctatcagagacaaagcgggacggatttacaagtcctataacgccggcgagaatgcttttgtggatatcctgcaagccgaatctgggcgctggattgctagagccaccacagtgttccaggccaaccaggctaatgagagccatgacgcgcccgccgctcagcctatcatgcgggtctttaagggcgacatgcttcgcatcgatcacgccggagccgagaaattcgtgaagattgttagactgtccccctctaacaatctcctgtacctcgtggaacatcaccaagctggcgtctttcagacccggcacgacgatccggaggacagcttccgctggctgtttgcctccttcgataaacttagagaatggaacgcggagctggtgcggatcgacacgctcgggcagccttggagacgcaagcggggactggaaaccggcagcgaggatgctacaagaattgggtggacccgccccaaaaagtggccttga

SEQ ID NO: 3830 - RNA, 3198 nt, synthetic construct
  misc_feature 1..3198: note = Cas9 variant
  source 1..3198: mol_type = other RNA
atgaacaaggacatcaattacgccctgggcctcgatattgggatcaccagcgtgggatgggctgtcattaacctggaccttaatagaatcgaggatctgggcgttcggattttcaacgccgcggaaaatctcaaagacgggtcctctctggcccttccccgcagactggctcggggacgcagacggctcctgcgcagaaaggcctatcgggtggagcgcgtgagaaaactgatcctcaagaacaatatcctgacaaaagaggagcttgaaggcctgtttaagaacaaggaggtcattgatgtgtgggaggctcgggttaaagggctcgactacaagctgagccgcgaagagtgggccaaaatccttattaatttctgcaagagacggggatttaaatccaaccgcaagaatgaagctaaggataaagaggccggccagatcctgtctagcatttcctataacatcgagaagatgaaagaaacgaatagcagaaccattggcgagtacatctataacgaagtgaagaatagcgaggactcctacgcgcctctccggaacaaattcggggaatataagatgtgtgtcagcagagatgtgatccgcgaggagattcacacactgtttgaaaaacaacgggagctgggaaacaatttcgcctctgacgaaatcgaggataagtactttgaaattttcaactcccagagaccgtttagcaatttcgaggacctcgagaagctggttggcttttgcaccttcgaacgcaaaaagcataaacgggctcccaagcactgtatctcttccgaggaatttacactttacgaggggattaacaaactgagcatcatcaaggatggagaaaagagaaaactctctgaggaggaacgcaccctggtggtcaatgaggccttcaacaagaaagaaattaagtatacaacccttcggaaactgctcggcctgtccgaggaggaactgttcagcacgctcacctactccatcgacaaggacatttctaagacagagaataccaaatttgtgagcctgaaggggtatcatgaaatcaaaagagctattgagaagggagtgtccaaaaaggcctggcaggatatcgaaaacaatcgcaaccttctgaatgacatcgcgtacgtcctcacactgggcaagaccgatgacgagattgagaaacagcttcggctgagaaacgttcctgaagaactcttcgaaagcctgctggatatgtcttttaataagttcaacaatctctccatctatgccctggagaaaattcttccctttatgaaggaaggctaccaatataacgaggcttgcgagaaagccgggtacaacttcaaggctatctacgaaggagtgcgcacgaaaaagctgcctgtgattgagatcgacgaaattgtcaatcccgtggttaaccgggccctcgcccagacaagaaaggtgatcaatagcgtcatcgataaatatggctctcctgtgcggattaacatcgagctggctcgcgacctggcgaagaattttaaagatagaaaacttattgaaaaggagcagaaggagaaccgggccaatctcgacaagatcagagaaaacctgcgcgagctgatggataaagaaccgaccgttgtggaggtcctcaagtaccggctgtgggagcagcaaagaggggaatgtgcttatacacagagccagattccccttgagcgcctgttctcccctggatactgcgaaatcgaccacatcattcccttttctagatctttcgacgattccctcagcaataaaatcctggtgctgggctctgagaaccagcggaaggggaatcgcaccccttatgaatactttggagaggactccgagagatggaacagcttcgaaatttgggtcaaaggctcttatcttaattacaagaagaaagccaacctcctgaagaaaaagttttccgaggaggaacaacgggattggaaagcccgcaatctgcaggacaccaagtacatctgtagatatattagcaacttcgtgaacaatcggctcgagttcaaggaatccgagaacaaacagaaggttatcacagtgaatggccgcgctacggcctacctgagatctcggtgggggcttaacaaagtccgcgaagatggagacaagcatcacgcgctggatgctgccgtggttggcgtgaccacacaagggatggtccagaaaatcagcaagtattccaaagcccacgagctctacaccgtgagaaagaatgacgaatttgtggatgttgagacaggagaatgcgtcgacgtggatgagtataaggagattcggaaagacatcctgcccagaccgtggcgcggcttctctgaggaactgaaacttcggctcagcgataaccctctggaggaactgaagaagtcccccattgagacctacaatgaagagtttatcaaagaaaacgtgaagcctattttcgtcagcagagtgccctttcgcaagatctctgggaaactcttcaaggagacgatctattccgaacgggcttttaaagacggctacttcgttagcaagaaatctctggtggaccttaagagaggagatctggacaatttttacaactatgagtgtgataagaaactctacgacgccatttccgagcgcatgaaggagttcaattataacggcaaaaaggcttttgaaagccccttccggaaacctacaaagtctgggaaggaaggaccggtcgtgagaagcgttaaaatcaagtccgccgtgccctttaaagatggcattcctatgaatgaggggctggtcgcgaaggaaggaatggtgcgcatcgacatttacgagaaagagggcaagtatttcgttgtgcccgtctaccggtatcagctggccaaggggatcgtgcctaaaagagctgccattgctaagaaagatgaacttaagtggcccatcatggaccagacctacaacttcaaatttagcatctacaagaatgatctcattgaggtgaaatatgacaagaagggcgtctacttcggatattacgatggctttgaccggaactctgcctccctgaccatcgaaaaacatgataacagcgagcgctatagatccattgggctgaaggttggagtgctcgaaatcaataaatacgaggtggacgtcctgggcaactatcacaaggtgaaacttgggggaaattga

SEQ ID NO: 3831 - RNA, 3198 nt, synthetic construct
  misc_feature 1..3198: note = Cas9 variant
  source 1..3198: mol_type = other RNA
atgaacaaggacatcaattacgccctgggcctcgatattgggatcaccagcgtgggatgggctgtcattaacctggaccttaatagaatcgaggatctgggcgttcggattttcaacgccgcggaaaatcccaaagacgggtcctctctcgctctgcctcgcagacttgcccggggacgcagacggctgctccgcagaaaggcctatcgggtggagcgcgtgagaaaactgatcgtcaagaacaatatcctgacaaaagaagaactcgaaggcctgtttaagaacaaggaggtgattgatgtttgggaggctcgggtgaaagggcttgactacaagctgagccgcgaagagtgggccaaaatcctcattaatttctgcaagagacggggatttaaatccaaccgcaagaatgaaacgaaggataaagaggctggccagatcctgtctagcatttcctataacatcgagaagatgaaagaaaccaattctagaacaattggcgagtacatctataacgaagtcaagaatagcgacgattcctacgccccgcttcggaacaaattcggggagtataagatgtgtgtgagcagagacgttctgcgcgaagagatccacaccctctttgagaaacaacgggaactgggaaacaatttcgcgtctgatgagattgaagacaagtactttgagatcttcaactcccagagaccctttagcaatttcgaagatctggagaagctcgtgggcttttgcacattcgagcgcaaaaagcataaacgggcccctaagcactgtatttcttccgaagagtttaccctgtacgaagggatcaacaaacttagcattatcaaggacggagagaagagaaaactgtctgaagaggagcgcacactcgtcgtgaatgaggctttcaacaagaaagagatcaagtataccacgctgcggaaacttctgggcctctccgaagacgagctgttcagcaccctgacatactccattgataaggacatctctaagaccgagaatacaaaatttgtgagcctcaaggggtatcatgaaattaaaagagccatcgagaagggagtctccaaaaaggcttggcaggatattgaaaacaatcgcaacctgcttaatgacatcgcctacgttctgaccctcggcaagacggatgacgagatcgaaaaacagctgcggcttagaaacgtgcccgaggagctgttcgaaagcctcctggatatgtctttttccaagttcaataacctgagcatttatgcgctcgagaaaatcctgccttttatgaaggaaggctaccaatataatgaggcctgcgaaaaagctgggtacaacttcaaggccatttacgagggagtgcgcacaaagaaacttcccgtcatcgagattgacgaaatcgtgaaccctgttgtgaatcgggctctggcccagaccagaaaggtcattaactctgtgatcgataaatatggcagcccggttcggatcaatattgagctcgcccgcgacctggctaagaactttaaagatagaaagctgatcgaaaaagagcagaaggaaaatcgggcgaaccttgacaagattagagagaatctccgcgagctgatggacaaagaacccacagccgtggaggtcctgaagtaccggctctgggaacagcaaagaggggagtgtgcttatacccagtcccagatcgccctggagcgccttttctctcctggatactgcgaaattgatcacatcatcccctttagcagatccttcgacgatagcctgtctaacaaaattctcgtgctgggctccgagaatcagcggaaggggaacaaaatcccttatgaatactttggagaggacagcgaacgctggaactctttcgagatttgggtcaagggctcctatctgaattacaagaaaaaggccaatcttctcaaaaagaaatttaccgaggaagaacaaagagattggaaggctcggaacctgcaggacacaaagtacatctgtcgctatattagcaatttcgtgaacaacagactggagttcaaagagtccgaaaataagcagaaagttatcacggtgaacggccgggccaccgcgtacctccgctctagatgggggctgaataaggtccgggaggatggagacaaacatcacgctcttgatgccgccgtggttggcgtgacaacccaagggatggtccagaagatcagcaaatattccaaggctcacgagctgtacacagtgcgcaagaacgacgaatttgtggatgttgagaccggagaatgcgtcgacgtggatgagtataaagaaattagaaaggacatcctcccccggccgtggagaggcttctctgaggagctgaaactgcgccttagcgacaatcctctcgaggaactgaagaaactgcccattgaaacgtacaacgaggagtttatcaaggaaaatgtgaagcctattttcgtctcccgggtgccctttagaaaaatcagcgggaaactcttcaaggagacaatctattctgaacgcgcctttaaggatggctacttcgtttccaaaaagagcctggtggaccttaagcggggagatctggacaacttttacaattatgagtgtgataaaaagctctacgacgctatttctgaaagaatgaaagagttcaactataatggcaagaaagcctttgagtcccccttccgcaagcctaccaagagcgggaaagaaggaccggtcgtgcggtctgttaagatcaaaagcgcggccccctttaaggatggcattcctatgaacgaggggctggtggctaaagaaggaatggtcagaatcgacatttacgagaaggaaggcaagtatttcgtggttcccgtgtaccgctatcagctggccaaagggatcgtccctaagcgggctgccattgcgggcaaatccgagcttaagtggcccatcatggatcagacctacaatttcaaatttagcatcttcaagaacgacctcattgagatcaaatacgccaagaaggatggatattttggctactatgacgggttcgatagacatacagcttctctggtgattgaaaatcacgacaactccgaccggtaccgcggaatcggcgtgaaaaccggggtcgttgagtttaacaagtatgaagtggatgtgctgggaaattaccataaagtcaacctcggcgggaattga

SEQ ID NO: 3832 - RNA, 3201 nt, synthetic construct
  misc_feature 1..3201: note = Cas9 variant
  source 1..3201: mol_type = other RNA
atgagcgagagagtggtccggcgcatcctgggcattgacctcgggatcgcctcctgcggatggggcgttgtggatatttctggggctggaggcgggatcattgccaccggagtgagatgtttcgacgcgcccctgatcgataagacaggcgaacctaaaagcgctacgcggcgcaccgccagaggccagcggcgcatcgtcagacggcgcagacaacggatgaacggggtgcgcagacttctgtgcgagtttggactcctgccggacccccggcctgatgcccttaatcaggctatgcgcagaatttccacagcctctgctgccgcgcaggttaccccctggacactgcgggccgctgcccaccagagactcctgagcaacgaagaactggctgtggtcctcggccatatcgcccgccaccgggggttcagatccaatgcgaagaacgaagccggagctaatgccgctgacgagacctctaaaatgaagaaagccatggaggccacacgcgaaggcctggctaagtaccatgcgtttggggatatgattgccaacgaccctaagttcgctaatcggaaaagaaaccgcgataaggactatagccacaccgccaaacggtccgatcttgaggacgaagtgagagccatcctgcgcgctcaactccggtttggaagcgccgcggctacggagaccctggcccagacattcgccgatgttgctttcttccagagaccccttcaggactctgaggaccgcgtgggcgattgtccttttgaaccgggccaaaagcgggccgctagacgggccccctccttcgagctgtttcgcttcctcagcagactggcgaatctgaaactcgccgtcgggcggtctcctgaaagacgcctgaccgctgaggaaattgcccttgctgccaagggatttggcgagacaaagaaaaccatcacgttcaagtccctgcgggaggcgctcgacctggatcccaacgccagattcagcgggattggaaaagacaaggaggcttctcttgatgtggtggcccgcacaggcggggctgcctacggaaccaaaacactgaaggacgccctcggcgatgctccttggagatccctgagccggacccccgagaccctggaccgcatcgcggaaatcctctcctttagagaggatattacatctatccggaatggcctggaagaccttgggctggatagcctcgtcgttgaggccctgatgcaggctgccgccaacggagacttcaaagagtttacgcgcgctggccatatttccgccagagcggctcggaatatcattccggggcttcgcgaaggactggtgtatagcgaggcctgcgccagagtgggctacgaccacgctgcccggctctctgtccctctggatcaggtggggtcccccgttacccgcaaggcgctgagcgaagctctcaaacaggtgagagccgtcgcccgggagtatggccctatcgactacttccacatcgaactggctagatctgtgggaaaaagcgccgaggagcgcaagcaacttacagatggcattgaagctcggaacgttgagaaagccaagagacgcaaacaggcggaagaacatctggggcgggccccctccgacgatgagctcctgagatatgaactggctaaggagcagaattttaagtgtatctactctggagacgccattgatcccgctggcgtggccgccaacgacacccgctaccaagtcgatcacatccttccttggagccggttcggggacgattcctatctcaacaaaacactgtgcaccgctagaagcaatcagaacaagcgcggacggacgccgtttgaatggttcgaggcggacaaaacagatgtggaatggatggagtacgtcgccagagtggagaatctgcaggaagttaagggccggaaaaagcgcaactattctattaaggacgctgccgccatcgaggacaaatttaaggctagaaatctcaccgatacccagtgggccacacggctgcttgcggacgaactgtcccgcatgtttccccctagagagtgtgaacgggctatctgcgggagagccgatggcggaaacgacggcctcaccattgtggaggagcgccgggtctttacaagacccggggccatcacgagcaaactgcgccgggcttggggactggaaggccttaagaaacaagatgggaagagagtggaggacgatcgccatcacgccgttgacgcgctcgtgctggctgccaccacagaatctctgctccagcggctgaccgtcgaggtgcagagacgcgaaagagagggacggcctgatgacattttccactgtgccgagccctggcgcggctttagagctgatgtgcggcgcacagtttacgggtccgaaaccatgccgggcatcttcgtcagcagagccgagcggagacgcgctcggggaaaggcccatgacgcgacgattaaacagatcagagaaattgagggcgagcgccttgtgttcgaacggaagcctgtggagaaactgaccgataaggacctcgaaaagatccccatccctaagccctatgggcaagtctccgaccctaaaagactgcgggatgagctggtggaatctcttcgcgcctggattgctgccggaaagcccaaggacagaccgcctctcagccccaaaggcgatgttatccggaaggtgcgcattcagacaaatgacaaagtctccgtggagatcaacgggggaaccgttgatagaggcgacatggctcgggtggatgtctttcgcaagaaaaataagaaggccgtgtgggagtactatgttgtgcccatttaccctcaccagatcgtcgccctgaacgacccgcccgatagagctgtgatcgcgtacgccgaagacaaagattggaaggagattgactctagctatgagttcctgtggtccctctttgggctgagctacgtggagatctctaaagctaatggcgaatgcattgacggatatttccggggccttcatcgcgggacaggagccgcctccgtctgtaagcacatcagcctgggcaaagatgctaccgtttctgggattggactcaagacgctggcctcctttaagaaattcacaatcgacagactgggccggaagtttgagatccctagagaggtgcgcacctggcggggcgaagcgtgcacatga

SEQ ID NO: 3833 - RNA, 3201 nt, synthetic construct
  misc_feature 1..3201: note = Cas9 variant
  source 1..3201: mol_type = other RNA
atgagccacctggtgctcggcctggaccttgggcccaactccatcggatgggccctggtcaatgatgaccctgagcatccggttgaatctaagctcgtggatctgggcgtgagagtcttccccgagggggtggacaactttgataccagcaaagaactttcccggaatgaggaccgcagagttgctcggggaatgcgcagacagattcggcgcagagcccggcgcagacaacagctgaagcaggcgctcatcgattctaaactgtggcctagcgaccccaacgatgaagtggtcctgtacaatacaaacccttatgagctccgggctcgcgccctgaaggagagacttgaaccccacgaggtgggccgggttctgctccatctgaatcagcgcagagggttcctttccaaccggaaaaaggacagaggagataaggaagtgcaaggcatgctggccgagattaatgagaacgaacagcagtgcaaagacggcgggtttgatacgatcggagcttggctcgccgacaagcaggctaatattgaccacgccaaccgcgaggaaaatgatcatgtccggaacagacacctggcgcgctctcaatacgtggacgagttcgaagccatctggagcgtgcaggctaaacaccatcctaagctgctcaccgaggagctgaaagtcggcaaacttgggaagcagacatatccggttaagcccatccctcggtggcacgaacatagacagggactgagccccctcgagtcctttggcatttacgggctgatcttctttcaacgccctatgtattggcccaagtctgtggtgggactttgtgaactggagccgaaagaacggagatgccagcgctccgatcggagacagcaacgcttccggctcctgcaggaggtcaataacctgaagtacgtggaccctgatacccacctcgagcagaaactggacgataagcagagacggcttctgctcgacaaactgagccacacaaaggaaatgacctttgatcaaattcgcaaggcccttgacttcctggagtctgttaaatttaacctcgaaagaggcgagcggtccagactgaagggcgtgcccatcgatgctctgttcgccgcgaaagacgtcctcgggcaggaatggtatgaccgccctgagcagcagaagacagagattgtggccgttctgcttgataatgaacgggacgatgacagaatcattgctcgcgccgtggctgagtggggaatgaccgccaaagaagccgaggctatgctgggcgtcgatctccccgcggggtacgccaacctgagctgtaaggctatcgagaagctgcttccccatatggaaagaggactcctgtacatggacgatgacgagtctaattccgccatgcacgccgctggctatctgcggcgcgatcaactcagacggcgcatctttgacgtgctgcctgatccggccagaacgcccaactgccctattggggacatccccaatcctgtcgtgaaacggacccttacagaaattcgcaaggttgtgaacgcgatcgtcagagagtacggaaaacccgatgctattcatctggaactcgcccggagcgtgcagatgggcaaggagaaacgctccgagtattctaagatgatcagagaccgggaagccgagagagacggcatcgttgaaaagctgcgcgagagcggggtgcgggtcaccagagataatattctgaaataccagctttgggaacagcaaaaccaggagtgtatctattccggaaagccgattagcttcgagaaactcttcggcgaagggggaggcgtggaggtggaccacatcctgcctcgctctcggtccctggatgacagccaggctaataagattgtttgcctcagaacagccaacgctgggaaaggcgatcagaccccctacgaatggctggccgacacgcaacctaagcagtatgagcaggtctgtcaacgcgcgggaatgcttatgcggtctggcagaatgccctacgccaagtaccgccggtttatccagagagaactggagctcgataaattcatcgctcggcagctggccgacacagggtatattaccaaggctacaatggagtacctgcgctatctttttgataaagaccatgatgtgctcggactgaagggccagctgaccgccgaactcagataccactgggggctggagaccatccttgaggaactgcctgacagccccgcgtggcacgaggccgattccggaaaactccggccgggcgaaaagaatcgcgctgaccatagacaccatgccattgacgctgtggtcatcgccctgacaaaccggagacgcctggtgcaactttctgatattgttaaaagagggggcgcccgggctcacggagagatcctcgaagacccttggcccaatttccgcgagaacgtggtccaggcgattaagaagacgaatgtgagccaccgggttgaaagaaaagtggccggcaagctgcatgaggagaccctgtatgggcccacacgcacccctggagaatgggtcctccggaaaccggtgatcgctctgtccgccaacgaggttgaaagaatccgcgatgccacaattagacagatcgtggtcagcgctcttgccgacgcgggcattgatgtggggcggggaaagaaacccgacgctaagaagatgaaagaggccctgtctaagctcaaaatgccttccggcgtgcccatccgcaaggtcagactgaccaaacctgaacagacgattcaacccgttcgggccgggcgccctgatcaggcttttgtgaagcccggcagcacacaccatctgtgcatcttcgagtttaccgagaacggaaagaccaaaagagacgccgtgttcgtcacaatgcttgaagcgatgaatcggctgaagagacgcgagccggtgatccagcggacccaccctgaaagacccgattctcgctttgttatgtccctcagcgctcgggagatgctgctcgccaactggaaagacggcgaaagactgcttacattcaagacggcctcctctacccaggggcaaatttggtttgctgagcatacagatgcccggaaaagcgctgactacaagcagttcgtggccaatgcgaacaccctggacgccaagaaagtcacagtggatcctctcggacgcatcagatgggctaatgactga

SEQ ID NO: 3834 - RNA, 3204 nt, synthetic construct
  misc_feature 1..3204: note = Cas9 variant
  source 1..3204: mol_type = other RNA
atgggcaccagactggggctcgacatcggaacaaacagcattggctggtgcctgttcaatcttgatgggtccggacggcccatcggcattcgcgacatcggggtgagaatcttttctgatggacgggaccctcgcagcggcgcctccctggctgtcgagagacgggttgcccgcgcgatgagacggcgcagagatcggtacatccgcagacggtctgctctcctggaagcccttatcaacacgggcctgatgccggccgacgtgcaggagagcaaggctctcaccgggtgtgatccctatgtgctgcgcgcccaagctctggacagagccctcgatgcgcaccttcttggacgggtcctgttccatctcaatcagagacgcggctttaaatccaaccggaaggccgaaagaaaagctggggacgataaggagggaggcaaaattgccgacggggctaaggccctggatcttgcgatgcacgaagccggagctcgcacatacggcgagttcctggccggccgggactctagacgcgtgcggctcagagctgagggggacggatatgatttttaccctgaacgccggcatctggaggccgaatttgacgccatctgggatgctcaggcggcctataatcccgctctgctcaccgacgttgtgagagatcgcctgcggagaattatcttcttccagcggcctcttaaggcccccaaagtcggcgggtgcacatttttcaacgaggagcctcgcctgccgaaggcccaccccctctttcaagaaagacggctgtacgaggaagtgaatcagcttgagattaccagagctggagcccctagccgcaaactgacactcgaccagcgggataagatcattagaaaactgaagtccgcgaagaccgctagcttctctggcctggcccgcctcctgaaacttgccgacggggaatcctttagcagagttacggagaaccggaccggactggctggcgatgacatcttcacatctttctccgataagcgctgttttggcgacagatgggcccatttcgaccccggggtgcagtggagcatcattgagaccgtcacagaagaggaagatcctgtgcggctccgcgactggctgatggctacccacggagtgacggtcgagcaagccgaagcgatcggcagagttcggcttcccgaggggcacggacgcctgggcgagacagcctctagactcattctggctcagctgaaatccgggagcaaggatggccatccgctcacctataatgaagccgtggaggctgccctgggaaaatcccactctgactttcggacaggcgaaatccttgagcagctgccttactacggggaaattctcagccgcgagattccccctggatccctggatcccgacgatgacgatgagatcagatggggcaagattaccaaccccaccgtgcatatcgggctgaatcagcttcggagactcctgaacgcgctgattaaagcccacggacgccctgacgaaatcgtcgtggagctcgctcgggaactgaagctgagcgagaaggataaagccgagcacaatagacgcattggcgctaacacacgggccgccgaagctagatctaagaaactgctcgagtccgggcaaccggacacgggcgcgaatcgcagcctgctgaaactttgggaagatctcaaccccaacaatcctctggaccggtgctgtcccttctgcggaagacatatcggccagatggccctgttttctggggagaccgaaatcgagcacattatcccttatagccgctccctcgacgattctgctgccaacaaggttattgcccatcggagctgtaatagagagaagggaaaccggacaccctgggaggcttggggccacaccgaacgctgggccatcattgcggaacaggtgtccagactgcataagagcaaacaatggcggttcgctccggacgccatcgagcgctttaatcaggaagggggattcattgccagacagctttctgatacacagtacctgtcccggatggctagaacctatctcagctctctgtaccctgacacggccggcgtctatgtgatccccgggcgcatgacagcgatgctgcggagactttggggcctcaacgagctgctgcctgatcacaattacgttgagaacccccactccggagctcctaagaatcgcctcgaccatcggcaccatgccatcgatgccgctgtggtcggcgtgaccaccagagggctgcttaacgaaattagccgcgccgctggacgggccgagagacaagacctggatcgcctctttatcgacctgcccaaaccgtgggaaacattcagagaggatctgcacgaatcccttgcgcgggtcgtgggctctcacaaggccgaccatgggcgcaaaggagttcctgctaagggcaaggatgccaccgctgccagactccacaatgagacagcctatgggctgacgggcctgaccagcgagtccggactccccattgtggtccatcgggtgcccctgctttctctgaaacctgacgacctcagcaacccgatccgcattcccgatgctgcgctgcagagagccctgcgggaagctacagacggcaagtccgggaaagattttcaggaggcccttgcccagttcagcaagtctgaccctgtttttaaaggaatcagacacgtgcgcgtccgggaaaccctgaaggtgatccccattagagatgcttccggccatgccttcaaggcgtacaaaggggacgctaatgcccgctacgatgtgtggcggatgcctgacggaaagtgggttagctcttggagagatcgggacggcaaagcccactccggcatcattacaatgttcgctgcccaccaagcggggcagcccgtccagcgccctcatcccgctgccaagagagtgctcagcctgcggcagaacgatctcgtggccgtcgagccgcaaggacagcctcgcaaaatcatgagagtggttaagttttctagcggcgggcagattaccttcgctgagcaccaggaagccggacccctgaaagctcgggacgccacgtcccctgacatcgatccctttaagtatttctacagctctgcgggcgggcttcaaaaggcccgcgctagacagatccggattgacgagctgggacgcatctttgatccgggccctagatga

SEQ ID NO: 3835 - RNA, 3207 nt, synthetic construct
  misc_feature 1..3207: note = Cas9 variant
  source 1..3207: mol_type = other RNA
atgaagtacgtgctgggcctcgacatcgggattgccagctgcggatgggctgtcatcaaccaggagaaacacagaattgaagatctgggcgttcggatcttcgacaaggccgagaatcccaaagatgggaagtcccttgcgacccctcgcagagacgctcggtctacacgcagaacgctgcggcgcaaaaagcatagaatgcaacggattaagatcctcctggtgaaacacggacttctgagcaagaccgaaatcgatcatctctatgagtccgccacagaaattgacgtgtggtacctgcgcctgaacgccctcgagagacggctgaatccgaaagagtttgctcgcgtccttatccacctgtctaagagacggggcttcaaaagcaaccgcaaggaaaccacactctccgagaatgggcagattctggaaaacatctctgagaatcttcagattatggagcagaagaactatagaaccgtgggagaaatgatcctgaaagataagcggtttgagaatcataaaagaaacaaggacggcacatacattggcaccgttacgcgccaacagctccaggaagagatccagatgatcttcaatgcccaacggctgtataaaaacaatcacgctaccgaaaagtttgagagctcctacctggagatttgggccagccagagaccctatgcgtctaaagatcagatcgaaaagatgattgggtactgtacactcgagcctaaggaaaaacgcgtgcccaaggcctcctggagcttccagtactttgtcgctctgcaaaccatcaacaatcttcggctgatttctaaagacagaatcgaggaactctccttcgaggagaagaaacgcatcatgaacctggcccttgaaaagagcattgtgaagtatatcgatattcggaaactgctctctgttcctaaggagtttcagttcaactccctgagctactccgctgacatcgtggatacaaccgtcgaaaataaaaagtgcattgagctgaaagaatatcactctatcaacaaggtgtacaagcagatctatggacaaaatgccctcaacctgcttcccaaagactacgacacgattgcgtatggcctgacaatctttaaggatgacaaagatattcaggagtacctccagaataagtacgtgaacgccaaagggaagcctatcagcaatctggctaacaagacctatgacgatacattcattcaggtccttctgaccctcaatttttccaaaatgggacatctgagcttcaaggccctgaaaaacatcattccgttcctcgaggaaggcctgtcttacgacaaggcttgtgagaaagccgggtataattttaagggaacctcctacacaaagaagacgaagtatcttcccgttatccctcaaaacaccaatcccgtggtgcacagagccctgagccagacacgcaaagtcatcaacgctattatcaagaaatacggctctcctaatgcgattcatatcgaaaccgcccgggagctcagcaagacattccaggagagaaaagaaattgattccatgtatcaggacaactctaagaagaacgagcacgctatctgcaaactgaaggaactgggcaatatcaaccccagcgggattaatatcgtgaaatttaaactttggaacgagcaagatggacgctgtatgtacaccggcaaatacattgaaccgcacagactcttcgaggaggggtatacggaagttgaccatatcctgccttactcccggagcctggatgactcttataataacaaggtgctcacactgggaaccgagaatcagcggaagggcaacaaaaccccctacgaatatatgcgcaataactccatttgggacgagtttgaaacaagagtccagagcaataagaaaatcaacaagaaaaagcagcaaaaacttctgctccagaatttctctcacgcccgggagcaggagtttatcgaaagaaacctgaatgatacccgctacgccacaatttatctgtccagccttatccagcaacatctcattttctccgagtctagccgggaaaagaaggtgcacacggtttccgggatcattacctctcatctgagaagccgctggggatttaacaaagacagaaaggagggccacatccaccatgctctggatgccgtgatcgtcgcggtgacatccgaccacatgattcagcgggtcaccaaatactacaagctcaaagaactgaaccgcaatagacaggctaagcggatgcaattccctgagccctgggagggctttcgccttgaactggaggccagaatcagccccaacacacagcagtatctcaaggggattcggttcaaaaattacgccgatgtgaacctgtctgaaatcaagcctatttttgtttcccgcatgccgaaaagaagcatcaccggagagctgcatcaggagacgattcggaagttccttggctataatgaaaaagggaaggtgctcaccgctacaaagaccaaactggaggacatccccttcgatgccaacggagactttcctatgttcggcaaggaaacagatctgtacacctataatgctatcaaagagcgctacctctctcacaagaaagacaagtccaagagctttcaagaacccctgtataaacctacgaagtctgggggcattggaccccttatcaaaagcattaagatcatggatacaagaaccattgtcaacccggtgaatcagggcaaaggggttgtgtacaactccaagatcgcccggacagacgtcttcaagaaaggagagaagtactatctgatccctatttacaccatcgatctcatgaaaaataccctgccccagaaggcgattacagccggcaaagggtatgaggactggacgaccatcgaccctagctttacattcctgttttctcttttccccaacgatctcattcagatcgtgccttccaagaataagaccatcaaagctagaacaaccgtgagcaagaaagaagttctgctgccctccctcacgggatactttaagggcgtccactctgggacagccggcattaccgtggagacccatgacggaagcatcattgctaacgtgggctccaaacaactgctttctttcgaaaagtatcaggtcgatgtgctggggcactacacaaaaatcaagaaggagaaacgcattggaatggccatctga

SEQ ID NO: 3836 - RNA, 3207 nt, synthetic construct
  misc_feature 1..3207: note = Cas9 variant
  source 1..3207: mol_type = other RNA
atgaacaaggccgtggcttacagactggccctcgacctgggcagcacctcccttgggtgggcgatcttccggctgaatgaggctcgcgaacccacagccattatcagagccggagtccggattttctctgatggccgcaacgctaatagcgagcctctcgccgttcacagacgggtggctcgcgccatgagacggcgcagagaccggctgcttaaacgcaagaaaagaatgcatgatcagctggtgcaacacgggttctttccggcggaagtcgccgagcggaaggaactcgagcgcctgaacccctatcagctgagagctaaaggactccatgaggccctgacgcctggcgaatttgctcgggccctttttcacatcaatcagagacgcgggttcaagtccaaccggaagaccgacagaaaagataatgactctggagcgctgaagcaggccattagcgagctccgcaaacggatccaagattccgactgcgctacagccggcgaatggttttggaaggagagaatgcagcagaaacccgagggcgtgcgcgggcagtgggttcgggctagataccgcaagaccccttctacaaccgatgaaggaaagaaacggatcggctatgacctgtacgtggatagagccatggtcgagcaagagttcgacgccctttgggctgcgcaggccgctctgcagcccgggctctttacagaagccgcccgcgctgaactgaaggataccctgctctatcagcgggacctgagacctgtgaaaccgggacggtgtacgcttctgcccgccgaggagcgcgcgcctctcgctctgcccagcacccaaagattccggattcttcaggaagttaacaatctgagactcctggacgaggccctgcgcgaagtgcctctcaacctggcccagcgggatgctgtcgtgtccgcccttgagggcaagaaagaactgagctttgctgccatcagaaagctcctgacactttctgggaaattcaatctggaggacgagaagcgcgcggaactcaagggaaacgccacctccgtgattctggctagaaaagatctgtttggcgacgcctgggctggcttcgatgccgcggtccaagacgagatcgtttggcggctcgtgagccaggaatctgagggggccctgattgcttggcttcagcagcatacaggagtggatggcgtctgcgccgaagctatcgtgaatacccgcctgcccgacgggtacggaagactctcccggaaggccctggagcgcattgttccggccctgcaaagagaggtgtgtacgtatgataaagctgtccaggcggccggcttcgctcaccacagcgaccttgggtttgatttcgactacgccgaagacgaggtgcagcaggttggagaacatacaatcgcctctaccggcgaggtgcaagctcagtacgcctttaagcagctcccttattacggcaaagcgctgcagcggcacgtcgctttcgggtccggagatgccaaggaccatgaggaaaagtgctatggcaaaatcgccaaccccacagtgcacattgggctgaatcaagtccgcaccgtggttaacgctctcatcagacggtacggacaccctaccgaggtggtcgtggaactggcccgcgatcttaagcagagcagagagcagaaacagcaaacacagcgggaacaggcggacaaccaaaagagaaatgaggatattcgcaaacggatcgctcccattctggagacgtcccccgaaagagttcgcgaccgggatatcaagaagtggatcctctgggaggaactgaacaaaaaggacattgccgatagacattgtccttattctggcgagcgcatcagcgccaccatgctgctttccgaagctgtggagattgagcacatcctcccgtttagccggacactggacgattctctgaataacagaaccgtcgccatgcgccgggctaatagaattaaaggggaccggacaccctgggaagcccgcgcggatttcgaggcccagggctggagatacgaagctatcctccagcgggccgagggaatgcctccccgcaagagatatcggtttgctgaagacggctaccagagatggctggggaaagaccgcaacttccttgcccgggccctgaatgatacctcctacctcagcagactggctgcgaactatctgcgccttgtgtgccctcaaggagtgcgggttatccccggccagatgacggacaagctcagagggaagtttggactcaattctgtcctgggcctggatgggaaaaagaaccgcaatgaccatcggcaccatgccgtggatgcttgtgtgattggcgtcacagaccagggactgatgcagagattcgccaacgccagcaaacaagctcgcgagaatggccttaccagactggtgcaggatatgctcctgccgtggtggccttcctactatgaccacgttgagcgggccgtgcgccacatcagagtctctcatcggcccgatcacgggtttgaaggagcgatgatgaagggcaccgctcatgggattcgcgaggacggaatcagagaagatggccggattaaacagagacctaaggccaaagggagcgccgaccacaagacaatcaccctgattcccatcgatgagcctcgccagcttgctcggcacggcgtggacgccgagggaaagcccctcccgtacaaaggctatgcgtccgggagcaactactgcatcgaaattacaaagaatggaaaaggcaagtgggaggggcaagttatctctacgttcgacgcttatagaattaaagccgccgctgatgccgctgcccgcgcgggacaggtgatctccaccgtcgaagccgacagcattgtgcggaagtctggctgggagagactgcgcggggctcagtcccaaaacggccagcctctggttatgcggctcgtgatcggagatagcgtcagaatggaagtggacggccgggatgaggtgatgcgcgtcgttaagatgtccgggaaagagatggtgtttgcccccgtgagagaagctaacgtcgacaagcggaataacatgcccgatgagcaggaccctttcacatacacctacaaacgcgccgatcagctgagaaaggccaaagctcggcaagtgacaatctctccgattggagaacttcgcgaccccggcttcaaggggtga

SEQ ID NO: 3837 - RNA, 3207 nt, synthetic construct
  misc_feature 1..3207: note = Cas9 variant
  source 1..3207: mol_type = other RNA
atgcagtacgtgctgggcctcgacatcgggattgccagctgcggatgggctgtcatcaaccaagagaaggaaagaattgaggatctgggcgttcggatcttcgacaaagccgaaaatcccaaggatgggaaatcccttgcggctcctcgcagagacgcccggtctacccgcagaacactgcggcgcaagaaacacagaatgctccggattaagatcctgcttgtgaagcagggactgctcagcaaaaacgagctgaatcatctgtatgaatccacgaccgaggtggatgtctggaacctccgcctggacgcccttgagagaaagctgaatccgaaagaatttacacgggtgctcatccacctggctaagcgcagaggcttcaaatctaaccggaaggagaccacacttagcgaaaatgggcagattctggagtccatctctgagaaccagcaaattatggaacagcagaattaccgcaccgttggagagatgatcctcaaggataaaaagtttgaaaaccataaaagaaataaggacggcacatatattggcaccgtgacgcggcagcaactgcaggaggaaatccagatgattttcaccgcccagagactgtacaaaaacgattatgctacagaggagtttgaaatcagctacctcgagatctgggcctcccaacgcccctatgcgagcaaggaccagattgagaaaatgatcgggtactgtaccctggaacctaaggaaaagcgggtccccaaagcctcttggtccttccagtactttgtggcccttcaaacaattaataacctgagactcatcagcaaggatcgcattgaggagctgtctttcaaagaaaagaaacagatcatgaatcttgctctggagaagtccatcgttaagtatattgacatccggaaactcctgagcattcctaacgaatttcagttcaactctctgtcctacagcgctgataccgtggacacgacactcgagaataagagatgcatcgaactgaaagagtattactccattaacaaggtctataaacagatctacgagaagaatgcccttaacctgctccccatcgactatgataccattgcgtacggactgacaatctttaaggacgataaagacattcttgaatacctgcaaaataagtatgtgaacgccaaaggcaagcctatcaataacctcgctaaaaagacctacgattataccttcattcaggccctgctgacactcaattttacgaagatggggcacctgtctttcaaagctcttaagaacatcattccgttcctggaggaaggactcagctacgacaaagcctgtgagaaggccggctataattttaaagggacctcctacacagagaagaccaaatatctgcccgtgatccctcagaacacaaatcccgtcgttcatcgcgctctgagccagacccggaaggtgatcaacgcgattatcaagaaatacggatctcctaatgccattcacatcgaaacggctagagagctttccaagacattccaagaacgcaaagagattgatagcatgtaccaggacaactctaagaaaaacgaacacgccatccataagctcaaggagctgggcaatatcaaccccagcggcattaatatcgtgaaatttaagctgtggaacgagcaggatgggcggtgcatgtattccggaaaatacattgaaccgcacagactcttcgaggaaggctataccgaggtcgaccatatcctgccttactctcgcagccttgatgactcctataataacaagaccctgacactcgggaccgaaaatcagcggaaaggaaacaagacaccctacgagtatatgggcaatacgagcatttggaacgactttgagaccagagtgcactctaataagaaaatcaacaagaaaaagcaacagaaactgctgcttcagcacttctcctacgcccgggaacaggagtttatcgaacgcaatctcaacgatacaagatacgctaccatttatctgagctctctgatccaacagcatctcattttctccgagagctcccggaagaagaaagttcacacagtgtctgggatcattaccagccatctgagatcccgctggggatttaataaggaccggaaagaaggccacatccatcacgcccttgatgcggtcatcgtggctgttacgtctgaccacatgattcagagagtgaccaagtactataaactgaaggagctcaaccgcaacctgcaagccaaaagaatgcctttccccgagccctgggaaggctttcggctggagcttgaagcccgcatcagccctaatacacagcagtacctcaaggggttcagatttaagaactatgctgatgtcaatctgtccgagattaaaccgatcttcgtgagccggatgcccaagcgctctattaccggagagctgcatcaggaaacaatcagaaaattcattggctacaacgagaaggggaaagtcctcaccgccatcaagacgaagctggaagacatcccttttgatgctaatggagacttccccatgtatggcaaagagacagatctttacacctacaacgccattaaggaacggtttctgtcccacaaaaaggacaaacgcaagagcttccaagagcctctctataagcccacaaaatctgggggcatcggaccgctgattaagtccatcaaaattatcgataccagaaccatcgtgaatcctgttaaccagggcaagggggtggtctacaatagcaaaattgcgcggacagacgtgtttaagaaggatgagaaatattacctgatccccatttatacgatcgaccttatgaagaacattctccctcagaaagccatcaccgctggaaagggctacgaagactggacaaccatcgatccctctttcacatttctgttcagcctgtttcctaatgacctcattcagatcgttccctccaaaaacaagaccattaaggcccgcacgacagtgagcaaaaaggaggtcctgcttccgtctctgaccgggtatttcaaaggagtgcattccggcaccgctgggatcacagtggaaacccacgatggcagcgttattgccaatgtcggatccaagcaactcctgctgatcgagaaataccaggtggacattcttggccactacacaaagatcaaagaagagaagagaatcgggatggcgatttga

SEQ ID NO: 3838 - RNA, 3207 nt, synthetic construct
  misc_feature 1..3207: note = Cas9 variant
  source 1..3207: mol_type = other RNA
atgcccaagagcgccaaacctcagcaggcttacaccctgggcctcgacatcgggattgcctccgtgggagcggctctgcttggccaacagcacatcattgggctgcatgtcagaacattcgatcgggccgagacggccaaggaaggagagccgctcaacaaaatccgcagagacgctcggctgacccgcagacggcttcagcgcagagcccaccggctgctccgcctgagacggctgtttaagcgccataatctcattcccgatacagacacctctacattcatcagcggccaatccccttgggaactgagagctcaggggcttgatcggcagctgacctctgccgagtggacaaccgttctctatcacatcgtgaaacatcgcggatttcacagcaacagaaagtccgaagtgaagacggacgagaaagcgggccagatgctgtctggcgtcaatcaaaaccaggcccttctgaagcagagcgggctccggaccatgggagagctggctgccagacacgaggctttccgcgaagccaaacggaataagaaaggcgcgtacaaccatacattttccagacacgatctggaagacgagctccatctgcttttcagccgccagcgggagctggggaatccctatgccacccctgaactcgaggatgctgtgcacacactgcttatgcaaagacgccccgccctgtctggaaccaacctcctgaagatggttggccactgcacgctggaacctgacgagtttcgggctccgaaggcctcctacacagccgaaagattcatttggctcaccaaactgaataaccttcgcgtgagcgggtctggagagacacggcccctgaatgagtccgaaagacaggctctcctgagcaagcctttttctcagtccaaacttacctataagcaagtccgcaaaatcctggagctccccgataacattcggttcgtgggcctgcattaccaccctgcgcaggacaatggcaagagccccgaaaacagagtgtttttcgaggccaaggcttttcatgccctgcggaatgtttataaaaaggccgggctcaacctggaatggcagcgcgattcccagaacccggagaaacttgacaatatcacctacgctctgacagtcttcaaggaggacaaagaagccaagcaatggctcattgagaaaggagtggaagcgtctgtgatcgaggctgtcctgaacgagagcttctccgaatttgttagactgagcattaaggcccttcggaagatcatccctcacatggagattggccatagatacgatgaagccgtgaaactcgctgggtattctcaccactcccatctgccccagcctagcaagacgccctacatcccccgcttctctaaacagagcattgccaatcctgtggtctcccgggctctgaaccaggccagaaagctcgtgaatgcgatcgttcgcgagtatggaccgcccgacgccgtgcacattgaactggctagagatcttaacaaaccttttgacgagcggcgcaagatcgagaaggatcaagaaaaataccagaaggacaaagccagagatatcgagaccttccaggaaaattttggcttcacacccaaggggctgcagctcaccaaatggcggctgtatcgcgagcaatctggaaagtgtgcttacagcctgaagcctcttgacattaacagactctttgaagatggctatgtcgagatcgaccatgccctgccctactcccggagcttcaatgatggcatgaacaataaagtgctgacactcaccacggagaaccgcaataaggggaaccagacaccgtacgaatatctggacggagcgtctaattccgcccagtggagaaactttgttgcttgggtgaacagcaataaatcttaccgggcctccaagcagcgcaaccttctgagaaaagacttcgctgcccaagccgctaccgagtttcgggaaagacacctcaccgatacacgctatattgcgcgggagttcaagagaatggtcgaaacccacctgaaactgaataagcctaaccagcgctgcgtggtcgtgagcggccagcttacagcctacctccgggctagatgggggctgatcaaggttcgcgagaatggagacctgcatcacgccctcgatgccgctgtggtcgccgcgtgttcccatgctatggtgaaacggctggccgactattctagacgcggcgagcttcaatacgcccgggggcaccattttgatcccgaaacgggcgagattatcgacatcaacgctctgagaaagctcgatgaccacttccctcagccctggaccgatttccggcgcgaactgctggcctggcttagccctgaccccgcgcagcagctcaaaaatctggcttattacacagatgagagactgaagcaagttaaaccgattcgggtgtcccgcgcccctaccagacggggactcggcgccgctcaccaggaaacaatcagatctgccaagtacctgggggagaaccgcagcaccgtcaagacgccccttgagaaactgaagctcaaagacattcccaatatcgtgggatatgaagatcctcggaaccatcagctgattcaggctatctcccaaagactgaccgagcacggcgacgacgggaagaaagcctttaaggaaccgctttacaagcccggaaataacaaaagcacagcgcctgtggttcgctctgtcaagctgttcaccgtgcagaaatccggcattcccgtgagagggggcatcgccaataacggaaatatggtccgggtggatatctttacaaagaaagagcgctatttcgctgttcctgtgtacgtcagcgacgccgctcggaacgagctccccaacaaggccgtggccagaggcaaggatgggtggattgacatcgatgactctttttccttcctgtttagcctctatcctaatgattgggtttctgtggtcgtgaaaccccatgaagctccgtgcgagggatactatgcgggcctggacattagcaccggggccatccacatttgggctcatgatcgcaacagatccgttggaaagaatggccttatgcggagcatcgggatcaaaacggcccactctgtggaaaagtaccacgtcgacctgctcggcaacctgtaccgcgtggtgcatgagacaagaaaacctctgcgggccggaaagtga

SEQ ID NO: 3839 - RNA, 3207 nt, synthetic construct
  misc_feature 1..3207: note = Cas9 variant
  source 1..3207: mol_type = other RNA
atgcagtacgtgctgggcctcgacatcgggattgccagctgcggatgggctgtcatcaaccaagagaaggaaagaattgaggatctgggcgttcggatcttcgacaaagccgaaaatcccaaggatgggaaatccatggcgacccctcgcagagacgctcggtctacacgcagaacgcttcggcgcaagaaacacagaatgcagcggattaagatcatcctggtgaagcagggactcctgagcaaaaccgagcttgatcatctgtatgaatccgccacagaggtggacgtctggaacctccgcctggatgccctggagagaaagctcaatccgaaagaatttacccgggtgctgattcaccttgctaagcgcagaggcttcaaatctaaccggaaggagacaaccctgagcgaaaatgggcagatcctcgagtccatttctgagaaccaacagatcatgggacagaagaattaccgcacagttggcgaaatgattctgcaggacaaaaagtttgagagccataaaagaaacaaggatggcacctatatcgggacggtgacccggcaacagcttcaggacgaaattcagatgatcttcaatgcccaaagactgtacaaaaacaattatgctacagccgagtttgaaaactcctacctcgagatctgggcgagccagcgcccctatgcctctaaggatcagattgagaaaatgatcggatactgtaccctggaacaaaaggagaagcgggctcctaaagcctcctggagcttccagtactttgtcgctctgcagacaattaataacctcagactgatctctaaggaccgcattgaagaactttccttcgaagagaaaaagcagatcatgaatctggccctcgagaaaagcatcgtgaagtatattgatatccggaagctgctttctgttcccaacgaatttcaattcaactccctgagctactccgcggacaccgtggacattacggtcgagtctagaaaatgcatcgaactcaaggagtatcacagcattaataaagtgtacaagcagatctatgagaaaaacgccctgaatctgctccctaaggattacgacacaatcgcttatggcctgaccatttttaaggatgacaaagatatccttgagtacctgcagaacaagtacgtgaatgccaaagggaagcccatttccaacttcgctaataaaacatatgacgatacctttatccaggccctcctgaaccttaatttcaccaagatgggacatctgagcttcaaggccctcaaaaacattatcccttttctggaggaaggcctgtcttacgacaaggcttgtgagaaagcggggtataatttcaagggaacatcctacacggagaaaaccaagtatctcccggtcattccccaaaacacaaatcctgttgtgcaccgcgccctgagccagacccggaaagtgatcaacgctatcattaagaagtacggctctcccaatgccatccacattgaaacagccagagagcttagcaaaacctttcaggaacgcaaggagatcgattccatgtatcaggacaactctaaaaagaacgaacatgctatttgcaaactgaaggagctcggcaatatcaaccctagcgggatcaatattgtcaagttcaaactgtggaacgaacaagatggacggtgtatgtactccggcaagtacatcgagccccacagactgtttgaggaagggtatacggaggtggaccatattcttccgtacagccgctctctcgacgattcctataataacaaaacactgaccctgggaaccgaaaatcagcggaagggcaacaaaacaccttacgagtatatggggaataccagcatctggaacgacttcgaaacaagagttcagtctaataagaagattacgaaaaagaaacagcaaaagctcctgcttcagcacttttcctacgcccgggagcaggagttcatcgaacgcaacctgaatgataccagatatgcgacaatctacctcagctccctgattcaacagcacctgatcttttctgagagctcccggaaaaagaaggtgcataccgtctctggaattatcacaagccaccttagatcccgctggggcttcaacaaagaccggaaggaaggccatattcaccatgctctcgatgccgtgatcgttgccgtgaccagcgaccacatgatccagagagtcacgaaatactataagctgaaagagctgaatcgcaacctccaggctaagagaatgccctttcctgaaccctgggaggggttccggctggagcttgaagcccgcatttctcccaacacccaacagtacctgaaaggatttagattcaagaattatgctgatgtgaacctctccgagatcaagcctattttcgtcagccggatgccgaaacgctctatcacaggcgaactgcaccaggagaccattagaaagtttatcgggtacaatgagaaaggaaaggtgctgacagccattaaaaccaaacttgaagacatccccttcgatgcgaacggcgactttcctatgtatgggaaggagacggatctctacacatataatgccatcaaagaacggttcctgtcccataagaaagacaagcgcaagagctttcaggagcccctgtacaagcctaccaagtctggcggaattggccccctcatcaaaagcattaagatcattgatacaagaaccatcgttaacccggtgaatcaagggaaaggagtcgtgtacaactccaagatcgctcggaccgacgttttcaaaaaggacgaaaagtattacctgattcctatctatacaattgatcttatgaaaaatatcctgccccagaaggccattacggctggcaaagggtacgaggactggaccacaatcgatcctagctttaccttcctcttttctctgttccccaacgacctgatccagattgtgccttccaagaataaaacaatcaaggcccgcaccacggtcagcaagaaagaggtgcttctcccctccctgacaggatattttaagggcgtgcactctgggaccgcgggcattaccgttgaaacacatgatggaagcgtcatcgccaacgtgggctccaaacagctgctcctgttcgagaagtaccaagtggacgtccttgggcactataccaaaattaaggaagagaaaagaatcggaatggctatttga

SEQ ID NO: 3840 - RNA, 3210 nt, synthetic construct
  misc_feature 1..3210: note = Cas9 variant
  source 1..3210: mol_type = other RNA
atgaagaaacagccccaaagatacatcctgggcctcgacctggggattgccagcgtgggatgggctcttatcctggtcgatggcgccgagaaccctgttgggctcctggactgcggagtgcggaccttcgaacgcgcggaggtgccgaagacaggcgattcccttgctctggccagacggcaggcccgctctgtcagacggctcattcgcagacgggctcaccgcctgctgagactccggcgcctgcttaaaagagaagggatcctgagcgccgctgactttaattccgatggactccccaacctgcctattgacgcctggcagcttcgggtggcgggcctggagcgcaagctcacgaatcaggaatgggccgctgttctgctgcatctcgtgaaacacagaggctatctgtctcaaagaaagagcgagacccagacagagaacaaggaacttgggagactgctcgccggagtcgctgaaaattccaaactgctttctgagagctccgagcagtaccgcacccccgccgagctggcggtgaagctctttgccgaacagagcggccggctgagaaacaaagggggagattatacacatacctttaatcgcctggacctccaaaaggagctgcaccttctgttcgaacggcagtgtgctctcggcaacccttttgcctctgctgagctgcagtccaaagttgatgaacttctgatgacacagagaagcgccctccaaggggaggccgtgctgaagatgctgggaaagtgcaccttcgagccctctgaatacaaagctgcgaagaatacgtattccgccgagcgctttatctggctcaccaaactgaacaatcttcggatcctgtacaacggcgaagacagagctctcgatgagggcgaacgcaagcagctgctggacgagccttataaaaaggccaaacttacatacaagcaggtccggagcattctcaatctgccggagtctgccgtgttcaaggggctgagatacggaaaagattccgacggcctcaaggctgaaaacggggccctgatggagatgaaagcgtatcataagatccgcaccgtgcttgaaaaagctggactgaagggcgagtgggaaaatcggattagaaaccccgagatcctcgaccaaattgggacagcctttagcgtctacaagaccgatgaggacatcaaagccgaactggctgccctgcggcttcctgagaacgttctcgatgctctgctggccggactcaatttcgacaagtttattcagctgtcccttaaagcgctgtctaacatcctccccctgatggaacgcggcatcagatatgatgaggcctgtaaggaggtgtacggcgaccaccgggctctggccgaaagcaaaaatcagatgcttctccctcagattcccgctaacgagatcagaaatccggtggtcctgcgcacgctgacacaagcccggaaggtgattaacgcgatcattagacgctatgggtcccctcagagagttcacatcgaaaccgcccgggagctcggaaagagcttcaaagatcgcaaggaaatcgagaaaagacaggaggaaaatcggaaggagcgcgaaagagctgccgagcattttaaagaactgttcccccggttcacaggcgagcctaagtctggggacattcttaagctgcgcctctaccagcaacagcagggaaaatgcctgtattccggcatccccattgatctggggagacttaacgagaagggctacgtggaaatcgaccacgctctcccctttagccggacctgggatgactctttcaataacaaagtcctggtgctgggaagcgagaatcagaagaaacgcaaccaaaccccttacgaatatctcgacggcgccagagattcccagcggtggagagagtttcaggcccgcgttcaggggtgtcggttcccgtacgctaagaaacaacggattcagacagcgaagctggactctaagacggaacagggatttcttgagcgcaatctgaacgatacccggtatatcgccagattcctctgcggctttatcgagaaaagcctgcatctgcaaggggctggaaagcgccgggtgttcgcctccaatggccagattacagcccttctgagagggctctggggcctgaaaaaggtccgcgaagacaacgatcggcaccacgctctcgacgccatcgtggtcgcgtgtagcaccgtgtctatgcagcagaaaattacaaaggctatgcaaagacgggagaccctggaaacgatcaacacagagaccggagaggttaagacccgcattccccagccttgggatttcttcagacaggaagtgatgatccgggtcttttccgacgctccccgcgaggaacttgccgagaaactgaatagcagacctgaagctctccatgatttcgtgtctcccctgtttgtttcccgggccccgaacagaaagatgacaggccaggggcacctggagaccgtgaaaagcgcgaagcgcctttccgagaatatttctgtcgtgaaaaagcctctgacagctctcaagctgaaagacatcgaaaacatcgtgggataccccgatcgggagcctgccctctatagagccctgcaagaacgccttcaggcttacaaggacgatcccgccaaagccttcgccgagcctttctataagcccgcgaaagacggcgggcagggaagcctggttaaggccgtccggattatcgaaaatacgaagcatggcctcaaagtgagaaacgggattaccgacacaaatggcgatatggtgcgcgctgacgtctaccagaaggccgataaaaagggaaaacggcaatactttatcgtgccggtttatgcttggcaagtggagaagaacgagctgcctaccgtcgactgcaaaggctacgaaattgatgacacatatgagttctgtttttccctgtacaagtatgatatcatcgaaattcagaatcccgacaacatgtctaaggagcttagagtgtactatatcaattgcgatagctccgacgggcgcttctggctggcccaccatgataaaagcgccaaggaacagcagtttagaatttctacccagaaccagcccatcattaaaaagtaccaagttgaccctctcggaaaagagatccggctgtgtaaggctgagaagcgcacggaactcaatggcaaaaagaaaaagtga

SEQ ID NO: 3841 - RNA, 3210 nt, synthetic construct
  misc_feature 1..3210: note = Cas9 variant
  source 1..3210: mol_type = other RNA
atgaactacgacatcggcctgagaattgggatcaccagctgcggatggtccattatcaataaggatctcgagcggattgaagacctgggcgtgcgcgtcttcgagaaagccgaaaaccccgatgggacagcttctgccgcgcctagacgggaggctcgcaagagcagacggaaacaccgcagaaagaaacatcggatcgaacgcatcaagagacttattgttcagcacgacctgctctccaagaaagagctggattctctttatctgagcccgtttaatatcgacgtgtggaacctccgggtggaggccctggaacgcaagctggataatagagagttcgcccgggtcctcattcatctggtgcaacgcagaggatttcagacgatccggaaatccgttgaaattcaggaggagggcaaacttctggaaaacgtgtctgagaatgaaagaatcatgaaggtcaacgggtacaagaccgtgggagagatgttcagcaagcacgaaaaatttacacatcacaagcgcaataaagacggctcctataccagcgttgtgacacggtctctcctgcttaaggagattaaaaccatcttcaactcccagagaatcctgggcaatgtctttagcacacaaaagctcgagtctgattacctgtatatttgggggtcccagcgccccaccctgacgtacgaacagctcatgagcatggtgggaaactgtatctatgagaaaaaggaaaagcgggctcctaaaacctcttgggccttccagtacttttccctgcttcaaaagattaataaactgaaggtgagcgacgataacacactcagaaaactgtccaaggaggaacgcgacatcgtcattgagcttgctttcaagaaaaagaatgtttcttttgtggatatccggaaagccctgaagctcaacgacaacaccaaattcaatcacctgacatacagccatgtggtcgagaccaagaaggtggaaaaagcgacgtttatcgagctgaagggctatcacctcattaaaaagcagctgaaagacagaaacgttgaacttacacaggagctgcagcccaaggattacgacgccatcgctgccgcttccaccttcttcaagaatgatattgaatttcgcgactatctccggaaccaatacctggatagcaatgggaaaagaaagtctaacatcgccaataaagtgttcgaggacaaggtcattgcggccgtgtttgagcttaacttctccaaagtttgccatctgagctttaagtctctctataaactgatccctcacctggaaaagggactcgattacaaggaggctatcctgtgtgccggctataatttccgcgacgaaaacaaacgggataagaaactttttctgcccgtgattcagcaggagacaaatcctgtcgtgcacagagctctcacccaagcccggaaggtcatcaacgccattatccgcgagtacgggagcccgaataccattagattcgtggttgctaacgacctggcgaaaacatacaagcagcggaaggaactggagtccacgcttaaaaagaatagagccgaaaacgagaaaatcaagaccaaactcctgtctatgggaattatcaaccccacaggcatggatatcgtgaagtataagctgtggtacgaacagagcggcatttgcctctataccgggcgccagatggagctgtccagcctttttaaacctggatactctatcgtcaatcatattatcccctataaccggtccttcgacgacacataccacaatagagtgctgaccctcacggagacaaagtatgaaaaaggcaacaagattccttttgagtacttcggggctgaagagacctgttggaatgaatacgagaaacgcgttagcacctctaagaagatccatgataaaaagagagagaaactgctgatccggaactttgacattgaatatgagaatgaaatgatctccaacaatgtgttcgatacacactacattggaagctatttcgagaagtacatcgacgaacatcttcaatttaaaaagtccaccaaaaagcagaaggtcttctctattcacggcaacatggtggcccacctccatagccgctgggggtttaataaaaactccagagagatctatctgaatcacgccgtggatgctgccatcgttgcggtcctgacagaccagctcattcggaacatcgctgattactatcgcagagacaatattctggagcagaagggatctcttaaattccccgaaccgtggaagtcctttagcatcgagctggaagcccggattagccctcaagtgcgcgatctcatcaaaaagctgaacctggactcttaccttgatgtggacatcctccatattaagcccgtcttcatctccaaaaagcctagacggaaagtgaacggcgaggcccacaagagcacgattcgctctctgatcggcattaatgagatcgggaaaaccgttacatgcattaagaccagactggaagatatcccctttgacgagaacggagacttccccatgtacggcaaggatacagacaaatatacctacacggctatcaaggaacggtatctcgagtttaataaagataaggaaaaagccttctccacccctctgtacaaacttaagagaaacggggagccgggaaatcagattaagagcgtgaagatcattgacacacgcaacatcgtcaataaagtgaaccagggcaaggggattgcttataattctaacatcatccgggttgatgtgtttagcagagaccagaaatactatgtcgtgcccatttacctgcgcgatttcatcaagggctccctccctaataagattatcaccgccgcgaaaggatttatgcaatggcccgagacagacaacagctacaccttcctgttctctatttttcctaatgatctgatcaaggttgtgcccaaagaaggcaagttcatcaaagccaagaacgagaataaagaaaacattaaccttacggagatcctcgggtattttaagggactggactccagcacaggcgctttcaccctggaatcccacgatgggtctctcctggcccggggaattggcacaaagaatcttctgctcatcgagaaataccaggtcgacgtgctggggagatataacaaggtgggcaatgaggaacgccaggatattaaaatccagcaaaactga

SEQ ID NO: 3842 - RNA, 3210 nt, synthetic construct
  misc_feature 1..3210: note = Cas9 variant
  source 1..3210: mol_type = other RNA
atgaactacgacatcggcctgagaattgggatcaccagctgcggatggtccattatcaataaggatctcgagcggattgaagacctgggcgtgcgcgtcttcgagaaagccgaaaaccccgatgggacagcttctgccgcgcctagacgggaggctcgcaagagcagacggaaacaccgcagaaagaaacatcggatcgaacgcatcaagagacttattgttcagcacgacctgctctccaagaaagagctggattctctttatctgagcccgtttaatatcgacgtgtggaacctccaagtggaggccctggaacggaagctggataatcgcgagttcgccagagtcctcattcatctggtgcagcggcgcggatttcagacgatcagaaaatccgttgaaattcaggaggagggcaaacttctggaaaacgtgtctgagaatgaacggatcatgaaggtcaacgggtacaagaccgtgggagagatgttcagcaagcacgaaaaatttacacatcacaagagaaataaagacggctcctataccagcgttgtgacacgctctctcctgcttaaggagattaaaaccatcttcaactcccaacggatcctgggcaatgtctttagcacacagaagctcgagtctgattacctgtatatttgggggtcccagagacccaccctgacgtacgaacagctcatgagcatggtgggaaactgtatctatgagaaaaaggaaaagcgcgctcctaaaacctcttgggccttccaatacttttccctgcttcagaagattaataaactgaaggtgagcgacgataacacactccggaaactgtccaaggaggaaagagacatcgtcattgagcttgctttcaagaaaaagaatgtttcttttgtggatatccgcaaagccctgaagctcaacgacaacaccaaattcaatcacctgacatacagccatgtggtcgagaccaagaaggtggaaaaagcgacgtttatcgagctgaagggctatcacctcattaaaaagcagctgaaagaccggaacgttgaacttacacaggagctgcaacccaaggattacgacgccatcgctgccgcttccaccttcttcaagaatgatattgaatttagagactatctccgcaaccagtacctggatagcaatgggaaacggaagtctaacatcgccaataaagtgttcgaggacaaggtcattgcggccgtgtttgagcttaacttctccaaagtttgccatctgagctttaagtctctctataaactgatccctcacctggaaaagggactcgattacaaggaggctatcctgtgtgccggctataatttcagagacgaaaacaaacgcgataagaaactttttctgcccgtgattcagcaagagacaaatcctgtcgtgcaccgggctctcacccaggccagaaaggtcatcaacgccattatccgggagtacgggagcccgaataccattcgcttcgtggttgctaacgacctggcgaaaacatacaagcagagaaaggaactggagtccacgcttaaaaagaatcgggccgaaaacgagaaaatcaagaccaaactcctgtctatgggaattatcaaccccacaggcatggatatcgtgaagtataagctgtggtacgaacagagcggcatttgcctctataccgggagacaaatggagctgtccagcctttttaaacctggatactctatcgtcaatcatattatcccctataaccgctccttcgacgacacataccacaatcgggtgctgaccctcacggagacaaagtatgaaaaaggcaacaagattccttttgagtacttcggggctgaagagacctgttggaatgaatacgagaaaagagttagcacctctaagaagatccatgataaaaagcgcgagaaactgctgatcagaaactttgacattgaatatgagaatgaaatgatctccaacaatgtgttcgatacacactacattggaagctatttcgagaagtacatcgacgaacatcttcagtttaaaaagtccaccaaaaagcagaaggtcttctctattcacggcaacatggtggcccacctccatagccggtgggggtttaataaaaactcccgcgagatctatctgaatcacgccgtggatgctgccatcgttgcggtcctgacagaccagctcattagaaacatcgctgattactatcggcgcgacaatattctggagcaaaagggatctcttaaattccccgaaccgtggaagtcctttagcatcgagctggaagccagaattagccctcaggtgcgggatctcatcaaaaagctgaacctggactcttaccttgatgtggacatcctccatattaagcccgtcttcatctccaaaaagcctcgcagaaaagtgaacggcgaggcccacaagagcacgattcggtctctgatcggcattaatgagatcgggaaaaccgttacatgcattaagacccgcctggaagatatcccctttgacgagaacggagacttccccatgtacggcaaggatacagacaaatatacctacacggctatcaaggaaagatatctcgagtttaataaagataaggaaaaagccttctccacccctctgtacaaacttaagcggaacggggagccgggaaatcagattaagagcgtgaagatcattgacacaagaaacatcgtcaataaagtgaaccagggcaaggggattgcttataattctaacatcatccgcgttgatgtgtttagccgggaccaaaaatactatgtcgtgcccatttacctgagagatttcatcaagggctccctccctaataagattatcaccgccgcgaaaggatttatgcagtggcccgagacagacaacagctacaccttcctgttctctatttttcctaatgatctgatcaaggttgtgcccaaagaaggcaagttcatcaaagccaagaacgagaataaagaaaacattaaccttacggagatcctcgggtattttaagggactggactccagcacaggcgctttcaccctggaatcccacgatgggtctctcctggcccgcggaattggcacaaagaatcttctgctcatcgagaaataccaggtcgacgtgctggggcggtataacaaggtgggcaatgaggaaagacaggatattaaaatccaacagaactga

SEQ ID NO: 3843 - RNA, 3213 nt, synthetic construct
  misc_feature 1..3213: note = Cas9 variant
  source 1..3213: mol_type = other RNA
atggccaccagactgggcctcgacatcgggacaaacagcattggatggtgcctgtacgatggcgactccatccgggatattggggtgcgcatcttccttgacggaagagagccctctaagctgacggtcagcggctccgggacccctctcgctgttaaacggcgcgatgccagaggagcgcggcgcagacgggaccgctatattggcagacggtctgctatgctgcgcgaacttagaaagcacggcctgctcccggccgatcccaaacaggccaaggtgctggagacacaagacccttacgctctgcgggtgcgcgccctcgatgaaaaactggagccccatcagatcgggagagctctttttcacctgaatcagcggagaggattcaagagcaaccgcaaggccgaacgggcgtccaaagccggcgaggacgggaagatcgctaccgccacaaaactcctggatgaggaaatgcagagacttggagctcgcaccctgggcgagtttctcgtcaagcgggactctgagttcgatggggaggccggaaaaagagtgcgcatgcgggcggacagcaaggcctatgacttttaccctgatagacgccatgttctggacgagttccgggctatttggaatgcccaaaaggtgtggcaccccgaactgctcacagagcaggcttggaacgatatctttagagtcattgaatatcagcgcgagctgaaacctcaggtggttggccattgtaccttcgccggcatcaatggggtgccggccgacgaaaagcggcttcccaaagctcaccctctgtttcaacagagacggctctacgaggaggtcaaccagctgaaggtggtggcgcccggagaagccggccgccctcttacgagagatgagcgggacgctctgattctcaaactgcaggataagaaatccgtcagcttcgaaaccctggggaagacactcaagctgaaagacggagagagatttaataaggaatctgagaaccgcaaagcccttgatggcgacgaggttcgggccgctctgtccgggaagaaactcttcggaaccagatggtttcacttcagcgccgaagaacaatggatgatcattgaacgcctgcttgaggaagaggattctgagacactgctcacctggctgaagatcggctatagactggacgacgaagcggctctcgccgtggccaatgctaagctgcccgagggccatgggcggttcggactttccgccacgacagctctgctcaaagaactgaaggccgatgtgtgcacctacgcggaggccgctaaacgcgccggctttcaccatagcgacttcagaacaggggaggtctttgatcagctgccgtactatggagaaatccttgctcgggagattgcccctggcaagcccgaatacggggacgagaacgaacgcagattcggcaaaatcaccaatcctaccgtgcacattggactcaaccagctgacaaagctggttaatgcgatcattcggctccacggcaagcccgattatatctttgtggagctggcccgcgagcttaaactgaacgaaaaggagaaaatcgcttacaatagacaactcaaggaaaacacggacgccgctcgggatcgcggggccaaactgggaaccatgggcgtcagagacacagggcggaacagactgattcttcgcctctggaccgagctgaatcccggagatgccctgaaccggagatgtcctttctgcggcgaacagatctctcagcgcatgattcagaatggggaggtggagatcgaacatattatcccgtattcccaatgttttgacgatggcatcggaaacaaggttctcagccacgtgcggtgcaatagacagaagggcgaccagacaccctgggagcgctgggggcatgatcctgaccggtggtccattatccaggaacaagtcgctcatctgcacagatctaaacagtggcgcttcggacccgacgcgcgggatagatacgccgctgaggaagacagctttcttcctcggcagctgattgatacccagtatctcacgcgcatcgccgccaagtacctggcttgtctgtaccccgagagaggcgagcggcacgtgttcgccgtccacgggggaatgacagcgatgcttcgcagactctgggacctgaactccattctgctcgatcataattgggtggaaaacctgaatagcaacgctccgaaaaatcggcttgaccacagacatcacgccatcgatgccgctgttgtgggcattatgacccctgggctgatcgccgagatcgcgaaggctgccgcccgcgctgaaaaacaaaacctcgaccggctgtttgaggagctgcccatgccttgggcccagcaccccaatgatagacgcttccgggacgaacttagagagaagattctcgctgccaccgtctctcataaagcggatcacggccgccagggaaagcctgaacggggcagagacatcacagccgggaagctgcataacgataccgcttatggatttacaggcctgacgtccgacaccgggctccccgtggttgtgcaccgcgtcccgctgacaagccttacccctaaagacattgccgatcccgacagaatccccgatacaaccctgcggggatctctctggcaggctacgcgcgacctgagcggcaaggagttcgaaaaagccctgcttgatttctccagaacccatgcccaatttaaggggattcggcgcgtgagagtgcgggagggcctgacactcatccctatcagaaatcacgctggaaaaccgtacaagggctatctgggggactctaacgcgcgctacaacgtttggcagatgcccgatggacggtgggtccaccaggtgattagcaccttcgacctccatcaacctggctttatcgagcagagaccccaccctgccgctaagaaagtgctgtcccttcgccagaatgatctgattgccatcgaacgggacggggccctcagacagattatgcgggtccaaaagtatggacagaacggccagatcttcctgatcgagcataatgaagctggcaacatggccgagcgcaataaaaacacagatgacccctttaagttctacgggcctggagcgagcgctctgagaaatatgaaagcccgccaggtgcggattgacgaacttggcagaatctttgatcccgggccgcggtga

SEQ ID NO: 3844 - RNA, 3213 nt, synthetic construct
  misc_feature 1..3213: note = Cas9 variant
  source 1..3213: mol_type = other RNA
atggccaaggacttcgagtacatcctgggcctcgatctgggggaaaccagcattggatggtccgtggtcagacttaacgagggcgttcccgaacacctggagcggctcggggtgcgcatctgctctgacggaagagatgctcagagccatgaacctctgtccgtggcccggcgcattgcgagaggccttcggcgcagacgggaccgctatatccacagacggattcgcctgacagatgtcctcgtgaaatacgggctgatgccggaggacatcaaggagagaaagaagctgcaagctctcaatccctatcggctgcgctctgaagcccttgatagaaaactggagccttacgaactcggacgggttctgtttcatatcaaccagagacgcggcttcaagagcaatatgaagacggaccggaaagattccgagtctggcgccatgaagcaggctattcttaaaaccagagccaagatggaggctagcggggcccgcacactgggagaatttctctatttcctgaacaaagacaagacctccacacaggagtacgtgcccgtccggatgagaagccactctgaaaagaataaaaccgtgtatgagatgtaccctgatcgcgcgatgtacgaagacgaggttcataagatctttgagcaacaggaactgtcccccgaggcccagacagaaattttcaacaccatctttttccagcggcctctcaaaccggtggagctgggcttttgtgagttcgaagatggggagagacgcgcttatacggccagcgtcgtgtttcaaaagttccgggcccttcagcagattaatcagatctacgtgcaagacgactatgaaagacgccccctgaccaaagaggaaaaggatattctcaaacactttctgcttgaggacttctctgccctggataagaacggactcctgacatgggcgaaggtccggaccctgctcaaactgcagaagaaaaagttcaatcttgaatccgagagacggaaaggcctgaacgccgacgttacaagctggaagctctctaatgctgcctgctttgggcgcgagtggttctcctttagcgatgctaagaaagaagagatcgtggccctgatcaccggagccgaaaaggaggaggaacttattgctgagctgaaaacgaagtacggcctctccgacgaaagagcgaaaaacacagccaatgtgtctctgcctgatggcgtcgctagcctgtccgccaaggccatgaagaaactcatccccttcctggaggaagggatgctttatgacgatgctgtgaagcaggccggatacgtttttagctcctctttcaaaggcgtgctgcctgagaagtatgagacctttattgaacccgagagcggggaatgtttcgacgagctcccgtactacggacaagtcctgcggagatatgtgctgggcggggttccttctgaagagaacaaactttttcccgagaagtactatggaaagatcaataaccctacagtgcacattgtcctcaaccagctgcgcaaactgatcaatagcctcgtggcgaagtacggccatccccggaaaatcgtcgtggaaatggctagagatctgaaactttccaaaaagcagaaagacgccattgccaaggagcaggctctgaacgaacgcgagaataagagaatcggcgccgaactcgagcggctggacattcgcaacaattatgataacagaatgaaatacaagctgtgggaggacctttctaccgatcccaccaaacggagctgccctttctgtgggaagcaaatctcccagcaggacatttttagcccggagttcgaaatcgaacacctcatccccttttctcgctccttcatggatggaagaagcaataaagttctgtcttgccggcgctgtaacagagagaagggcaataagacacctttcgaggcttttgggaacgactccacgcggtggaatgccattatgggacgcgtggaaagcctgcccgagaacaaaagatggaagttcgcgtccgatgccatgtctcggtttgaaagagacggcgatctcctggctcgcatgatgaccgacacacagtatatggcccggatcgctagacgctacctttgctgtgccgcgaatcctaaccaagtctacgggattcccggccagctgaccgccaaactccgggagcattggggactgaatagcatcctgtccgatcagaaggaaaaagacagatctgatcaccgccaccatgctattgacgccttcgtggttgcttgcacagaccggggcacccttcagaagtatagcacggagagacgcgattacgccaagccggagatgccttccgaaaaagctccccacatcccttttgctgacttccggctcagcgatattaagagagtgtttgacgagatcatcgtctctcataaacccgatcgggggaacgcgcgcgccgctattctgaagggaggcacagtggccaaactgcacgaagagacctattacgggatgggaggcgaagggtccaagaagggcacctggaaactcatccaacggattcctgtgagcgagatcaagaaagcctctgacctggattgtcttattgaccagaagggaacagctaaccccctgagagttctcctggtcggcgcctccgagagcgaacaggagcagatcatcgcgtcttatttcgctcgcagagggacccataaagtgcggacatacagagaacgcaataaggatgtgattctgccgtttaaagacaaggatggaaaactttatcggtacgccgtctacggcagcaacgcctatgctgagatctactgccctgacagagggaagaatgccggaaagtggcaagtggaaattatccccaactattgcgcgcaccagaaaggcttcattcccaagtggcgccacacggatgctcatgccaaactcatcatgcggctgtacagaaatgacatggttgcctatgagaaggaggggaagaccgtgatcgctcgcgtcaaaaagatgggcggaaacggcgtgattgtttttcggaatcacctgatcgccaaagaagagggggacagactctcctggcaggctgtggtcagcggaatgcaatctgccaacctgcgcaagatttacgtggatgttcttggcagagtgatcgaccctaaacggccgatgacacagaatgaaaccgatgggcaggacaactga

SEQ ID NO: 3845 - RNA, 3213 nt, synthetic construct
  misc_feature 1..3213: note = Cas9 variant
  source 1..3213: mol_type = other RNA
atgagccacttcagactgaagcagctcaactacatcctgggccttgacctggggattgcctccgtgggatgggctgtcgttgagatcgataccgaagagaatcccacacggctcattgacgtgggcgtgcgcacgtttgaaagagccgaggtccctaaaaccggggattctctggcggctgcccggcgccaagccagaagcgctcggcgccttatcagacggcgcacacatagactgctccgggcccgcagactgctgaagcgggaaggcattctccacgctgacgatctgaacgccgagggacttgtgaaagagctgccgaataccccctggcagctccgcgttgacgggctggatagaaaacttatgcctaaagaatgggcggccgtgctgctccatctggtcaagcaccggggatatctgtcccagagaaagaacgagtctgaaggcgctgacaaagagctcggccgcctgcttgccggggtgcatgagaatcaccaggctctgcaaagctccgaataccggacacccgccgagctcgcggttaagaaattccaggcccagtctggacacatcagaaaccagcgcggcgattatacccatacatttgaccggaaggatctgcaacaggaacttcaccagctgttcgctgcccagcaaaaatacgggaatccttttgtgagcgacggactcaagcagggcatcgagaccctgctgatgcagcaaagacccgctctctccggggatgccgtccagaagatgctgggacgctgcacgttcgaaaccgaggagtttaaagccgctaagcatacatatagcgcggaacggttcatttggcttaccaaactgaacaatctcagaatccaggagaacggcaatgaacgctgtctgacagcccaggagcggggccaaattatcgaccttccttacaagaaagctaagctgacctatgcccaggtgagaaaagaactctctctgccggagaacgcctttttcaaggggctgcgctacggaaaggagaatgctgaaacggccgcgctcatggagatgaaggcttaccacgccattcggaaggccctggaaaaagctggccttaagacagagtggcaggggctggcctgcaaacccgaactcctggacgctatcggaaccgtgttttccctgtataagacagatgaggacattagcaccagacttcagggccaactctctgaggatgtcatcaacgccctgctggcggggctcaatttcgacaagtttatccagctgtcccttaaagccctgagcaagattctccctctgatggaacagggacagcggtacgatgaggctcacgccgctctgtatgttcgctctacaccccaacctcagagacttctcccccagatcaccgccgacgaaatttgtaacccggtggtgctgcggacgctgtcccaggcgagaaaagtcatcaacgccattgtgcgccggtacggcagccctgctagaatccatatcgagaccggccgcgaggttgggaagtccttcaaagatagacaagaaattcagaagcggcaggaggacaatcacaaggaacgcaaacaagccgctgagaagttcctcgaatattttcccaacttcgtgggacagcctaaagccaaggatatcctgaaacttagactgtaccagcatcagcacggccaatgcctctattctgggaagacactggacatttgtcggctgaatgagaagggatacgccgagatcgatcatgcgcttccctttagccgcacctgggacgactccttcaacaataaagtcctcgtgctggctggcgaaaaccagaataaggggaaccagacaccctacgagtggctgggcggagccagcaattctcctagatggcaggaatttgttgctcgggtgggctccagccgcttccaccactctaaaaagcaacggattctcctgcggcagcttgatgaggaagggtttaaagagcgcaacctgaatgacaccagatatgtcgcccggttcctctgcaagtttatcgaggaaaacatgctgctgcttggaagaggcaaacgccgggtgttcgccagcaatgggcagatcacgtcctttctcagatctcgctggggactgcggaaggtcagagaggaaaacgatcgccatcacgctctggacgccgtggttgtggcgtgtagcacagtcgctattcagcaacggatcacctacttcgtgagacagcgcgagatgaatatttttgatggcgaactcatcgacaaggagacctccgaggttagccggccgtatttcccccagccttgggatttctttagacaagaagtgatgatgcgggtcttcgggaaacccgacggcgatccttcttttcccgaggccgacacaaaggaaaccctgtgcacacttctggagacgcgcctctccagcagaccgcaggccgtgcatgagtacgtgacccctctgttcgtttctcgggctcccacacgcaaaatgtccggacagggccacaaggaaaccgtcaaaagcgccaagctgcttcacgaggggaagtccgtgctgagagtgcctctcacacagctgaaacccaacctcctggaaaagatggtcaaccgggatagagagcctcaactttatgaagcgctgaaagagcgcctcgctgcctacggaaatgaccccgccaaggcttttgccaccgagttccggaaaaagggcgggcagctggtgaaggctgttagagtggaagatacgcagaaatctggagtcctgcttcataagggcaccggggtggccgacaacgcgacaatggttcgcgtggacgtctttgagaaaagcggcaagtattacctggtgccgatttactcctggcaggttgcccaaggaatcctccctaataaagctgtgattcagggcaaggatgaaaagaactgggacgagatggatgaaacctatacattcaaattttctatgtaccccaatgacctggtcgagatcaacaccgggaagcagagactcttcggatattacatcggcctggatagagccacgggggctattagcatccgcgagcacgaccttgataattttaaaggaaagaacggcatttatcgggtgggggtgaaaacagccatctccttcaagaaataccagaccgacgaactgggcaaggtcgttgtgccctgtagacctaagaaacgcctcccggtgagatga

SEQ ID NO: 3846 - RNA, 3216 nt, synthetic construct
  misc_feature 1..3216: note = Cas9 variant
  source 1..3216: mol_type = other RNA
atgagactgggcctcgacatcgggaccaacagcattggatggtggctgtaccagacagatgacggcacgatcaccgatgtgcttgacgggggagtccggattttctccgatggccgcgacccccaatctaaggagagcctggccgttgatagacgggtggctcgcgcccagagacggcgcagagaccggtatctccgcagaaaagcggctctgatgaagcggatggccggggccggacttatgcctacagatcaggctcacgccaaaaagctggaatccctcgacccgtacgctctgcgcgccgagggcctggattgcgaactccccctgacccatcttggcagagcgctgtttcacctcaatcagcggcgcgggttcaaatctaacagaaagacagaccggggagataatgagagcggcaagatcaaagacgccaccgctagactggactgggccatgcgcgatgctaaggcccggacatatggggaatttcttcataccagacaacagaaagcggacgatcctaagcgcatgcccacggtgcggaccagactgacagtcgcccgccgggacaacgctgagaaagaggaagccggatacgatttctatcctgacagacgccacctctccgaggaatttgatgctctgtgggccgcccaggctgactaccatgaggcgctgtctgatgacctccgggatcagattaagaccatcatcttccaccaaagacccctgaagacacctgaggtgggcctttgtctgtttaccgacgaacgccggattccgagcgcccaccccctcaatcagagacggatcctgcttgagacggttaacgctctgcgcattgtggccagaggggaagccgctcggagactcacactggaggaacgcgaccagatcgtccatgccctggataataaaaaccacaccaagacactctccggaatggcgatgaaactgaaggctcttggcaaagtgattcggctgagaagcgaccagaccttcaccctcgagacagccaatcgcgatgccatcgcttgcgacctggttagagcctctctttcccatcctgatcggatgggcggggtgtggacgaccctggacgagggagctcaatgggaagtcgtgcagcgcattagagccgtgcagagcgattctgagtttgacgcgctcgtcgtttggctggaacaaaaccacggcctggataatgcccacgctcaggccacagctaacgcgcccctccctgaggggtatggacggatgggcctgatggccacccgcagaatccttgccgctctgcagtccgacgtgatgccctacagcgatgccgtggctgcctgtgggtggtctcattccggaggcccgacaggcgaagtcctcgagaagctgccttactatgggaaaatcctggaccggcacgtgattcccggaacctacgatgagaataacgaagacgttaagcgctatggcagaatcacgaatcctacagtgcatattgggcttaaccagatccggcgcctcgtcaacagaattatctgcatccacggaaagcccgacgagattgtggttgaactggcccgggatctgaaaaatagcgaggaccaaaagagagaaatccagaaaattatcaagaaaaacaccgatgctgcgattaagcgcggcgagaagctcatcaatgagctggggcagaaagacaccggcgccaaccggcttgtgctgagactctgggaagatctgggacatgacgtcatgacacgcaattgtccctactccggcaagcggatctctgctgggatgctgttcgatggaagctgcgacgtggatcacattcttccttattccagaaccctcgacgatggcatcgccaacaaaacactgtgtctgaaggaggccaatcgccagaaaagcaacaatacgccgtgggaagtctggggagagaccgagcaatgggacacaattgctgccaacctcaagaatctgcccgataacaaggcgtggcggtttgcttctgacgccatgcagagattcgaaggggagaatgacttttccgcccgcgctcttaaagatacccagtacctgagccggatcgccagagcgtatctcgacgctctgtacgatggcggggacggcaactctcacgtgtgggttgtgcctggacggctgacagaaatgcttcgcagacattggggcctcaatgggctggaggccctgaccgatagcgacgaaaacacggtcaaggccaaaaaccggatggatcaccgccatcacgctattgacgccgctgtggttgccgcgaccgatagaggactcatccagcggatttccaagatcgccaaaagagacgagcaagctggcgccgaggaagtggctcgctctgtcagccctccctgggatgggttccgggacgacatcgccgcccagctgtccagaattatcgtgagccaccgcgctgatcatggacggattgactctcaggcgaagcagcaaggcgaggatgccacagctgggcagcttcacatggacaccgcctacggcgtggttgatgccggaagagtcgtgtcccgcaagcccctgctcagcctgtctgaatccgacatcaaaaagattcgggatccggacctgcagagacatcttacacgcgtgaccaaaggcctcgataagaaagagttcgaacacgctctgagcgactttgccaatgcgagaaagctgcctgatcaatccgagaacccctatttcgggatgcggcgcgtcagactcatcgacgctctgcaggattctgcccgggtgagcgttcgcgacagagacggacatatctacaaagcctataaggctggctccaatcactgctacgaggtgtggcggcttcctgatgggaagattaaaccctgggccatctctacgtttgaagcgcaccagacaggaaccgagagcaagcctcatcccgctgccaaaagactgctccgcgtcttcaagcgggacatggtggccattgaaagagatggcgagacactgatgtgttatgttcagaaaatggacatcgctaacgggctgtttcttgtgccgcacaccgaaggcaatgccgatgctcgcaaccgggacaaggatgactccttcaagtttattcaaatgagcgccgtctctctgatcagagcgaaaatccggcgcattcatgtggatgagatgggaagactccgggaccagggccctccccgctga

SEQ ID NO: 3847 - RNA, 3216 nt, synthetic construct
  misc_feature 1..3216: note = Cas9 variant
  source 1..3216: mol_type = other RNA
atgagatacaccatcggcctggacattgggatcgccagcgtgggatgggctgtcattaacgaggataagtcccggatcgaagacctcggcgttcgcgtgttcaaaaaggccgaggaacccgatgggaaatctctgaatcttgcgagacgggaggctcgcggaagcagacggcgcattagacggcgcgccacaagaatgcagaaggtgaaagaactgctcgtcaagtataacctggtgtccgagaaggagcttgaaacgctgtacatcatcaccgagacaacccctgacgtttatgaactccgggccaaaggcctggatcgcctgctctctagacaagagtttgctcgggtgctgacaaatattgccaagcgcagagggtacaaaagcaaccggaagatcgacgaggaagataaagaggtcggaaaactttccaagggcaccattgaaaataaaagaatcctgcaggagaagggctatcgcacaattggggaaatgttctacaaagacgagaagtttgagtataacaaacggaataaggctggagaatacaactctaccgtgctcagaagcatgctgatcgatgaggttcacacgcttttcgaaatgcagcgcaaatttaagtccgagttcgccaatgaagagtttgagaaggaatacgtggaggtcatgacctatcagaaaccgtacattacacccgaactgctcgagaagatgctgggcaaatgcaccttcgaaaagggggagcctcgggcgcccaaaaacagctatacatttgagagattcatgctgctccaaaaggtgaataacctgaatatctacatcaacggagaaaaggtggagattcctcaggaaaagaagaaagagatcattgagcttgcctataagcagtctgaaatcaaatacacccagctgcgcaagaagctcgagctgcccattgaagctcggtttgccgaccttaattatcaaatcaaaagaacggaggatgaatccgaggaggctctggtcaagaaaatcgaagacaagaaattcgttaagctcgagggctggcataagattcgcctggccctgaaagaaaacaaggataaatttgagaagatcgagaaaaaccctgaactccagaatattatcgcggacgccctggtgcggaacaagacagacgagaccattaaaaattaccttgaaaagagcgatatcgacgaggaaatcattaacgctatcctgaatattaacttcacaaagttcgggcacctctcttacaaagccatgaataagatcattccggagctggaaaaaggacttacctatgataaggcttgtgagaacgtgggctacgagtttaaaggcagaaagaatgaactgcagtataagctgccccctgtcaccgagctcgaagacgagatcctgaactccgtggttctccgcgccgtgagccagacacggaaagtcattaatgccatcatcgataagtacgggtctcccacggctatttatatcgagaccgcgagagaactgtccaaaccttacgacgagcggatgaagattgaaaaacgccaaaaggagaacgccgctaataacgatcagatcaaggaatatattaaagagacattcggatttgaccccaagccgttcgatatcgtgaaaatgaaactttggagagagcagaatggcaaatgcgcctacagctccaagcctatccccgccgaacggctgtacgaggaaaactttgttcaagtggaccatattatccctttctctagatgttttgatgacagctatcagaacaaggtcctcgtgctgaccgacgagaatcagaaaaagaaagaacgcacacccttcgagtactttggggaggataaggaacggtggcaccagttcgaggaatttgtcaacctgacctataaattcaatacgagaaagaaagagaaccttctcattaagaattttaacgaagagaagtccaaagagtggatccaacgcaatattaacgacacaaagtacatcagcaaattcatgtataattacatcgctaacaatctgaagttcgccgattctgaatccaaaagaaaggtgtataacattaatggacaggcgaccagcatcctgcggcattactggggcctcaagaaagaccgcgaggaatctgataagcaccacgctcaggacgccgttattatcgcctgcgctaccaacaaaaatattaagaaagtgagcgattactccagacggaagctgctttataagaacaacgagatcatcgacgaggaaacaggggagattatcgataaaaagtacaatattgacatctctattaaagaaccctggcctaagtttcgcgaggaagtcgaggccagaatggaggatgctgacaacaatggacagctgtatgccctcatcaacggcaatttcaccaactacgatgacgtggacattacacatatcaaaccgatctttacgagccggatgcccgaacgcaagattaccggcagagcgcacaaggatacaatgcggtcccaaaaattcatccagcaggggcagaattttaccgttgtgaagaaacctctgaaggccattagcaaacaagagatcgaaggaattatcaacaatcccgacttcaagaacctgtatctttctgataagaaactctacgacgatatctatcagaagatgaaagaggctgactttaaggccgaaaaggctttcgccaatgagtaccgcaagtactccaaaaacggcaatagccctattgtcagatctatcaaggtggcgtccgccggggctacaggagtgcagctgaagaacggcgccattgctgagaatgccaacatggttcgggtcgatgtgtttgaaaaagacaacaagaattatctggtgcccatctacgtcagcgatttcgccaaaaacgagctcccgaataaggctatttgtgcgaacaaagacgaaaaggagtggatcgaaatgaccgagaagtataaatttaagttctccctgtaccctaatgatcttgtgaaaatcaagcgcaaaaacgagaaggaattttatgcctactattgctctacgcatagagggaccggcaatattaacctgctcctggttaatggagaggctcggaaggacggcgtggggatcaaaaacacagaaattttcgagaagtaccaggtcgatgtgctgggaaatatcagcaaagttaacaaggagaaaagagaaggcgtgaagtga

SEQ ID NO: 3848 - RNA, 3216 nt, synthetic construct
  misc_feature 1..3216: note = Cas9 variant
  source 1..3216: mol_type = other RNA
atggactacagaatcggcctggatattgggaccaacagcatcggatggtccattatcgagctcacaacggtgcagtctaagctggacggcaaatatcggcttaaggccgtcgggctgattgatgctggagttcgcatgttcgacagagccgaagtgcccaaaaccggcgcgagcctcgctctgcctcggcgccttgccagatcctctcggcgcagactgacacggcgcagcgccagaaagaaagctatccggaatctcctggtgaaggaggatatcctgaaccaaattgaactcgaccacctgtaccgcacctccgagcttgtcgatatctggcagattagagtggaagggctggagcggcgcctcggaagacaggagtgggcccggctgcttatccatctgggccagaagagaggctatcgctctacacggaaagctgaagagggggccgacaccgaaggcagagcggttctcagctccattaaggagaatcaagagacactgaaacagtaccgcaccgtgggagaaatgtgggccacggatgacaagtttaaagggcgggtcagaaacagcaccaatgagttcatctttaacgtgtctcgcgataatctggaagaggaaattcggttcctctttcagcagcaaagagagctgggatccatgtatgctagcaagctgctggaggaatcttacatggaggtttggggccaccagctcccgttcgcctccggggaaagcatcctgaagaacgtgggaacatgctctctttatgagaaagaaaagcgcgctgccaaagcgacctacacatttcagtacttcatggccctggacaagctcaataacgtccggatcctgccctccatgagaaccctgagcgaggaggaacgcggcctcgctctgaaagccatgtttgagcgggataaacttcctaaaaatccccctaagttcacgtattcccatctgagaaaggctattaaactcgaagaggacgaaacatttcagaccatctcttacgacgtggagaagacactggccaccaacgagagcgccgtgttcgtcaatcttgctgcgtattaccaaattaaaaaggtttgtgatgaacacaacgagaattatgactacgtggattataacaccatcggccatgccctgacagtgtacaaaacggacgaagatattaacaagtacctcgcttccaagaataacatcgccaaacgggtctatgccaatgactttatcgatagcgtgctgaagcactcttacaccacattcgggcacctgtccctcaaagctctgagccgcattatcccccttatggaggagggagaagttttcgccaaggcgaaagagaaggctggctttaaggaagagtcttatctggaaattaaaagcaagctcctgaccaacatccctgacgccattaaaaatccggtggtcatgagatccctgacacaggcccggaaggtgatcaacgctatcattaaaagaatgggggagcagcccgcctctatccaaattgagcttgctcgcgaactcagcaaggatgtttccgagcggaagaaaatcaccaatggattcgccgaaaacagaagccgcaatcagtttgcgattaagacgctggaggaaaaccatatcacaaatattagaggccaggacatcgtgaaattcaagctgtggcaggagcaagggggacggtgcgcctactctctcaaacctatcaagctggaggaacttatttcctttctgaaaaaggagcgcagatatgaacacaacctcgatgtcgaccatatcattccctacagcaagaccttcgacgattcttataccaataaagtgctggtcttttccgacgagaaccggaagaaaggcgatcagatccctgctgaatacctgggcattgggacaaagcgctgggagaaatacaaggagttcgtgatcaccagcaagtttcccgcctccaaaaagaaaagacttctcaaggaacagctggttgagcgggaggaactgttcatgaaagagcgccacctcaatgacacaagatatgcttctcggtactttatgaacttcctgcgcgaaaaccttctgagaaaggagacggtgctccacgaaacccagtgggtcacagccgtggcgggacgggttaccagccatatcagaaagcgcctgggctttgggaaagatcgggaggaaacacaccttcatcacgcccttgacgctattatcgtggcctgtaccgataagtggatgattgactgcgtcacgaattattacaaatccagagagggaggctctatcaagcgcaaagagattcggttcccgagcccttggaacgggttctggcatgatgtgcaaaccaagctcgctcagctgccccagcctgaagtgatcaatgagtccatcagcaagggcaaccccgacgccgttgattatatgctggtctctagaatgccccgcaaatccattacaggagccgctcacaaggaaaccatcagcaaatggggcgggtacgacgataagggaaaagcgctcctggtgaagaaagtggccctttctgagctgaagtttaagaatgacgacttccctatgtataacaaagaaacagatccgctcctgtacgaggctattaagaatcggtacgtcgagtccggcagagacgtgaaacgcgcctttgccacgcccctgtataagcctagcaaatctgggaagcggaacgaagttaagagagtgaaagtcatcgctgagaagaaagccatggtgcgggaagttaatggaggcattgcggagaacgggggccttgtgcgcagcgatatcttcctcaaggaaaagaagtacgtcatggtgcccgtttatacctttgacacaatcaagcagcaactgcctaataaatacgtggtctccggaagaggctatgagcagtggcccgagctgaccgctgaacacgtgttccagtttagcgtgtacccgtatgagctcgtccatgttgggacaaacaagggagataattctttctactactttgcctccctgaacattagctccaatgtgcttaaattctctgaatgtaaccggcctaccaaggactatatcgagattggcctgaacagcatcattctcctggagaaatacgaaatcgatgtgctggggcgcattaccggacagtccaagaagggcatcagacaatcttttaaaaataacaagagccagatgaaagagtga

SEQ ID NO: 3849 - RNA, 3219 nt, synthetic construct
  misc_feature 1..3219: note = Cas9 variant
  source 1..3219: mol_type = other RNA
atgagactgggcctcgacatcgggaccaacagcgtgggatggtggctgtacaagacagatggcgaggccgcttccgcccggattgtcgaagttatcgacgggggagtgcgcattttctctgatggcagagaccccaaaagcaagacgtcccttgcggtggatcggcgcgtcgctagagccgcccggcgcagacgggaccgctatctgagacggcgcgcttctctcatgaaactgcttgccagaaccgggctgatgcctgctgatccggtggaggccaagaaactcgaacggctggacccctacgagctgcgcagcacaggactcgatgacgcgctgcctcttacccactttggcagagccctgttccatctcaatcagcggagaggctttaagtccaaccgcaagacagatcggggagacaatgaaaacggaaaaatcagagaggctaccgcccgcctggatcttgagatgatgacatctggcgctcggagctatggggagttcctgcacatgagacgccaacgggcctccgaccccagacatgttcctagcgtgcgcacccggctctctgtcgcggccagaggaggccccgacgctaaggccgaagctgggtacgatttttatcctgaccgccaccatctggaagaggagttccacgccctgtgggccgctcaggcgacgcaccatcaggccctcaccgatgacctgcgggatcttgtgtttgagaaaattttctaccagagaccgctgaaggaacccaaaatcggactctgcctgtttacagctgaggaacggatcgccaaggcccaccctcttacccaacgcagagttctgttcgaaacaattaatcagctccgggtgaccgctgacggcagatccacgcgccccctgacactggaggagcgggataccctcgtccatgccctggacaacaagaaacctacaaagagcatgacctctatgaatatgacccttaaagcgctggctaagctcctgaaacttagagatggcgaacgctttacactggagacgggggtgagagaaaacatctcctgtgaccccgtgcgggcctgcatggcccacccggctcgcttcggacctcagtggagctctctcgattgggaggcccagtgggacgtcatttccagagttcggcaagtgcagagcgaaggcgagtttatcgagctgaccgactggctgattcaggggcacggactcgatgctgaccatgccaaggcggtgggcaatgccccgctgcctgaagggtatgctcgccttggattctccgccacagagagaatcctggatcagctcaaagctgaagtctgtacctactctgacgccgtggcgaagtgcggctggcaccatagcgatcaacggacaggcgcctgtctggaggttctgccctactatggggaagtgcttgaccgccacgtcattcccggaacctacgatgctacggacgatgagatcacaagatatggccggatcaccaaccctaccgtgcatattgggctcaatcagctgcgcagactggttaacaagatcattgaggtgcacggaaaaccggaccagatcgtcgtggaactcgcccgggagctgaagcaatccgaaccccagaaaaaggatgctatgaaaagacttcgcaatacaaccgccgacgccattcggagaagcgagcagctggagcagctcggccaacctaacacagggcacaatcgcatgctgctgcggctttgggaagatctcggccccgctatcggacctagatgctgtccctacacgggcaagaccatctctgtcacaatggtgttcgacgggtcctgcgacgttgatcatattctgccgtttagccgcaccctggacgattctttcgcgaaccggacactctgtctgaaggaggccaacagagaaaagagcgaccgcaccccttgggaggcttggggaggcacggatcagtgggacgatatcgccgccaatcttaagaacctgcccgagaaaaagcggaaaagatttgggcctgacgctatggaatggttcgagggagaaaatgattttctcgaccgggccctggtggatacccagtatctggcgaagatttcccgcatgtaccttgacacactcttcaccaagggcgggcacgtctgggtggttcccggcagaatgacagagatgctgcggcgccattggggactgaacgctctcctgaatgataaagacagaggcgccgtgaaggccaaaaaccggaccgaccacagacaccatgctatcgatgccgcggtcgtggctgccacggactatcgccttatgcagaagatttctcgggccgctgggcaaggagaaaatgccggccagagcgctgagctgatcgccagagatacagacgcgccttgggaacactttcgcgccgatatcgcttcccagctcgagaaaattatcgtgagccatcgggccgaccacgggagaattgatgttgagggacgcaagaccggccgggactctacagctgggagactgcataacgataccgcctacggcgtcatcgacgatctgaccgtggcctcccgcacaccccttatgagcctcaagccgtctgacattgctatcacggaaagagggaaaaatattcgggaccctcagctgcaaaacgcgctgtacgtggccaccaagggcaaagaggggaagatgttcgaacaggctctcgtcgattttgcctccaaagagggaccctatcagggcatccgcagagtgcggctggttgaaacacttcagaaggccgctcgcgtggagatcgggaaaaccgagagcggacaacccctgaaggcctacaagggcgactccaatcactgctatgaactctggaaactgcctgatgggaagattgtcccccaggtggttacaacctacgaggcgcacgctggctctgcccccagacctcatcccgccgctaaacggatcctgagagtgttcaagaaagacatggtcaaacttacgaaggatggagaagagattgtgggctatgttcagagcatgcacatcaaaaacgggctgtttgtggcccaacatctcgaggcgaatgctgacgcccgcaaccgggataagacagaccctttcaaatttctgcagatgggagccggcaccctcgtcaagaccgggctgagacgcgtgcttgtggatgaaattggacggctgagagaccccggccctcccaaactctga

SEQ ID NO: 3850 - RNA, 3225 nt, synthetic construct
  misc_feature 1..3225: note = Cas9 variant
  source 1..3225: mol_type = other RNA
atgcagaccaagaacctgccctacacactcggcctggacatcgggatggccagcgtgggagctgcccttctgctccctgatcaagagcggattctggcgcttcacgtcagaacgttcgacaaagctgaaaccgccaaggagggcgaatccctgaataaaatccgcagagattctcggctcacacgcagacggattcgcagacgggcccatcgcctggttagactggctcggctcatgaagcgcgtggggctgatcgccgacgctaacccggaggcctttgcgcttcccggagtgagcccttggcacctgagagccgatggcctcgaccggctgcttgaacccaaagagtgggctggggtcctgtatcatctcgtgaagcaccgcggattccagtccaatagaaagtctgaggccaaagctgatgaaaaggccggccagatgctgagcggcgttgggcggaaccaggcgctgctcaaagaggccggatacagaaccgtgggcgaactggctgcccgccatgaggactttaaggaggctaaacggaataaagggggatcctattctcacacattcgccagagccgatcttaacgctgaactgaatctcctgtttgagcgccaacgggcgcttggcagcagactggcctccgctgacttccaggaaaacgtccgcgatctcctgatggcccggagacctaccctgagcggggccaatctcctgaagatggtgggaaagtgcacatttgagaagtctgaagaccgcgctcccaaagccggctaccgggcggagagattcgtttggcttggcaagctgaacaatctcaaaattgtggggtccggagatgctcgccctctgaccgacgccgagcaccggatcgtcatcgaccttccgtttacgcaggccaagctgaccttcaaacaggtgagaaaggctctcgaactggagacacatcaacggtttaacctgctcagctatcgccccgatcctaagggcaaagacaaggatcccgaagagtctaccttctttgaagccaaatccttccacacactgagaaaggcttacgagggggccggacttaaaaaggagtggcagcgggacgcgctggatcctgacagactcgatgccctggcttatgccctgacctgttacaaggacgatacggaaagccgccagtggcttgtggctcagggcattgggacacccatcattgaggccgtcctcgcggaatctttcgacaaatttatccatctgtcccaaaaggccctgaaagctattctcccgcacatggaggccggacagcggtacgatgacgctgccaagagcgccggctatgaccactcccagcctgatgctggcaccgggaaaagagcgacactgccccctcccgacaaggataccatccgcaatcccgttgtgtacagagcccttaaccaagctcggaagctggtgaatgccattgtcgccgaatatggacctccggctgccgtgcatatcgagctcgcgcgcgacctgtctaaacccatcgatgagagacgggacattgaaaagggccagaaagagttccaggctctgaaggaaaaacttgccgccgcttttgaggagaccttccaccgcaagcctagcgggctcgatctgctgaagtacagactctttcgggaacagctggaccaatgcccctattgtcagaaagcccttgttgtggatcgcctgttcgagcctggatacgcgcagatcgaccatgctctcccctattcccggagctttgatgacggcatgaacaacaaggtcgtggttcacgtggcctgcaatcaggataaagggaacagaacaccgtacgagttcctggacggcgccggagactctgaacgctggcaaagatttgtcgcttgggtgcagggcaataaggccattcggcaggctaaaagaaaccgcctgcttcgggtcaatttcgggacggatgaagccaaggagttttccaaaagaaacctcagcgacacccgctacatctgtcgggagttcaagagaacaattgaaacccagtttgcgtggcattctgatgccgagggaaatgaacgctgcgtggttctgagcggccaactgacatccctcctgcgggctagatgggggcttatcaaggtgcgcgaggacggagatctgcaccacgccctcgacgtcgctgtgatcgccgccgcttctcggagcctggttaaaagaatggcggattattcccggcgcaacgaactggagatggtgagaaatcggtacgtcgaccctgccaccggcgaggtggtggatgttgctgcccttcgccagattgaagaccatttccccaagccttggcccctcttcagagaggaactgctggcccggctcgctcctgagcccaaactgcagcttacgtgtgtcagctcttatgatgaagggctgagagagtccatccgcccgattcgggtgagcagagcccctacacgccggggcctcggagcggctcaccaggagaccatcagatctctgcgcgacggctcccaaagcgccattaagacacccctgcgggatcttaacctgaaagacctcgaaaatatcgtggggtttgagagagacaccgccctgatcgatgctattcgcaccagactcgaagccttcggaggcgaggggaagaaggcgtttgacgataaacagccccctctgcggaagccgtccaaagaccccgataaggctcctatcattcgctctgtcaaacttctggtgacacaaaagagcggaatccccattagaggcgggatcgccaacaatggcgccatgctccggtccgacattttcacgaaggctggaaaattttacgccgttcctatctatgtggctgatgccgtccgcggcgagctgccccatagagcggtggcccaggctaagcctgaactggagtggcccatgatggacgaatcttaccagttcctttttagcctgcacccgaacgattggatgaccatccggctcaaaaatgaggttagagaagggtattacgccggactggaccgcgctacaggcaacatttccctctggctgcacgatcggaaccagaatgtggggcagaagggacttctgaccggcaacgggatcaaaacagccctcgccgtcgagaagtaccatgtggacctgctgggcaaacttcacagagttcataaggaggaacgccaacctattcacatcaagcccggaaaacggtga

SEQ ID NO: 3851 - RNA, 3234 nt, synthetic construct
  misc_feature 1..3234: note = Cas9 variant
  source 1..3234: mol_type = other RNA
atgaagtacagcatcggcctggacattgggatcgcctccgtgggatgggctgtcattaacgaggatatcgaaagaattgaggacctcggcgttcggatcttcgatgtggccgaacagcccaaaaccggggcgtctctgagcacacctcgcagacttgctcggtccacgcgcaagagactgcggcgcagacggcaccgcgtggagagagtccggaaatttatgatccaaaagggactcctgacccaggtgcagatggaacagctttatgactggaaagatggcgacctggatatttggctcgttcgcgtgaatgccctggagagaaagctgtctgaccgggagttcgcccgcatcctcgtccattttgctaagaacagagggttccaaagcaatcggaaatccgaactgcaggaggaagataacggagccgtgctttctgctgttcaggagaataagagactgatggaggaaaaaggctaccagacaattagcgagatgctcctgtatgacgaaaagtttgagggcaccaaacgcaacaaagggggagaatacacacacgtggtcgcccggtccgatcttaagagagagatccaactgattttcgagaagcagcgcgcgtatggccatgcctttgctaccatggaaaatgaggacaagttcctccagatctggagctctcagcggccgtttgccacaaaagatgacattgctaagaaaatcgggaactgcaccttcgaacccaaggagaaaagagcccctaagtccacgtacacctttgaacgcttccgggcgctggacaagctgaatagactccgcatcctgagcggaacatctcccgcccggtcccttacccaagaggagagagatctgattctcaacagcctgttttctaaaaaggaagtgaaatataaggagcttcgcaaactgctcaagctgaatgacgaacagcggttcaacgagatcttctacgatcctaatgaaaagattgagaaaaacgagaatagaacatttctgtccctcgaaagccagtacaagatccggaaaattctgcaaaagatcgagggcaaatcccttaacgacacctatcgccccgtggatctggacacgatcgcttacgccctcacagtcttcaaggatgaccaggatattagagactatctgcagaaccagtacgttgcttctaatgggaagaaagaacttaacctggccaatcggaagtataacgatgagctcatcgaggaactgctgcacctcagctttaccaaattcggacatctgtcccttaaggccctgagaaatattctcccttttatggagcaaggcatcccgtaccaccaggcttgtgaaaaagcgggctatcagttcaacaagaaggtgaatcgcgagaaacagaagctgctgccccctgtgcccgccaaagacattgtcaaccctgtggttatccggagcctttctcaagtgagaaaggtcatcaatgggattatcaaacgctacggatcccccagctctatttacatcgaactcgctagagagatgggccgggggtataaggagcgcaaagacctggaaaagcagtacaacaagaatagacagatgaacgagggagccaaaaagcacattctggaactccggccggagtttggcgatcctcgcgggcatgacatcctgaaatataaactttggcaggaacaagattgcagatgtgcctacagcttcaagtccattcccatcaagcagctgtttgagatcggatatgctgaggtggaccacattatcccttactctcggagcttcgatgactccaataacaataaggttctcgtgctggccgcggaaaaccagaacaaacagaatcgcacaccctatgagtggtttggccatgatgaaaccaagtggcaagagttcaccagcctggtcacaacgatgaaagtgtctaagaaaaagaagtcccttctcctgaaaaagaactttgacgaagaacaggctgaggagttcagaagccggcacctgaatgatacccgctacattacaagatacatcaaaaccttcattgaggacaacctccagtttcggatcgaagagggcaagaaaacatatgtccacaccgtgaatggggcctacacgtctctgatgagaaagcgctggggattcaacaagaatcggcaagagaacgcccttcatcacgctctggatgccgttatcgtggctgtctccctcccctttaaacataaggtgagagcctatttcaaacgccgggaagagtacgcgcacaatcagctgaagagagaaggcgagtttttccctgaaccgtggcccgggtttattcatgagctggagatccgcatgatgcaggacagcgaaaacattaaacttgccatggagtccctcaatctgaagacatatgatgaatctttcatcaaagagctgaagcctatttttgttagccggatgcccaagagagctatgaaaggacagatccacgaagagaccctcaagcgcgtgcggggcagaaccgacgacgggtacatccggacagtcaaaaaggtgaaactggatcaaattcctttcgacaagaacggcgattttcccatgttcggaaaggagaccgacatgaaaacatatgaagccatcaagtcccgctaccttgagtctggcaaagataagaaaaaggcttttaatacgccgctgtacaagcctgccaaaaaccccgaaaatgcgcctattatcagaagcattaagatcgaggaaaaagccaaccgggtggttatgctcgacgagaagaccgctgccgataacgcttccatcgtccgcacagaggtgttcagacacaaagaaaccgggaattatttcctgacacccgtgtacgtcgccgacgtgctggccaagaaggttcctgatcggcttattaccacgaaaaagccctatagcgagtggagaaaaatcaccgacgaatacgagtttctcttctctctgtatccgaacgatctgattcgcgtgaagatgcctaaagagaaggaaacaaagacccatacaggagagaaacacgtctggcaggaaaattttatgtacttcaagggcgtgcattccgggagcgctggagttcggatgatcgaccacatgaactcttttgaggatgaaattggcgtgagaaaactcgtcgtgttcgagaagtatcaggttgaccccctggggcgcatgaataaagtgcacggcgagaagcggcatggaatctga

SEQ ID NO: 3852 - RNA, 3234 nt, synthetic construct
  misc_feature 1..3234: note = Cas9 variant
  source 1..3234: mol_type = other RNA
atgaagtacagcatcggcctggacattgggatcgcctccgtgggatgggctgtcattaacgaggatatcgaaagaattgaggacctcggcgttcggatcttcgatgtggccgaacagcccaaaaccggggcgtctctgagcacacctcgcagacttgctcggtccacgcgcaagagactgcggcgcagacggcaccgcgtggagagagtccggaaatttatgatccaaaagggactcctgacccaggtgcagatggaacagctttatgactggaaagatggcgacctggatatttggctcgttcgcgtgaatgccctggagagaaagctgtctgaccgggagttcgcccgcatcctcgtccattttgctaagaacagagggttccaaagcaatcggaaatccgaactgcaggaggaagataacggagccgtgctttctgctgttcaggagaataagagactgatggaggaaaaaggctaccagacaattagcgagatgctcctgtatgacgaaaagtttgagggcaccaaacgcaacaaagggggagaatacacacacgtggtcgcccggtccgatcttaagagagagatccaactgattttcgagaagcagcgcgcgtatggccatgcctttgctaccatggaaaatgaggacaagttcctccagatctggagctctcagcggccgtttgccacaaaagatgacattgctaagaaaatcgggaactgcaccttcgaacccaaggagaaaagagcccctaagtccacgtacacctttgaacgcttccgggcgctggacaagctgaatagactccgcatcctgagcggaacatctcccgcccggtcccttacccaagaggagagagatctgattctcaacagcctgttttctaaaaaggaagtgaaatataaggagcttcgcaaactgctcaagctgaatgacgaacagcggttcaacgagatcttctacgatcctaatgaaaagattgagaaaaacgagaatagaacatttctgtccctcgaaagccagtacaagatccggaaaattctgcaaaagatcgagggcaaatcccttaacgacacctatcgccccgtggatctggacacgatcgcttacgccctcacagtcttcaaggatgaccaggatattagagactatctgcagaaccagtacgttgcttctaatgggaagaaagaacttaacctggccaatcggaagtataacgatgagctcatcgaggaactgctgcacctcagctttaccaaattcggacatctgtcccttaaggccctgagaaatattctcccttttatggagcaaggcatcccgtaccaccaggcttgtgaaaaagcgggctatcagttcaacaagaaggtgaatcgcgagaaacagaagctgctgccccctgtgcccgccaaagacattgtcaaccctgtggttatccggagcctttctcaagtgagaaaggtcatcaatgggattatcaaacgctacggatcccccagctctatttacatcgaactcgctagagagatgggccgggggtataaggagcgcaaagacctggaaaagcagtacaacaagaatagacagatgaacgagggagccaaaaagcacattctggaactccggccggagtttggcgatcctcgcgggcatgacatcctgaaatataaactttggcaggaacaagattgcagatgtgcctacagcttcaagtccattcccatcaagcagctgtttgagatcggatatgctgaggtggaccacattatcccttactctcggagcttcgatgactccaataacaataaggttctcgtgctggccgcggaaaaccagaacaaacagaatcgcacaccctatgagtggtttggccatgatgaaaccaagtggcaagagttcaccagcctggtcacaacgatgaaagtgtctaagaaaaagaagtcccttctcctgaaaaagaactttgacgaagaacaggctgaggagttcagaagccggcacctgaatgatacccgctacattacaagatacatcaaaaccttcattgaggacaacctccagtttcggatggaagagggcaagaaacaatatgtccacacagtgaatggggcctacacctctctgatgagaaagcgctggggattcaacaagaatcggcaggagaacgatcttcatcacgccctggacgctgttatcgtggccgtctccctcccctttaaacataaggtgagcgcttatttcaaaagacgcgaagagtacgcccacaatcagctgaagcgggaaggcgagtttttccctgaaccgtggcccgggtttatccatgagctggagattagaatgatgcaggattccgaaaacatcaaacttgcgatggagtctctcaatctgaagacgtatgacgagagcttcattaaagaactgaagcctatctttgtttcccgcatgcccaagcgggccatgagaggacaaattcacgaagagacactcaaacgcgtgcggggcagaaccgacgatgggtacatccggaccgtcaagaaagtgaagctggaccagatccctttcgataaaaacggcgactttcccatgttcggaaaggagacagatatgaagacctatgaagctattaaatctcgctaccttgagagcggcaaggacaaaaagaaagcctttaatacaccgctgtacaagcctgctaagaaccccgaaaatgcccctatcattagatccatcaaaattgaggaaaaggcgaaccgggtggttatgctcgatgagaaaacggccgctgacaacgccagcatcgtccgcaccgaggtgttcagacacaaggaaacagggaattatttcctgacccccgtgtacgtcgctgatgtgctggccaaaaaggttcctgaccggcttatcacaaccaagaaaccctattctgagtggagaaagattacggatgaatacgagtttctcttctccctgtatccgaacgacctgatccgcgtgaaaatgcctaaggagaaaggaaccaagacacataccggcgaaaagcacgtctggcaggagaattttatgtacttcaaaggggtgcatagcggatctgccggcgttcggatgattgatcacatgaactcctttgaagacgagatcggggtgagaaagctcgtcgtgttcgaaaaatatcaggttgaccccctgggccgcatgaataaggtgcacggagagaaacggcatggcatttga

SEQ ID NO: 3853 - RNA, 3234 nt, synthetic construct
  misc_feature 1..3234: note = Cas9 variant
  source 1..3234: mol_type = other RNA
atgcagcaaaagccccagagatacatcctgggcctcgacctggggattgccagcgtgggatgggcttgcgtctgggccgatgagaacgaacaccctaccggccttctggactgtggggttcggacattcgagcgcgcggaagtgccgaaaacgggagattccctcgctctggccagacggcaggcccgctctgtgagacggcttatccgcagacgggctcatcgcctgctcagactgcggcgcctgctcaagagagagggcgtcctgcttagcgccgactttaatgaaaacgggctggtgcggggactccccattgatgcttgggccctgcgcgttgcgggccttgacagaaaactgtccaataaggagtgggccgctgtgctcctgcacctggtcaaacatcggggctatctctctcagagaaagaacgagacccaaagcaaggataaagaactggggcgccttctggccggagtgaatggcaaccgggaggctctccagaatagatccgacgaataccgcacagccgcggagctggccgttaagaaattcgctgccgagaacaatgggtctcttcggaacaagggaggcgattatagccacacctttgacagaaaagatctgcagcgcgaactccatctgctgttcgagcggcagagagctctcgacaatccttttacatccagcgaaatggaggccgccgtggatgaactgcttatgaagcaacgctctgctctgcagggggaggcggtcctcaagatgctgggacggtgcaccttcgagccctccgaatacaaagccgctaagaacacatatagcgccgagagatttgtgtggcttaccaaactgaataacctccgcatccagtacaatggcgaagaacgggccctgtctgaagctgagagacggctgctcctggacgagccttatcagaaggccaaacttacgtacaagcaagtgcgcaccattctggaactccccgagtccgcggtcttcaaaggcctgagatacgggcacggagaagacggcctgaaggctgagagcgggacacttatggaaatgaaggcctatcacgccgttcggaaagctctcaaggatgccggactggagggcgagtgggaaaacagaatccgcaaccctgagctgctcgacgctatcgggaccgccttttctctgtacaaaacagatgaagacattcgggcgaatcttgccgctttcagactgtccgagaacgtgctcgaggccctgctggctggacttaattttgataagttcgtgcatctcagcctgaaagccctggcgaagatcctcccgctgatggaacagggcatgcgctatgacgaggcctgtaaggaggcttacggcgatcactatggggccaaagagcaggaagaccatagacttctgcccccttttgtcgctgatgacattcggaaccccgtggttttccgcaccctcacgcaagccagaaagatcgtgaatgagattgtccggcgctacggatcccctctgagagtgcacatcgagacaggccgggaagttgggaaatctttcagcgatcgcaaggagattgagaaaagacaggaagaaaaccggaaggagcgcgagagagccgctgcgcactttaaggaactgttccccaattttgccggagagccgaaagctcaggacatccttaagctccggctgtatgaacagcaacatggcaaatgcctgtactccgggaaggagatcgacctcagacgcctgcctgaaaaaggctacgtggagattgatcacgcccttcccttcagccggacctgggacgattcttttaacaataaggtcctggtgctcggaaaggagaaccaggacaaaagaaatcgcacaccttatgaatacctggatggcaaggggaactccggagcctggcgggctttcgccgagagagtcagcggctgtcgctttccctatgcgaaaaagcagcggctgcttacccagaaactcgacgaaaagaccgagcaagggttcctggagagaaatctgaacgatacacgctacgtggctcggtttctctgccagttcatcgaagagaaaatgcatctggaaggagccggcaagaagagagtttttgcctctaatgggcagattacggcccttctgcggggcttctggggactcaaaaaggtgcgcgaggaaaacgacagacaccatgctctggatgcggtcgtggttgcttgtagctccgtgtctatgcagcagaaaatcacccggcactttcgctatagagaggagctggaacacattgaccgggagacaggcgaagtcatccatgggttcccccaaccttgggagttctttagacaggaagtgatgacccgcgtgttcagcgatgacccggtttccgagcttgccgagaagctggatagccggcccgaagccgtccacgagtttgtgacacctctcttcgtgtctagagctccccatcgcaaagtcaccggacagggccacctggaaacgatccggtccgccaagagactcgacgagaagattagcgtggttaaactgcctcttacacaactgaagaccaaagacatcgaacgcattgtggggtaccccaaccgggagccggctctctatgatgccctggcggccagactggctgcctttaaggacgatcctgctaaagccttctctgagcccttttacaagaccggaaaggacggcaaatgcggggtccttgtgaaggccgttcgcgtggaaaatgtccagaaatccggcctgctcgtgagaaaggatgagagcggaaaaatgcagggcgttgctgacaacgcgacaatggtgcgggtcgatgtgttcgggaagaatggaaagaactacctggtgcctgtctatgcctggcaagttgaaaaaggcgagctccccaatcgcgctgtggtggcctacgccgacgaggaagattgggacgagatggatgactcctttgagttcaagttttctctgtatcctaacgatcttgtcgaagtggttaccaaaaaggacaaattctttgggtactatagcggattcaatagagctacaggcgccatcaacattaaggaacacgacctgtccaaatctaaggtgaagaatggggtctacgagggcatcggagtgaaaacggcgcagagcttccagaagtatcaggttgataccctcggcaaaacaatccggctgtgtaagcccgagaaacgcatggggtttaagaagaaatga

SEQ ID NO: 3854 - RNA, 3237 nt, synthetic construct
  misc_feature 1..3237: note = Cas9 variant
  source 1..3237: mol_type = other RNA
atgagatacgtgctgggcctcgacatcgggattgccagctgcggatgggctgtcatcaaccaggagaaggaacggattgaggatctgggcgttcgcatcttcgacaaagccgaaaatcccaaggatgggaaatcccttgcggctcctagacgggacgcccgctctaccagacggacactgcgcagaaagaaacaccggatgcaacgcattaaggtgctcctggtgaagcatggacttctgagcaaaacggagctcgatcacctgtatgaatccgccaccgaggtcgacgtgtggaacctgagactcgatgctctggagcggaaactttacccgaaggaatttgcccgcatcctgatccatctcgctaagagacggggcttcaaatctaatcgcaaggagacaaccctgagcgaaaacgggcagattcttgagtccatctctgagaatcagcagattatggaaaagcaaaactatagaacagttggagagatgatcctgaaagacaagaaatttgaaaatcacaagcggaacaaaaatggcacctacgtgggcacagtcaccagacagcagctccaggatgagattcaaatgatcttccatgcccagcgcctgtataagaacgactacgcgacggaagagtttgagagctcctatctggaaatttgggccagccagcggccctacgcttctaaagatcagatcgagaagatgatcgggtactgtaccctcgaacctaaggagaaaagagcccccaaggcttcctggagcttccaatattttgtggccctgcagacaattaataaccttcgcctgatctctaaagaccggattgaggagctctccttcgaggaaaagaaacagatcatgaatctggcgcttgaaaagagcattgttaagtacatcgatatcagaaaactgctctctgtgcctaacgaatttcaattcaattccctgagctattccgccgacaccgtcgacacagctgtggagtctcgcaagtgcattgaactgaaagagtaccacagcatcaacaaggtgtataaacagatttacggagagaacgccctcaatctgcttcccaagtattacgataccatcgcttacggcctgacgatttttaaggacgataaagacatcctcgaatatctgcagaacaagtacgtcaatgccaaagggaagcctatctccaacttcgccaataaaacatatgatgacacctttattcaggcgcttctgaacctcaatttcacaaagatgggacacctgagcttcaaggctctgaaaaacatcattccgtttctcgaggaaggcctgtcttacgataaggcctgtgagaaagctgggtataatttcaagggaacctcctacaccgagcaaacaaaatatcttcccgttatccctcagaacacgaatcccgtggtgcatcgggccctgagccagaccagaaaggtcattaacgccatcattaaaaagtacggctctcctaatgctatccacatcgaaacagcccgcgagctcagcaagacctttcaggaacggaaagagattgactccatgtaccaagataactctaagaaaaatgaacatgcgatccacaagctgaaagagctgggcaacattaaccccagcgggatcaatattgtgaagttcaaactttggaacgagcaggacggaagatgcatgtattccggcaagtacatcgaaccgcaccgcctctttgaggaagggtatacagaggttgatcatatcctgccttacagccggtctctggacgactcctataataacaagaccctcacgctgggaacagaaaatcagagaaaaggcaacaagattccctacgagtatatggggaataccagcatctggaacgatttcgagacccgggtgcagtctaataaaaagattaacaagaaaaagcaacagaaacttctgctccagcacttttcctacgctcgcgaacaggagttcatcgaaagaaatctgaacgacacacggtacgccaccatttatctgagctcccttatccaacagcatctcatcttttctgagagctccagaaagaaaaaggtccacacagtgtctggaattatcacgagccatctgcgctcccggtggggcttcaataaggatagaaaagaaggccacattcaccatgccctggacgctgttatcgtggccgtcaccagcgatcacatgattcagcgcgtgacaaagtactataaactcaaggagctgaacagaaatcttcaagctaaacggatgccttttcccgagccctgggaagggttccgcctggagctcgaagccagaatctctcctaacacccagcagtacctgaagggactgcggtttaaaaactatgcggacgtcaatctttccgagatcaagagcattttcgtgtctcgcatgccgaagcattccatcacaggcgagctccaccaggaaaccattagaaaattcatcgggtacaacgagaagggaaaagttctgacggccattaagaccaaactggaagatatcccctttgacgctaatggcgatttccctatgtatgggaaggagagcgacctctacacatacaacgccattaaggaacggtatctgtctcacaaaaaggataaacgcaagagctttcaagagcccctttacaaacctaccaagtccggcggaatcggccccctgatcaagagcattaaaatcatggacacaagaaccattgtgaatccggtcaaccaggggaagggagtggtttataattctaaaatcgctcggacggatgtgttcaagaaagaggaaaagtactatctcattcctatctacacaatcgacctgatgaagaacattctgccccagaaagccatcaccgcgggcaaggggtatgaggactggacaaccattgatccttcctttaccttcctttttagcctcttccccaatgacctgatccagattgtcccttccaaaaacaagacaatcaaagcccgcacgaccgtgtctaagaaggaagtgctgctccccagcctgacaggatactttaaaggcgttcattccgggaccgctggcatcacagtcgagacccacgatggatctgtgattgccaatgtgggcagcaagcaacttctgctcatcgaaaaataccaggtcgacgtgctggggaactatacgaagattaaagaggagaagagaatcggactgacaacctacaatgataacaaaaagattgctgcctgttga

SEQ ID NO: 3855 - RNA, 3237 nt, synthetic construct
  misc_feature 1..3237: note = Cas9 variant
  source 1..3237: mol_type = other RNA
atgaagcagcaaccccagagatacatcctgggcctcgacctggggattgccagcgtgggatgggctcttatcctggtcgatgaggaaggcaaccctattgggctcctggactgcggagttcggaccttcgagcgcgccgaagtgccgaaaacaggcgattcccttgcgctggctagacggcaggcccgctctgtgagacggctcatccgcagacgggcccaccgcctgctgagactccggcgcctgcttaagagagagggggtcctgagcgctgccgactttaattccgatggactccccaacctgcctattgacacgtggcagcttcgggtggctggcctggaacgcaaactcaccaatcaagagtgggccgcggttctgctgcatctcgtgaagcacagaggctatctgtctcagcggaaaagcgagacacagaccgaaaacaaggagcttgggtgtctgctcgcctccgtcgctaaaaattctaagctgcttagcgaaaacgccaatcagtacagaacacccgctgagctggccgtgcgcctcttcgcggagcaatccggacatctgcggaacaagggcggggattatacccacacatttaatagactggacctccagaaagaactgcatcttctgttcgagcagcagcgcacctttggaaaccctttcgccagcgctgaactccaatctaaggttgatggcctgcttatgatgcagcggtccgccctgcagggggaggctgtgctcaaaatgctgggaaagtgcacgtttgaacccagcgagtacaaggccgccaaacacacctattctgctgagagattcatctggctgacaaagctcaataacctgcgcatccttgaaaatggcaccgagcgggcgctgaacgaagccgagagaaaactcctgctggacgaaccttacaagaaagctaagctcacatattcccaagcccgcaaactcctggatatgagccacgacgccacctttaagggcctgcggtacgggaaggattctgagggactcaatgctgagaacggcgccctgatggaaatgaaagcgtaccataagattagaacggtccttgacaaagctgggctgaagggagagtgggaaaaccgcatccggaatccggagattctcgacaaaatcggcacagccttctccctgtataagaccgatgaagacattcaggccgctctggccgatcttagactccccgagaacgtgctgaatgctctgctcgccgggctgaactttgacaagttcatccagcttagcctgaaagcgctctccaatattatgcctctgatggagcggggaatccgctacgatgaagcctgtaaggaggtgtatggcgaccacagagctctggccgaatctaaaaaccagatgcttcttccccctatccccgctaatgagattcggaacccggtcgttctgagaacactgacccaaacccgcaaggtgatcaatgccattatccggagatacggcagccctcagcgcgtgcatattgagacagcgagagaactcgggaaatcctttaaggatcggaaggagatcgaaaaacgccaggaggaaaacagaaaggagcgggagcgcgccgctgaacacttcaaagagctgttcccccactttgccggagaacctaagggcggggacatccttaaactgagactctatgagcagcaacagggaaagtgcctgtacagctctattcccatcgatctgggccggcttaatgaaaaggggtatgtcgagattgaccatgctctccccttctcccgcacgtgggatgacagctttaacaataaagtgctggttctgggctctgagaaccagaagaaaagaaatcagaccccttacgaatacctcgacggagccagcaactcccaacggtggcgcgagttccaggccagactgcagggctgtcggttttcttatgctaagaaacagagaatccaaacagcgaagctggatagcaaaaccgaacaggggttcctggagcgcaacctcaatgacacacggtacattgccagatttctgtgcggattcatcgaagagaacctgcaccttcagggcgaggggaagcgccgggtgtttgcttccaatggacaaatcaccgccctgctcagaggcctgtgggggctcaagaaagtccgcgaagagaacgatcggcatcacgccctggacgctattgtggttgcctgtagcacggtgtctatgcagcagaagatcacaaaagcgatgcagagacgcgaaacccttgagaccgtcgatacagagaccggcgaagtgaagacacggattccgcaaccctgggacttctttagacaggaggtcatgatgcgggtgttctccgatacgcctcatgaggaactggctgaaaaactcagcggacgccccgaggccctgcacgactttgtttctcctctgttcgtgtccagagcccccaatcggaagatgaccggccaggggcaccttgagacagtcaagagcgctaaacgcctgtccgaaaacatctctgtggttagaaagccgctcaccgccctgaaactcaaggatattgagaatatcgtgggatatcctgaccgggaacccgcgctgtaccaggctcttagagagcgcctgcaagcctataaagatgaccctgtcaaggccttcgctgaacccttttacaagcctgccaaaaacggcgggcagggaagcctcgtgaaggctgtgcgggttaaagatgtccagaagacaggcgtgatggtgagaaaagaccgcgggggcattgcccggggaatcgcggacaatgccaccatggtcagagtggatgttttcggcaagaaggggaaaaactatctggtgcccgtctacgcttggcaagtggccaagggaatcctgccgaatcgcgctgttgtggcctacgccgacgaggctgattgggacgagatggatgactcctatgaatttaaattcacgctttaccctaacgatctggtcgagattatctctaagaaaggccggatttttgggtattacagcggactcaatagagcgaccggcgccatcgacattaaggaacatgatctgtccaaagagaaggctaagaacgggatccaccagagcgtgggcgttaaaacagtgctctctttccagaagtatcaggtcgaccccctgggaaaagaaatctgcctttgtaaggtggagaaacatcccgagcttaattccaagaagaaaaagtga

SEQ ID NO: 3856 - RNA, 3237 nt, synthetic construct
  misc_feature 1..3237: note = Cas9 variant
  source 1..3237: mol_type = other RNA
atgggctacctgatcgggctcgacattggaatcaccagcgtgggctatgccgtcctgcagacagatttcaaggggaacccctacaaaattcttctgatgaatacggttatctttcctgtggctgaggccccgaagaccggagaatccctcgcggctcccgtgagacaaaaacggtctagccgcagaacaaaccggcgcaccaagttcagaaaactgcgggtccagaaactttttgtgcgcttcggcctgctcgagtccgccgacgttgccacatttctgaatcagaaggtgcctcaccaggatatttggcaactgagaaaagacgctctcaaccggaagctgtctaatcgcgaacttttcgagatcctgtatttcttcgtcgggcatagaggatttaaaagcaaccggcgctccgaagtgaccggcaagcagcccaaagataatcaggttgtgctcacatctatccacgacagaggcaacaccctgaatgatttcgacagccttggggagatgatgcaggagctgcctgaatttaagacgattaagcataacaaagcctaccggcccgataataccatctatcctctccgcgcttggattgagcacgaactgtccgccatcttcagcgtccaacagaagaacaatagacagattacagacaactttatcacccagtacctggatattttccggtctcaaagagacttcgatcagggaccggcggccccctcccgctttggcgggaatatgatcgagcggatggtgggacctgacagcctcgacgctcatgagaaaagagccgctaagctgacaaacaccttctttcgcttcaactttctttctacgctgaataacctcaaaatccagctgacacttggcgccgaatttcaccccctgaccacacctcaacgggagattgtgctccaggcggccaccctgaagtccctgaattataaacagatcagacacaagctccagctgcccgatagcgctcgctttaaccttgtcccgtaccaatctaatgaagaccctattaagaccgagtccaaacattacctgttcaagcggaaagccctcacacagatcgaagctgttacggataacccccagctgattgacaagatcgggaccatccttgcctattttaaaggagataagacaagacaggagaagctgagcgccctcaatctgtcccgcgctgagattaaacaactgctccctatcaaccagcccggcttcggcaatctgtctcttaagaccatgcacaaaattctgccctacctcgaacaggggcatctgtatcacgaggcggcccagctggctggatacgactttcaaaacaatcttgtggatcggcagtatctcagagacaacctgaagaatcctgtggtcaaccgcgccatcggcaaaacaattaaggtggttaatgccatcatcaagaaatacggggatccggacgctattcacatcgaactgacccgggagattaagcatagccacgaagagagacagaaaatcgcccggcagatgaacacgaacatggatcaaaatgacaaggtggcggagcatctccgcgaaaacggcattcccgtcaatggacagaacatcattaaatccaagctgttctatgagcagaaggggatcgacctttacagcggacaacagatcaatgaacaggatctgtacacagaggaccactatcaggtggatcatattatcccttactctatttcctttaacgacagcttcaccaataaaaccgttacaagaacctctaacaatcaaaacaaggctaatcggctccccctggaatatctgagcgaggagaaacaggatgccttcagagcccgcgtgatgtccaacatctctaattaccggaagagacagaaccttctcaaagaaggcattacagaggacaatcgccagcaatggaagacgagaaacatcaacgataccggctatatcaatcggctgctgagccagtacctccgcaacaatgtccagtttacaaagaagtcccacaaccctgtgttcaccgtcaatggggctacaaccgcctatattagaaagcggtacggaatcattaaaaaccgccaggctacggacctgcaccatgccgtggatgcggttatcattggctgcatcagcaatacctttgtgtctagacttgccaagtactccgaagctcaagaggcccggtatcacaaacagctgtggcagatcacacaataccgccaggagcataaggacctcagcaccattgaatatcaggagctgatcaaacagttccccctgccgtggcctgattttagacacgaacttatggctcggctctctacagaccccgccaagatgatggcgcaccatacctgggagcactacacggatgaagagatttcccaactgaagcctgccttcgtcatccgcagcgctaaccataaagtgacagggtccgcccacgacgacaccatttattctaagaaactgtacgatcagagaggagttggcctcctgcggacaagccttcagaatctgaagtatgactccaaaaaggatgggatcaagaactacgagagactcaaagacggctctaatagcctggtgtacgattccctgcttcgcgctctcaaggaacatgacggaaacgccaaaaaggcctttcccgataatcagctgctgatcagcaccggcaaccaccaacagattatcacccacgtcaaaacagtgaagaagattacgcatcctatcgaggtgaatcgggacaccgctattgcgatcgggggaagaatgattcgcgttgatatcttcaaacaggccaaggctcagaaactcatcggcattcccgtctatgtgaacgacacagtgaagccgaccctgcctaaccgggcctgtacatctgggaaaagatactccgattggtatcaacttacccgccaggaccagtttctgtgcagcctcgtctctaatgatctggtgctggttgaaacggccagcccccttaaggtgacaaacaatatcaccaacgaggaagtccagaccacacaactgctctgttacttctcctcttttaatattgctaacgcccagatcaatttccacagcattaacaatgactccagcatcaaccccatcgtgctgaataaagttacctatctcacaaagtaccagctggactatcttggaaactactttcctgtgaagcatgagtctcggaaaacgttcaatagaaagcgctga

SEQ ID NO: 3857 - RNA, 3237 nt, synthetic construct
  misc_feature 1..3237: note = Cas9 variant
  source 1..3237: mol_type = other RNA
atgcacaccagactggccctcgacatcggcacaacgagcattgggtggatcctgtacgagcttgtgaacggacagcccgcttccattctggatggcgggacccggatcttctctgacggacgcgaagccaagacaggccatagcctcgcggtcgggagacggaccgctcgcggaatgagacggcgcagagatcggtatctgcgcagacgggccgcccttatgaaacgcctggctgccattggcctcatgcctgagtccccggaagctgccgcgcaactggccacactggacccctacgagctcagagctcggggcctggatcaccctcttccccctgaacatctggggcgcgccctctttcacctgaatcagagacggggattcaagtctaacagacgcaccgacaaaggcaataacgaagggggaatgatcgctgatgccagcgcgcggcttgagcaggccatgatggctgccggcgctagatcctatggggaatttctgcataagcgccgggccgaggccacagctcccagagcgacccctgccgttcgcacgcggatcaatccgcacctcaccggagaagacggcaaagagcagcccggctacgatttctatcctgacagaaagcacctggaggatgaatttcatcgcctgtgggaggctcaagcccggcacaaccccgacctcacacccgccatgggggatctgcttttccagaccatttttcatcagagacccctgaaggctccggccgtgggacgctgcctcttcctggacgaacctcggcttcccaaagcgcaccctctgacacagcaaagaaccctctacgagacggtgaatatgctgcggatcgctcctcccggccagcctaagcgcagactgtctcgggtccagagagaccagattgtgcacgccctcaacaatcgcaaaatcctggccagcccggggaagaacgttcttacactggctgccattggaaaactcctgaaacttcggcccggcgaggctttttccctggataccgccaatagagacgcgatcgcctgtgatcctgtgcgcatgagcctcgcttatgaggggagattcggaccccaatggtctgccctgtccgtcgagagccagtgggaactgattcagcggctccgcgacgatcaagacggcgctgccctggtggattggatcatggacagatacggctttgatcgggaccgcgcgagagccatcgctgatgcccctcttcccgaggggttcggacggctgggcgaaacagctacccgcgccgttctcgccgtgctgattgggggaaccacagagcaggaagtcctgacgtactctgaggctgtggcggcctgcggctgggaccattccagacttgggaccggcgaggtgctcgaccggctgccgtattacggacaggtcctggatcgccacgttctccctggcacagggagacccgaagacgatgagatcacccggtttggaagaattacaaaccctaccgtgcatatcggcctgggacaggtgaagcgccttgtcaataaggtgattgacgcttggggacggccccacgaaatggttgtggagctggccagagatctcaagatgagcgaagaccaaaaacgcaacctggccaaggtcaatgctcagaaccagcgggccgcggagatgagatctgctaaactgatcggcgatcttaagatcgaggacaacgggcgcaatcggggcattctcagagtgtgggaagagtccgccgccgatgttctgcatcgctgttgcccttatacgggagctcagatcagcgcctccatgctgttcgacggctcttgtgatattgaccacatcctcccctacagccggacactggatgacgggttcaacaatagagtgatttgccttaaatccgcgaaccgggaaaagcgcaatctgaccccgtgggaggcttggggaaacacccctaagtgggccgccatcgaggctaatctcaaaaacctgcctcccgccaaggcttggagatttgcccccgacgcgatgctgcggtatgaaggcgagcgcgatttcacagccagagctcttgtcgacacccaatacctcagccggctggccagagaatatctggagtgtctctacgctgaagatatcgacccggggccccactctgggaaaaagcctcgccggcccatttgggtggtcacaggcaaactgacggagcttctgagacgccattgggggctcaattccctgctgcctgatgcccaccggggcaccgccaaggctaagaacagacttgaccatcgccaccacatgatcgatgcggccgtggttggagctacagaccatgccaccgtgcagcggattgccaatatggctaaaggcaacgtcgagaatgggctcgaagatctggccggaacaatcctgcccccttggcccggcctcagagacgatctgaaggcgcgccttgagagaaccattgtgagccaccgggggaaccatggagctatcgacccggccgcccgcaaacagggcagagatacgacctctgggcagctgcacaatgacacagcttacggcctcaccggagaaacactgaagggcgttcctctggtggtcaaccggaaacccattgacatgcttacccctgccatgatcgataagatccgcgacccccatctgagcagatggctcacggcggtgacaaaggggaaagagggaaaggattttaaagctgccgtggaagccttccgggctcacccgggcccttatagagggattcgccgggttagactgatcgagcccgtcgaggtgattcgcatcaaggaccggaacggaagaccttacaaaggctataagggcgattccaatcaatgctacgaagtgtggtgtctccccgaccggaccctgacacaccatgtcgtgtctacctttgccgctcaccaggggcagaccggaaagccccatcctgccgcgaaacgccttgccagactgtataagggcgatatggttcggctcgaccgcagcaaattcgggtccgtgattgctacagtcgagaagtttgatagaaacggacagctggaactggtgccgcacaatgagggcaacgccgaccaacggtaccgcaaagataagagcgactctgttttcatcagacttcgggctgccacgtttatcgcctccggggctcgcagagtgattgtcgacgaaatgggacggatcagagatcccggccctggcaaacattga

SEQ ID NO: 3858 - RNA, 3240 nt, synthetic construct
  misc_feature 1..3240: note = Cas9 variant
  source 1..3240: mol_type = other RNA
atgaagtacggcatcgggctggactgcggaattaacagcgtgggctattgtatcatggagctcaattccgatgacgaacccaaaagaattgtccggctgaactctcgcatcttcaccgaggccgaaaatcctaaggatgggagctcccttgctgccccgagacgggaggcgcgcggactgagacggcgcattagacggcacaaacatcgcctcgaaagaatccgggctctgcttgttcgcgagaacatcgtgacacaggccgagctggacaatatgttttctggcacgctcagcgatatttacgaactgagaaccgccgctctggacgctcccctcaacaatatcgagttcgcccgggtgctgattaaccttgcccaacgcagagggtttaagtccaatcggaaatctgaaaagagctccagcgataaggagacaggaaaactgctctctgcgatcaagaaaaacaaggagtccattgaagccggcggctatagaaccgtcggggagatgctgttcaaagacgaacgctacgctaagcacaagcggaataaaggagaggcctatcttaacacagtgagcagagatatgatcgaagctgagattcatgccgtttttgcgtctcagcgcaatttcggcatgccttttgccaacgagaagatcgaaaatgagtacaccgacatcgctctgtcccagcggcccttcgatctcgggcctggagaaggccccgagaactgcaaaagcccttatgccgggaagcagattaaaaacatgatcggacaatgtacatttttcccggaagagaagagagctgtgaaagcctcttactcctttcagctgttcagcctgctccagggcattaataacatcaccctggtctcctctgacggcaatacgtttccccttagccaggagcaacgcaagaccctgaaggattactgcttcaaaacagccaacgtgacctatgcttccattcggaaggttctccagatccctcaggaatacacattcaaaaatatcacctatacggacgacgggattgaaaagagcgaaaagaagacaaagtttcagcacctgaaaccctaccatgagatgaagaaagtgcttggatctgcgatccaaaccctgacacctgaggagctcgatgagattggcgaaatcttcaccttttataaggacgagaccattatcatcaaacagctggaagagacagagattgataagtccctgtacgacctcctgcttcagctgcccacgttcgaaaaggccgggcacatcagcaccaaggcttgtaagatgattatcccgtttctcgaggaaggaaaaacatatgataaggcctgcgagtgtgccggcctgaacttcaaagctcacaccaatatgcaaaagcagatgcttctgcctgccaagtctgacgaactcaacgatgtcgtgaatcccgtggtcagacgcgcgattagccagacaatcaaagttgtgaacgctattatccgggagatggggacctcccctacgtacatcaatattgagctggccagagaactgtctaagagcaaaaaggagcgcgacgaaatcaacaaaaagtacaaactcaatcaggccgagaacgaacggctgaagaatgagattatcgataactttaagattaaacccaacggacaagacatcatcaaacttaaactgtggcatgagcaggatgacggcatttgcccctatacaggcgtgagaatcaagtacgaaaatctcttcgacgatgggtatgctgagattgaccacatcattccttactccctgagctttgatgactctttcaacaataaaatcctgaccaccgccacacagaaccggcagaagggaaatcgcatcccgcttgaatatctccccgagtccgaaaaggatggctttagagtctgggtgaacagcaatattcggaaccatagaaaacgccaaaatctgctgaaggagcacttcaccgaggctgacaaaaaggaatttaaatctcggaacctcaatgatacaagatacctgaacaaacttctgctcaattatatcaacgacaatctgctgttcacggatttctacaacgggaagaaaaagcacgttacctccgtgaacggagccgtcacagcgtacattcgcaaaagatggggcatcaataagaaccgggaggacggggatcttcatcacgccgtggacgctgccgttattgcttgtgtgacccagggcatcatcaatcgcattacagcctatagcgcgagaaacgaagccccttacgatctcaataccgagacgggagagatcaaagaacggtttcccctgccttatcccaacttcaagaaggagctggacgctcgcaccacaattgaagacgagaaaagactcaagcgggtcctgatgtccttttctaattacagctatgatgacgtggaaaaagccaagccgtgcttcgtctcccgcacccctcatagaaaagtgacaggcgctgcccacgaggagaccatccggtctgggaaggttgaaggatttacggtgagcaaaacagagcttaccaagctgaagctcacaaacggcgaaattgaggggtactatgaacccgagtccgataccctgctgtacaatgcccttctccagcgcctgaacgagttcggaggcgacgctaaagcggcctttgctgatgagttccataagcctaaagccgacgggacccccggccctgtcgtgaagaaagttaagacaatcaagagatctagctccaatgtgaaagcccggaacaagaatggactgggcgtcgctgataacgggagcatgattagaatcgacgtgttttacgtggaaaatgaaggatattacttcgttcccatctatgtcgccgatacggtgaaagagatgccgaacgaagcgtgtccttttggcaaggacaaaaagaagattatgaccgatgacgatttcctcttttctctgtaccccaacgaccttatcaaaattacagctaagaaagacatgaagttctccctggccaataaagagagcgggctccccaagaacaagtatgccaatgaggtgctggtctactattctgctgccgatatcagcaacgcgtccattagcgtgatcatgcacgacaatgcttacaaattccgcggatgcggcatcaagtctctggttaaacttgaaaagtacaccgtggatcctctcgggaacgtctccaaagtgaatcgggagaagagaatgtattttaagtga

SEQ ID NO: 3859 - RNA, 3240 nt, synthetic construct
  misc_feature 1..3240: note = Cas9 variant
  source 1..3240: mol_type = other RNA
atgagactgggcctcgacatcgggaccagctccattggatggtggctgtacgagacagatggcgccgggtctgacgctcggatcacgggagtggtcgatggcggggttcgcattttcagcgacggaagagatcccaagtccggcgcctctcttgcggtggaccggcgcgctgccagagccatgcggcgcagacgggatcgctatctgagacggcgcgctaccctcatgaaagtgctggccgaaacaggccttatgcctgctgacccggccgaggcgaaggccctggaagctctcgatccctttgccctgagagctgccgggctggacgagcctctccccctgcctcaccttggacgggcgctgttccatctcaaccagcgcagaggctttaaaagcaatcggaagaccgatagaggggacaacgaatccggaaaaatcaaggatgccacagctcgcctggacatggagatgatggccaatggcgctcggacctacggggagttccttcacaagagacgccaaaaagccacagacccccggcatgtcccttctgtgagaacccgcctgagcattgccaaccggggaggcccggatggcaaggaagaggctgggtatgacttttaccccgatagacgccacctcgaagaggagttccataaactgtgggcggcccagggagctcaccaccctgaactgacggagaccctccgggacctgctttttgaaaagatcttctttcagagacccctgaaagagcctgaagttggcctctgcctgttctccgggcatcacggagtgcccccgaaggatcctcgccttcccaaggcccatcctctgacacagcggagagtcctctatgagaccgtgaatcaactgcgggttacagccgacggccgcgaggctagacccctgacccgggaagagagagatcaggtgatccacgccctcgacaacaaaaagcccacgaaaagcctgtcttccatggtccttaagctgcctgcgctcgctaaagtgctgaaacttcgcgatggggaacggtttacactggagaccggagtgagagacgccattgcctgtgatccgctccgcgctagccccgcccaccctgacagattcggcccccggtggtctatcctggacgctgatgcccagtgggaagtcatttcccgcatcagacgggttcagagcgacgcggagcatgccgctctggtggattggctcacagaggcccacggcctggaccgcgctcatgccgaagcgaccgcccacgctcctcttcccgatgggtacggaagactgggcctcaccgccacaacgcggattctgtatcaactgaccgctgacgtggtcacatacgccgatgccgtgaaggcttgcgggtggcatcactctgacggacgcaccggcgagtgttttgatagacttccgtactatggggaagttctcgagcggcacgtgatccctggctcctaccatcccgacgatgacgatattacacgcttcggaagaatcaccaatcctacggtccacatcggcctgaaccagctgcggagactcgtgaatcgcattatcgaaacacatgggaagccccaccagattgttgtggagctggcgcgggaccttaagaaaagcgaggaacagaagagagccgacatcaaacgcattcgggataccaccgaggctgccaagaaaagatccgaaaagctggaggagctcgaaatcgaggacaacggacgcaatcggatgctgctgagactttgggaagatctcaaccctgacgatgccatgcgccggttctgcccctatacaggcaccagaatctctgctgccatgatttttgacgggagctgtgatgtcgaccacatcctgccgtactcccggacactggatgacagcttccctaatcgcacgctctgcctgagagaggcgaaccggcaaaagcgcaatcagaccccctggcaggcttggggagatacaccccattggcacgccattgccgctaaccttaaaaacctgcctgaaaataagagatggcggtttgccccggacgcgatgaccagattcgagggcgagaacgggtttctcgatcgcgctctgaaagacacacaatatctggcccggatctctagatcctaccttgacaccctcttcacgaagggcggacatgtgtgggtcgtgcccggccgctttaccgaaatgctgcggagacactgggggctgaatagcctcctgtctgatgccggacgcggcgctgttaaagccaagaaccggacagaccatagacaccacgctattgatgccgcggtgatcgccgctaccgaccctgggcttctgaatcgcatcagcagagccgctggacagggcgaggccgccgggcagtccgctgaactcattgcgcgggatacaccccctccctgggagggcttccgcgacgatctgagagtccggctggaccgcatcattgtgtctcatagagccgatcacggacggatcgaccatgctgccagaaagcagggccgcgatagcaccgccgggcaacttcaccaggaaacggcttattccattgttgacgacatccatgtggccagccggacagatctcctgtctctgaaacctgcgcagctcctggacgagcccggaagatccggccaggtccgcgatccgcaacttcggaaggctctgagagtggccaccgggggaaaaacaggcaaggactttgagaacgccctccggtacttcgctagcaaacctgggccctaccaggccattcgcagagtgcggatcatcaagcctctgcaggcgcaggctcgcgttcccgtcccggcccaagatcctattaaggcctatcagggcggatctaatcacctgtttgaaatctggagacttcccgacggcgagattgaagctcaggtgatcacctccttcgaggcccacaccctggaaggggagaaacggcctcatcccgctgccaagcgcctcctgagagtgcacaaaggagatatggtcgcgctcgagcgggacggccgcagagtggttgggcatgtgcagaagatggatattgccaacggactgtttatcgtcccccacaatgaagctaacgccgacacacggaataacgataaaagcgaccctttcaagtggatccaaattggcgctagaccggccatcgcctccggcattcgccgggtgtctgttgatgagatcgggagacttcgcgacggaggcacgcggcccatttga

SEQ ID NO: 3860 - RNA, 3240 nt, synthetic construct
  misc_feature 1..3240: note = Cas9 variant
  source 1..3240: mol_type = other RNA
atggacgaggaagccaagatccagctgagcaaagagtcctacgaagaggaactcgagtctctgcttgaaaagagcggcgaagagttcagagatgtgtttctgcaagctaaaaaggtctatgacgccattctcctgtccgatatcctttctaccaaaaagcagaacagcaaggcgaaactgtccctcgggatgattgaacggtacgactctcacaagaaagatctggaggagctgaagcagttcgttaaagctaatctccccgaaaagacagccatctttttcaaggacagctccaaaaacggatatgccggctacattgatgggaagacgacccaggaggacttttataaattcctgaagaaagaacttaatggaatcgctggcagcgagcgctttatggaaaaggtggatcaagagaacttcctgctcaaacagagaacaaccgccaatggggtgatccctcatcaggtccacctgacagagcttaaggctattatcgaacggcagaagccgtactatccctttctggaggaagcccgcgacaaaatgattagactcctgaccttccggatcccttactacgtgggacccctggcgcaaggcgaggaaacatcttcctttgcctggctcgagcgcaagacccctgagaaagttacgccctggaacgctaccgaagtgattgattatagcgcctctgctatgaagttcatccagagaatgattaattacgacacatatctgcctaccgagaaagtccttccgaagcattccatcctgtaccagaagtatacaatctttaacgaactcaccaaagtggcctacaaggatgagcggggcattaaacaccagttcagctctaaggaaaaacgcgagatcttcaaggagctgtttcaaaagcagagaaaagttacggtgaagaaacttcagcaattcctgtccgcgaattataacattgaagacgccgagatcctcggggtcgacaaggcttttaatagctcctacgccacataccatgatttcctggacctggctaaacccaacaccgaacgggtggccgagctcctggagcagcctgaaatgaatgccatgtttgaggatattgtgaagatccttacaatcttcgaagaccgcgagatgattagaacccagctgaagaaatatcagtctgtcctcggagatggctttttcaagaaactggttaagaaacactacaccgggtggggacggcttagcgaacgcctgatcaacggcattagagacaagaaaacaaataagacgatcctcgattatctgattgacgatgacgattttccctacaaccggaacagaaatttcatgcaactgatcaacgacgactccctcagctttaaggaggagctggctaatgaacttgcgctggccgggaaccagtctctcctggaggtggtggaagctctgcctggatcccccgccatcaaaaagggcatttggcagacccttaaaatcgtcgaggaactcattgagatcattggctataatccgaagaacatcgtggttgagatggcccgcgaaaatcagcggacaaacagaagcaaacctcgcctgaaggctctggaggaagccctcaagtctttcgatagccccctgcttaaagagcaacctgtggacaatcaggcgctgcagaaggatcggctctacctgtattacctgcagaacgggaaagacatgtacaccggagaagctcttgatattgacagactctccgagtatgatatcgaccacatcattccccgctcttttatcgtcgataatagcattgacaacaaggtgctggtttccagcaaagagaatcggctgaagatggatgacgtgcccgatcaaaaggtcgtgatcagaatgcgccggtactgggaaaaactcctgagagccaaccttatttctgagcgcaagttcgcctatctgacaaaactcgaactgacccctgaggacaaggctcggttcatccagagacagctggtcgagacgcggcagatcacaaaacatgtggccgctattcttgaccaatactttaatcagccggaagagtccaagaacaagggcatccgcattatcaccctcaaaagctctctggtttcccagttcagaaagacctttgggattcacaaagtgcgggaaatcaacaatcatcaccacgcccatgatgcgtatctgaacggagtcgtggccatcgctctcctgaagaaataccccaaacttgagcctgagttcgtttatggcaattacacaaagtttaacctggccaccgagaataaggctacagccaagaaagagttctacagcaacattctcagatttttcgaaaaggaggaatattcctacgacgagaatggggaaatcttttgggataaagcgcgccacattccccaaatcaagaaagtgatttctagccatcaggtcaacatcgtgaagaaggtggaggttcagacgggaggcttctataaagagaccgtcaatcctaagggcaaacccgacaagctgatccagcggaaagccgggtgggatgtgtccaagtacggaggctttgggtctccggtggtcgcttatgccgtggctttcatttacgaaaagggaaaagccagaaagaaagccaaggctatcgagggcattacaatcatgaaacaaagcctgtttgaacaggaccctattgggttcctttccaacaagggctatagcaatgttaccaagttcatcaaactctctaagtacacactgtacgagctggaaaacggacgcagacggatggtggcgtcccacaaagaggcccagaaggctaatagctttattctccccgagaaactggtcacccttctgttctatgcccagcattacgatgaaatcgcccacaaggagtcttttgactatgtgaacgatcacctctccgagttccgcgaaatcctggaccaagttattgattttagcaatagatacacgatcgctgccaagaacaccgagaaaattgcggaactgttcgagcagaaccaggaatctacagtgcagagcctttcccagagctttatcaatctgatgcaactcaacgctatgggcgcccctgccgacttcaagtttttcgatgtcattatcccccggaaacgctatccttctctgaccgagatctgggaatccacaattatctaccagagcattaccgggctcagagagacgcggacacgcatggctaccctgtgggacggagagcaatga

SEQ ID NO: 3861 - RNA, 3240 nt, synthetic construct
  misc_feature 1..3240: note = Cas9 variant
  source 1..3240: mol_type = other RNA
atggacgaggaagccaagatccagctgagcaaagagtcctacgaagaggaactcgagtctctgcttgaaaagagcggcgaagagttcagagatgtgtttctgcaagctaaaaaggtctatgacgccattctcctgtccgatatcctttctaccaaaaagcagaacagcaaggcgaaactgtccctcgggatgattgaacggtacgactctcacaagaaagatctggaggagctgaagcagttcgttaaagctaatctccccgaaaagacagccatctttttcaaggacagctccaaaaacggatatgccggctacattgatgggaagacgacccaggaggacttttataaattcctgaagaaagaacttaatggaatcgctggcagcgagcgctttatggaaaaggtggatcaagagaacttcctgctcaaacagagaacaaccgccaatggggtgatccctcatcaggtccacctgacagagcttaaggctattatcgaacggcagaagccgtactatccctctctggaggaagcccgcgacaaaatgattagactcctgacctttcggatcccttactacgtgggacccctggcgcaaggcgaggaaacatccagcttcgcctggctcgagcgcaagacccctgagaaagttacgccctggaacgctaccgaagtgattgattattctgcctccgctatgaagtttatccagagaatgattaattacgacacatatctgcctaccgagaaagtccttccgaagcatagcatcctgtaccagaagtatacaatcttcaacgaactcaccaaagtggcctacaaggatgagcggggcattaaacaccagttttcttccaaggaaaaacgcgagatcttcaaggagctgttccaaaagcagagaaaagttacggtgaagaaacttcagcaatttctgagcgcgaattataacattgaagacgccgagatcctcggggtcgacaaggctttcaattcctcttacgccacataccatgattttctggacctggctaaacccaacaccgaacgggtggccgagctcctggagcagcctgaaatgaatgccatgttcgaggatattgtgaagatccttacaatctttgaagaccgcgagatgattagaacccagctgaagaaatatcagagcgtcctcggagatggcttctttaagaaactggttaagaaacactacaccgggtggggacggctttccgaacgcctgatcaacggcattagagacaagaaaacaaataagacgatcctcgattatctgattgacgatgacgatttcccctacaaccggaacagaaattttatgcaactgatcaacgacgacagcctctctttcaaggaggagctggctaatgaacttgcgctggccgggaaccagtccctcctggaggtggtggaagctctgcttggaagccctgccatcaaaaagggcatttggcagaccctcaaaatcgtcgaggaactgattgagatcattggctataatcccaagaacatcgtggttgagatggcccgcgaaaatcagcggacaaacagatctaaaccgcgcctgaaggctctcgaggaagcccttaagagctttgattcccctctgctgaaagagcaacccgtggacaatcaggcgctccagaaggatcggctgtacctgtattaccttcagaacgggaaagacatgtacaccggagaagctctcgatattgacagactgtctgagtatgatatcgaccacatcattcctcgcagcttcatcgtcgataattccattgacaacaaggtgctggttagctctaaagagaatcggctcaagatggatgacgtgcccgatcaaaaggtcgtgatcagaatgcgccggtactgggaaaaactgcttagagccaacctgatttccgagcgcaagtttgcctatctcacaaaactggaactgacccccgaggacaaggctcggttcatccagagacagcttgtcgagacgcggcagatcacaaaacatgtggccgctattctcgaccaatacttcaatcagcctgaagagagcaagaacaagggcatccgcattatcaccctgaaatcttccctggttagccagtttagaaagaccttcgggattaacaaagtgcgggaaatcaataaccaccatcacgcccacgatgcgtatctcaatggagtcgtggccatcgctctgcttaagaaatacccgaagctggagcccgaatttgtttatggcaactacacaaaattcaatctcgccaccgagaacaaggctacagccaagaaagagttttactccaatattctgagattctttgaaaaggaggaatattcttacgacgagaacggggaaatcttctgggataaagcgcgccatattcctcaaatcaagaaagtgattagctcccaccaggtcaatatcgtgaagaaggtggaggttcagacgggaggcttttataaagagaccgtcaaccccaagggcaaacctgacaagctgatccagcggaaagccgggtgggatgtgtctaagtacggaggcttcgggagccccgtggtcgcttatgccgtggcttttatttacgaaaagggaaaagccagaaagaaagccaaggctatcgagggcattacaatcatgaaacaatcccttttcgaacaggacccgattgggtttctcagcaataagggctattctaacgttaccaagttcatcaaactgtccaagtacacactgtacgagctcgaaaatggacgcagacggatggtggcgagccataaagaggcccagaaggctaactctttcattctgcctgagaaacttgtcaccctgctctatcacgcccagcattacgatgaaatcgcccacaaggagtcctttgactatgtgaatgatcacctgagcgagttccgcgagatcctggaccaagttattgatttttctaacagatacacgatcgctgccaagaacaccgagaaaattgcggaacttttcgagcagaatcaggaaagcacagtgcagtccctgagccaatcttttatcaacctcatgcagctgaatgctatgggcgcccccgccgacttcaagtttttcgatgtcattatccctcggaaacgctatccctccctcaccgagatctgggaaagcacaattatctaccagtccattaccgggctgagagagacgcggacacgcatggctaccctttgggacggagagcaatga

SEQ ID NO: 3862 - RNA, 3243 nt, synthetic construct
  misc_feature 1..3243: note = Cas9 variant
  source 1..3243: mol_type = other RNA
atgaagaccagcttcgcctttgacatcggcacaaactccattgggtggtgcgtgctggctctcgataatgccaacctgccctacagaatccttgacgcgggagtccggattttctctgatggccgcgagcctaaaagcgggacgtccctggctgaaggaagacggctcgcccgcggcatgtctagacggcgcgacagatataagcggcgcagaaaagccgttatccggaccctgattgagtacgggcttatgccggatgaccccgctgcccgcagagctctggtggccgaaacaaatgataaggcgcctggaaaaatcgccagcgacgtgtatgctctccgggcccgcgctctggatgacaagctgcccctccaccatatcggcagagccctgtttcacattaaccagcggagaggcttcaagtccaatcgcaaaaccgataagcgggacaacgatcaagggaaaatcgcgtctggaattagcagacttcgcgacaagctggcctccgagggcatgcggacactcggggaatacctgaatcatagacaccaggctggaaactgggtccgcgtgcggcctagcagagttcccggcaaagacgataaggaggaggacgggtatggattttaccctgaacgcgcccttctgcaggatgagttcaatgctatctggaccgcccaggccgctcattatccggacgtgctcacagaagaacggagaacccacctggagacgattatctttttccaacgccccctgaagcctgtccaggtgggcaaatgttcttttaaccccggcgaggagcggctccctagagcgcaccccctgttccaggaatttcggctttacaaggaggttaatgaactggagctcgtggatcgcaaccaggaccatcacaaactgtcccttgatcaaagagacgccctgattgctcagctcaagacccagcgggaggccgcctacagcgctctgagaaaaacagcccgcgcgccgctggggacccggttcaataaggaaacagagtctagaaccaaaatgaagggagatgaagtcgctgccgagctctccgccaagacgcgctttggccaggcttggatcagcatgcctctggaagagagatggatcattgtggacacacttcggcgcgtggaggatcccctggaactcaccgcctggctggagcaacattatgggcttgacggagaacacatcgacgctattctggccgcgagactccctgagggctacgggcggctgggagaaacagccctgaccgagatcctcgtcgagctgaaagctgccgttatttctgaagctgaggccgcgcgcagagccggctatgatcacgcccttctgcagcggggcgccgggctcgaagctctgcccaagtaccaggaggtgatcgcccgcagaatccctcccggaaccggcaacccggacgatccctatgacgtggagaaagggcggattacaaatcctacggtccatatcggactgaaccaacttcagaaggtgctcaacgccctgattcgcagatacggcaaacccgaacagatcgctattgagctggcgcgggaactcaagctgaatgatgagcagaagagagaaaagaacatcgagatcgcccgcaatacccgggctgccgagcaaagatccgccaaacttgttgaactgggggtgcctgacacaggctataaccgcgtcctcctgaaactgtgggaggaacttaatctccgggctcccgagaacagagtgtgcatttactgtggagaaccgatcaatattgagaccctgttcagctccgccgttgatatcgaccacattctgccttggtctaagacactcgatgacagccaggcgaaccgcctggtgtgccatgtcgcttgtaatcggcagaaagccaactacgcccccgctgaggtgcctcagtggcaaggcagatatgatgacatccttgcccgcgcgaataccctgcccctcaacaagcggtggagattcgggcgggatgctatgaagaaatttgccgacgaagagacgttcctggcccgccagctgacagacacccagtacctttccagactcgctcacgcctatatggctgccctgtaccctgatgaggaacccgacgcgcagggagtcctggcccggaagaatcatgtgcgcgttattaccggcagaatgacagaaatgctccggagacaatgggggctgaacagccttctggctgatcacaatcagaaaaaccgcaacgaccaccggcatcacgccatcgatgctgccgtggtcggagtgaccacaagagccctcctgcagcgcatcgctacggttgcgggcgggcgggaggcccaggctctggaggaaaccattggcaagatcgagccgccttggcccggatttagagacgaacttcaagccgtgattaaacgcatcgtcgtgtctcataagcccgatcacggcacactccctaagccggggcagggaggccagaccgccgggcaactgcacaatgacacagcttatggactgaccggcgagacggattcccgggggacccccattgtggttagacgcaaacctttcacaagcctcaccgagaaggacctgccctctatcagagatcggcagcttgcccaggcgctgggcagcgctatcgccggacgctccggcaaagaactccaggccgctctggagcaatttagagaccgggatgactacaagtctattcgccatgtcagagtggtggaacctctgaacgtcatccccattcgggacgggacaggcagagcctataaagcgtacaagggagatgctaattaccgctatgacgtgtgggagcttcctaacgggaaatggatgcacgaagttgtgagcatgttcgatgcccatgaccggtcctggaccagcgccgtccacatccatcaccccgctgccagacgcgtgctgtctctcaagcagaatgatatggttgcttacgaccacccgcaggatggacctacgattggccgggtggtcaagttttcccagagcgggcaaatgacattcgctccccataaagaggcgggcgccctgaaggctagagacgccgatcctgaggaccggtttcgctatttctacaaatctggatccgctatgaaggatatcggcctcagacaggtgcgggttgacgaaatcgggcgcgtgtttgaccccggaccgagagataaagaggcccggaacgcccgcaagaagaaaagcaccgactga

SEQ ID NO: 3863 - RNA, 3243 nt, synthetic construct
  misc_feature 1..3243: note = Cas9 variant
  source 1..3243: mol_type = other RNA
atggccaagagcttcgcttttgacatgggcaccaactccatcgggtgggccgtgctgggactcgattctgcgggcgaccccgatagcattgagggggctggagtcagaatcttctccgacggccgggaacctaaatctggggccagcctggccgagggacgcagaattgctcggggcatgtcccgcagacgggaacgctacaaggccagacggaaagctcttatccgcacactgggcgattatgggctcatgccgctggagagagccgcgcggcgcgcccttgttgctgaaacgaatgacagatcttttggactggtggcccaggatgtgtacgctctccgggcccgcgcgctggtcgagaagctgcccccttatcacctcggcagagccctgttccatcttaaccaacggagagggtttaaaagcaatcgcaagaccgacggacgggataacgagctgggcatgattgctacagggatcgccgctctcgacgcccagctgaatggaagaacccttggccagtacctgcacgaaatgcgcggcgccgatccccggcagagagggcaagtgcgcgttcggcctcatctcgagatcaacgacaagggaagagaaattgctgcgtatggcttctacccccagcgcgccatgctggagcgggagtttaatgctatctgggccgcccaggctcctcaccatccggaactgctctccgaggaaagacgcgcccacctgttccaggtgatcttttatcaacggccccttaaacagcctgatcccgggagatgcagcttcaaccctgcggagccccggctggctaaggcccacccgctctttcagcgcttcagactggtcaaagaaattaatgagcttcggattgtgacaggatctaactcccagggcgttcctctgaccctcgagcaaagagacatcctgctgacactcctgcgcgacaagaaagccagctcttttaagacccttctggctaagattatcaaagggcagcccgaagcccggttcaataaggcttccgatagcagagacaaaatgaagggagatgagctcgccgcgacgatgtctgacaaaacccgcttcggccaggcctggtttgctatgcctgaagccgagcaatggagaatcattgctaagctgcgggatatcgacgatccccttgaactgaacgcctggctcgagtccgagtacggcctggcgcccgaacgcagagacgccgtggctaatgccctgctccctcaggggtacggacggctgggcgagacagctcttagaaccatgctggattatctcgaagccgccgtcattagcgaggctgaagcggccgctcaggccgggtacgaccatgccctggctagacggggagccggcctggatcagcttccgaaatatcaagaggtgctcgggcgcagaatccctcccggctccggagagcccaacgacccttacgacattcggatgggccgcatctctaatcccacagtgcacatcgcgctgaaccagctgagacgggtcgttaacgctctcattagaaagtatgggaagccggccgaaatcgccattgagctggctcgcgatcttaaactgagcgaagaacagaagcgggaggtgaatgccaccatcgcgaaaaacacgagagacgctgaacgccgggccgtgagactcgccgatgagggaattgacaatacaggccataaccgcgctctgctgcggttctgggaggagcttgccgctgatcctctcgacagagtctgtgtgtactgcgggggaggcatcggggccgcgtccctgtttaatggcagcgttgatatcgaccacattctgccctggtctcgcaccctcgatgactcccgggccaacagaatcctggtgcacaatagctgtaaccggcttaagcgcaatttcgctccttttgaagtccccgagtggagagagatttatcaggatatcctggtgcgggccgctaaactccctgccaacaagtcttggcgcttcgcccccgacgctatggatagatttgaaggagagaaggacttcctggcgcggcaactgacagacacccagtaccttgccagaatggctcatgaatacctcgccgccctgtatccggatgaggaacctgacgagtggggcgtttttgctcgcgggaatcacgtgcgggtcgtgcccggaagactgaccgagatgctccgccgggcctggggcctgaacgcgattcttagcgatgacaatcgcaaaaaccgcaatgatcatcggcaccatgctatcgacgccgtcgtggttggggtgacaacgagagatatgctgaacaagatttcccaggccgctggacgcggcgccgacatgggggcggctgatgccctcagacggttcgatcccccttggccgtcttttcaccaggccgtccgcgctgccgtggaaagaatcctggttagccaccgggctgaccatggcaccctgcccggaacagacggccaagggtccaccgccggacagcttcacaacgatacagcgtacggcctcaccggggagacgcgcaaaggactggccgtggtcgtgagacggaagccttatctgagcctcgaacccagagacatcgagacaattcgcgaccctcagctgcgggatcatcttgctaccgaaacctacggcctggccggggctgagttcacagccgccctcaaaagactgcagcaaaccgacaagttttatgctggcatccgccgggtgagagttacagaggcgctgtctgtcattcccatccgggatgccacgggacacgcttacaaggcctataaaggcgacgccaatttccgctacgatgtgtgggaacttcctaacgggaagtgggtgcccgaggtcatttccatgttcgacgctcacgatagaggatgggtgagccaggttcatgccgcgaatccggctgcccggcgcgtgctgtctctcagacagaacgacatggtcgcctaccaacaccctgaacagggcctggtgtatgggcgggttgtgaaatttggacagtccggccagatgaccttcgctgcccatcacgagggcgggagcctcaagtcccgcgatgcggacagagatgacccctttaaatacttctataagtctgccggaacaatgaaggacatcggcctgcggcaaatccgcgtcgatgagattgggagagtgcaggaccctggaccccaggatcgggacagcaaaagagttcgcaagtccgatcggtga

SEQ ID NO: 3864 - RNA, 3246 nt, synthetic construct
  misc_feature 1..3246: note = Cas9 variant
  source 1..3246: mol_type = other RNA
atggccgctttcaagcccaaccctatcaattacattctgggcctcgacatcgggattgccagcgtgggatgggcgatggtcgagatcgatgaagacgagaacccgatttgcctgatcgatcttggcgttagagtgtttgaacgggctgaggtgcccaaaaccggggactccctggccatggcccgcagactcgctcggtctgtccgcagactgacacggcgcagagcccaccggcttctgcgcgctagacggctcctgaagcgcgaaggagtgctgcaggccgcggatttcgacgagaatggcctcatcaaaagcctgcctaacacgccctggcaacttagagccgctgccctggatcggaagctcacccctctggagtggtccgctgttcttctgcatctcattaaacaccgcgggtatctgtctcagagaaagaatgaaggagagacagccgacaaggaactgggcgcgctcctgaaaggcgtggccgataacgctcatgcccttcagaccggggactttcggacacccgctaagctggccctcaataaattcgagaaggagagcggacacatcagaaaccagcgcggcgattactcccataccttttctcggaaagacctgcaagccgaacttaatctcctgttcgagaagcagaaggaatttgggaaccctcacattagcgatggactgaaagagggcatcgaaacactgctcatgacccagagaccggctctgtccggggacgcggtccagaagatgcttggacactgtacgttcgagcccaccgagcctaaagccgctaagaatacatataccgccgaacgctttgtgtggctgacaaaactcaacaatctgcggattcttgagcaaggcagcgaacagcccctgaccgacacgcagagagccaagctcatggatgagccttaccgcaaatctaagctgacatatgctcaggcccggaagctgctcggcctggaagacaccgcgttctttaaagggcttagatacggaaaggataacgctgaggcctccacactgatggagatgaaagcctatcatgctatcagccgcgccctcgaaaaggagggcctgaaagacaagaagtctcccctgaatctttccccggaactccaagatgagattgggaccgctttcagcctgtttaaaaccgacgaagatatcacaggacggctgaaggacagagttcagcctgagatcctcgaggccctgcttaaacacatttctttcgataagttcgtgcagatctccctgaaagcgctccgccggattgtccccctgatggaacaaggcaagagatacaacgaggcctgcgctgaaatctacggggaccattatggaaagaaaaacacggaggagaagatttacctgcctcccatccccgccgatgaaatccggaatcctgtggtgcttcgcgctctcagccaggccagaaaagtcattaacggcgttgtgcggagatatggctccccggcgcgcatccacattgagaccgcccgggaagtggggaagtcttttaaagacagaaaggagatcgaaaagcgccaggaggagaatagaaaagaccgggaaaaggctgccgctaaattccaggagtactttcccaacttcgtcggagaacctaagagcaaagatattctgaagctgcgcctctatgagcaacagcacggcaaatgtctgtactccgggaaggaaatcaatcttggaagactgaacgagaagggctatgtggagatcgaccatgccctcccctttagccggacatgggatgactctttcaataacaaagttctggtgctggggtccgaaaatcagaacaagggcaatcagaccccttacgagtactttaacggaaaagataatagccgcgaatggcaagagttcaaggccagagtcgaaacatctcggtttccccgcagcaaaaagcagcggattcttctccagaagttcgacgaggatggctttaaagagagaaacctgaatgacacccgctatgtgaacagattcctgtgccagtttgttgctgatcggatgagactcacggggaagggcaaaaagcgcgtgttcgcgtccaacggacaaatcacaaatctgcttcgggggttctggggactgagaaaagtccgcgccgaaaacgaccggcaccatgctctcgatgccgtggtcgtggcctgttctaccgttgctatgcagcagaagattaccagatttgtgcgctacaaggagatgaatgccttcgacggcaaaacaatcgataaggaaaccggggaggtcctgcaccagaaaacacattttccgcaaccttgggagttctttgcgcaggaagtgatgattcgggttttcggcaagcccgacggaaaacctgagtttgaagaggctgacacgcccgaaaagctgagaacccttctcgccgagaagctgagctcccgccctgaggccgtgcacgaatatgtcacacccctgttcgtgagccgggctccgaacagaaaaatgtctggccaggggcacatggagaccgtgaagtccgccaaacggctcgatgaaggagttagcgtcctgcgcgtgcctcttacacaactgaagctcaaagacctggagaagatggtgaatagagaacgggagcccaaactgtacgaggcgcttaaggctcgcctggaagcccataaggatgaccccgccaaggcttttgccgagcctttctataaatacgataaagctggcaacagaacccagcaggtcaaggccgtgcgggttgaacaggtgcagaaaacgggggtctgggtgagaaatcacaacggaatcgcggacaatgccaccatggttcgcgtggatgtctttgagaagggcgacaagtattacctcgtgccgatttactcttggcaagttgctaaagggatcctgcccgatcgggccgtggtcgcttatgccgacgaagaggattggacagtgatcgacgagtccttcagatttaagttcgtgctctacagcaacgatctgattaaagtccagcttaagaaagactccttcctgggctatttttctggactcgaccgcgccaccggcgctatcagcctgcgggaacatgatctggagaagtccaaggggaaagacggaatgcacagaattggcgttaagacagcgctttctttccagaaataccaaatcgatgaaatggggaaggagattcgcccttgccggctgaaaaagagaccccctgtgcgctga

SEQ ID NO: 3865 - RNA, 3246 nt, synthetic construct
  misc_feature 1..3246: note = Cas9 variant
  source 1..3246: mol_type = other RNA
atggccgctttcaagcccaaccctatcaattacattctgggcctcgacatcgggattgccagcgtgggatgggcgatggtcgagatcgatgaagacgagaacccgatttgcctgatcgatcttggcgttagagtgtttgaacgggctgaggtgcccaaaaccggggactccctggccgccgctcgcagactcgcccggtctgtccgcagactgacacggcgcagagctcaccggcttctgcgcgccagacggctcctgaagcgcgaaggagtgctgcaggcggccgatttcgacgagaatggcctcatcaaaagcctgcctaacacgccctggcaacttagatccgctgccctggatcggaagctcacccctctggagtggtctgctgttcttctgcatctcattaaacaccgcgggtatctgagccagagaaagaatgaaggagagacagccgacaaggaactgggcgcgctcctgaaaggcgtggccgataacgctcatgcccttcagaccggggactttcggacacccgctgagctggccctcaataagttcgagaaagaatccggacacatcagaaaccgccggggcgattactctcatacctttagcagaaaggacctgcaggccgagcttgatctcctgttcgaaaaacaaaaggagtttgggaatcctcacatttccgacgacctgaaggaaggaatcgagacactgctcatgacccagcgcccggctctgagcggcgatgcggtccagaaaatgcttgggcactgtacgttcgagcccaccgaacctaaggccgctaaaaacacatataccgccgagcggtttgtgtggctgacaaagctcaataacctgcgcattcttgaacagggatctgagagacccctgaccgacacggaacgggccacactcatggatgagccttacagaaaatccaagctgacctatgctcaagcccgcaaactgctcgagctggacgatacagcgttctttaagggccttcggtacggcaaggacaatgctgaagccagcaccctgatggagatgaaagcctatcatgctatctctagagccctcgaaaaggaggggctgaaagataagaaaagccccctgaaccttagcccggaactccaggacgagattggaaccgctttctctctgtttaagacagatgaggacatcacgggccgcctgaaggatcgggttcagcctgaaatcctcgaggtgctgcttaaacacatttccttcgacaagttcgtccagatcagcctgaaagccctcagacggattgtgcccctgatggaacaagggaagcgctacgacgaggcgtgcgccgagatctacggagatcatgacggcaaaaagaataccgaagagaagatttatctgcctcccatccccgctgatgaaatcagaaaccctgtggtccttcgggccctctcccaggctagaaaagttattaacgccgtggtgcgccggtacgggtctccggcgagaatccacattgagacagcccgcgaagtcggaaagagctttaaagacagaaaggagatcgagaaacggcaggaagagaatcgcaaggatagagaaaaggctgccgctaaattccgggagtattttcccaacttcgtgggcgaacctaagtccaaagacattctgaagctgcgcctctacgagcaacagcacggcaaatgtctgtatagcgggaaggagatcaatcttggaagactgaacgaaaaaggctacgttgagatcgatcatgccctccccttttctcggacctgggacgattccttcaataacaaggtgctggtcctggggagcgaaaatcagaacaagggaaatcagacaccttatgagtactttaacggcaaagacaattctcgcgaatggcaagagttcaaggccagagtggagaccagccggtttccccgctccaaaaagcagcggattcttctccagaaattcgatgaagaggggtttaaggaaagaaacctgaatgacacgagatacgttaaccgcttcctgtgccagtttgtggctgatcacatgctcctgacaggcaagggaaaacggagagtcttcgcgtctaatggccaaatcaccaaccttctgcgcgggttctggggactccggaaggtgagagccgagaacaatcgccatcacgctctggacgccgtcgtggttgcctgtagcaccgtggctatgcagcagaaaattacacggtttgtcagatataaggagatgaacgccttcgacggcaaaaccatcgataaggaaacaggggaggtgctgcatcagaagacgcactttccgcaaccttgggagttctttgcgcaggaagttatgattcgcgtgttcggaaaacccgacggcaagcctgaatttgaggaggctgatacccccgaaaaacttcggacactcctggccgagaagctgtccagcagacctgaagccgtccacgagtacgtgacacccctcttcgtgtctcgggctccgaatcgcaaaatgtccgggcagggccatatggaaaccgttaagagcgccaagagactggacgagggagtctctgtgcttcgggtgcctctgacccagctcaaactgaaggatctggagaaaatggtcaaccgcgaaagagagcccaaactttatgaagcgctgaaagctcggctcgaggcccacaaggacgatcccgccaaggcttttgccgaacctttctacaagtatgacaaggctggcaatagaacgcaacaggtgaaagccgttcgcgtggagcaggtccaaaagaccggggtgtgggttcggaaccataatggaatcgcggataacgccacaatggtgagagtcgacgtgtttgagaaagctggcaagtactatctggttccgatttactcctggcaagtggccaaagggatcctccccgatcgcgctgtcgtggcctacgccgacgaagagggatggaccgtgatcgatgaatccttccggtttaagttcgtcctgtattccaatgaccttattaaggttcagctgaaaaaggactctttcctcggctactttagcgggctggatagagctacaggcgcgatctccctgcgcgagcacgaccttgagaaatctaagggaaaagatggcatgcaccggattggggtgaagaccgccctgagcttccagaagtatcagatcgacgaaatgggaaaagagattagactctgccgcctgaagaaaagacctcccgtgcggtga

SEQ ID NO: 3866 - RNA, 3246 nt, synthetic construct
  misc_feature 1..3246: note = Cas9 variant
  source 1..3246: mol_type = other RNA
atgaccgccttcaagcccaaccctatcaattacattctgggcctcgacatcgggattgctagcgtgggatgggccatggtcgagatcgatgaagaggaaaacccgattagactgatcgaccttggcgttcgggtgtttgagcgcgcggaagtgcccaaaacaggggattccctggctgccgccagacggctcgctcgctctgtcagacggctgacgcgcagacgggcccaccgccttctgagagctcggcgcctcctgaagagagagggagtgctgcaggccgcggacttcgatgagaatggcctcatcaaaagcctgcctaacaccccctggcaacttcgggccgctgccctggaccgcaagctcacacctctggaatggtccgctgttcttctgcatctcattaaacacagagggtatctgtctcagcggaagaatgagggagaaaccgccgataaggagctgggcgcgctcctgaaaggcgtggccgacaacgctcatgcccttcagacaggggattttagaacccccgctgagctggccgtcaataagttcgaaaaagagagcggacacatccgcaaccagcggggcgactactcccatacattttctagaaaggatctccaagccgaactggtgcttctgttcgagaaacagaaggaatttgggaatcctcacattagcgacggactcaaggagggcatcgagaccctgctgatggctcagcgcccggcgctctccggggatgccgttcagaaaatgctgggatattgcacgttcgaacccaccgagcctaaggctgccaaaaacacatacaccgccgaacggtttatttggcttacaaagctgaataacctcagaatcctggagcaaggcagcgaacgcccccttaccgacacggagcgggctacactgattgacatgccttataaaaataagctcacctacgccaaagcgagagagctgctgggcctcgatgacacagctttctttaaggggctgcgctatggaaaggataacgccgaatctgccacccttatggagatgaaggcttaccacgccatccggagagctctggaaaaagagggcctcaaagacaagaaaagccccctgtccctgtctccggaacttcaggatgagatcgggaccgccttctccctctttaagacagacgaggatattacgggacgcctgaagggctgtctgcagcctgaaatcctcgacgcgctgcttaaacatattaatttcgataagttcgtgcagatcagcctgaaagccctccggagaattgtccccctgatggagcaagggaagcggtacgacgaggcttgcgccgaaacctatggagatcactacggcgagaaaaactctgaagagatgctgtatcttcctcccatccccgctgacgaaatccgcaaccctgtggtgctcagagccctgtcccaggcgcggaaggtcattaatggcgttgtgagacgctacgggagcccggcccggatccatattgagacagctagagaagtgggaaagtcctttaaagaccgcaaggagatcgagaaaagacaggaagagaaccggaaggatcgcgaaaaagccgctgccaagttcagagagtattttcccaatttcgtcggcgaacctaagtctaaagacattctgaagctccggctgtacgagcaacagcacgggaaatgtctttatagcggaaaggccatcgatatccgcagactgaacggcaaagggtacgtggagattgaccacgctctccccttttcccggacctgggatgacagcttcaataacaaggttctggtgctgggctctgaaaatcagaacaaaggaaatcgcacaccttacgagtatcttaacggcaaggataattccagagaatggctcgagtttaaggcgcgggtcgaaaccagccgcttcccccattctaaaaagcagagagtgctgctgcaaaaatttgacgagaaggggttcaaagagcggaacctcaatgatacgagatacgttaaccgctttctgtgccagttcgtggccgaccacatgcagcttacaggaaagggcaagcggagagtctttgctagcaatgggcagatcaccaacctgctccgcggattctggggcctgcataaagtgcgggccgaaaacgatagacaccatgccctggacgctgtcgtggttgcctgttccaccgtggcgatgcaacagaagattacatgcttcgtccgctataaagagatgaatgcttttgatgggaagaccgtggacaaagaaacaggcgaggttcttcaccagaagacgcacttcccgcagccttgggagtttttcgcccaagaagtgatgatccgggtctttggaaagcccgacggcaaacctgagttcgaagaggccgatacccccgaaaagctcagagctctgctggccgagaaactctctagccgccctgaggcggtgcatgaatacgtgacacccctgtttgtttcccgggctccgaacagaaagatgagcggggcccacaaagacacccttcggtctgccaagcgcttcgtcaagcataatgagaaaatttccgtgaagagagtgtggctgacagaaatcaaactcgctgatctggagaacatggtcaattataagaacggacgggaaattgagctgtacgaggcccttaaagctcgcctgggcgcctatgggggaaatgcgaagcaggcctttgaccctaaagataaccccttctacaagaagggcgggcagctcgtgaaagctgttagagtggaaaagacccaggagagcggcgtcctgctcaataaaaagaacgcctacacgatcgctgacaatggagatatggtgcgggttgacgtgttttgtaaagtcgataagaagggcaaaaaccaatatttcatcgtgcccatttacgcctggcaggttgccgaaaatatcctgcctgacattgattgcaaggggtatagaatcgacgattcttacaccttttgtttctcccttcacaaatatgacctgattgctttccagaaggacgagaaaagcaaggtggaatttgcgtactatatcaactgcgattcctctaatggacgcttctacctcgcctggcacgacaagggcagcaaagagcaacagtttcggatctccacacagaacctggtcctgatgcagaagtaccaaattgatgagcttgggaaagaaatcagaccgtgtcgcctgaagaaacggccccctgtgagatga

SEQ ID NO: 3867 - RNA, 3246 nt, synthetic construct
  misc_feature 1..3246: note = Cas9 variant
  source 1..3246: mol_type = other RNA
atggccgctttcaagcccaaccctatcaattacattctgggcctcgacatcgggattgccagcgtgggatgggcgatggtcgagatcgatgaagacgagaacccgatttgcctgatcgatcttggcgttagagtgtttgaacgggctgaggtgcccaaaaccggggactccctggccgccgctcgcagactcgcccggtctgtccgcagactgacacggcgcagagctcaccggcttctgcgcgccagacggctcctgaagcgcgaaggagtgctgcaggcggccgatttcgacgagaatggcctcatcaaaagcctgcctaacacgccctggcaacttagatccgctgccctggatcggaagctcacccctctggagtggtctgctgttcttctgcatctcattaaacaccgcgggtatctgagccagagaaagaatgaaggagagacagccgacaaggaactgggcgcgctcctgaaaggcgtggccaacaatgctcatgcccttcagaccggggattttcggacacccgctgagctggccctcaacaagttcgagaaagaatccggacacatcagaaatcagcgcggcgactactctcatacctttagccggaaggatctgcaagccgagcttattctcctgttcgaaaaacagaaggagtttgggaaccctcacgtctccggaggcctgaaggaagggatcgagacactgctcatgacccagagaccggctctgagcggagacgcggtgcagaaaatgcttggccactgtacgttcgagcccgccgaacctaaggctgccaaaaatacctatacagccgagcgctttatttggctgaccaagctcaacaatctgcggatccttgaacaaggctctgagagacccctgacagataccgaacgcgctacgctcatggacgagccttaccggaaatccaagctgacatatgcccaggcgagaaaactgctcgggctggaggacaccgctttctttaagggacttcgctacggcaaggataacgccgaagccagcacactgatggagatgaaggcttatcatgccatttctcgggctctcgaaaaggaggggctgaaagacaagaaaagccccctgaatctttccccggaactccaggatgagatcggaaccgccttctctctgtttaagaccgacgaggatatcacaggcagactgaaggaccgcattcagcctgaaatcctcgaggcgctgcttaaacacatttccttcgataagttcgttcaaatcagcctgaaagccctccggagaattgtgcccctgatggaacaggggaagcggtacgacgaggcttgcgccgagatctacggagatcattatggcaaaaagaacacggaagagaagatctacctgcctcccattcccgctgacgaaatccgcaaccctgtcgtgcttagagccctctcccaggcgcggaaagtgattaatggcgtcgttagacgctatgggtctccggcccggatccacattgagaccgctagagaagtgggaaagagctttaaagatcgcaaggagatcgagaaaagacaagaagagaaccggaaggaccgcgaaaaggccgctgccaaattcagagagtactttcccaatttcgtgggcgaacctaagtccaaagacatcctgaagctgcggctctatgagcagcagcacgggaaatgtctgtacagcggaaaggagattaaccttggccgcctgaatgaaaaagggtatgtcgagatcgatcatgccctccccttttctagaacatgggacgattccttcaacaataaggtgctggttctgggcagcgaaaaccagaataagggaaaccaaaccccttacgagtactttaatggcaaagacaactctcgggaatggcaggagttcaaggctcgcgtggagacaagcagatttccccggtccaaaaagcagcgcattcttctccagaaattcgatgaagacgggtttaaggagagaaatctgaacgatacccggtatgtcaatagattcctgtgccaatttgtggcggaccgcatgcggctcacgggaaagggcaaaaagagagttttcgcctctaacgggcagatcacaaacctgcttcgcggattctggggcctgcggaaagtgagagctgaaaatgatcgccaccatgccctcgacgccgtcgtggtcgcttgtagcaccgtggccatgcagcagaagattacccggtttgttagatacaaagagatgaacgcgttcgatgggaagacaatcgacaaggagaccggcgaagtgctgcaccagaaaacacattttccgcagccttgggagttctttgctcaggaagtcatgattcgcgtgttcggaaagcccgatggcaaacctgagtttgaagaggccgacacgcccgagaagctgcggacccttctcgccgaaaaactgtccagcagacctgaggctgttcacgaatatgtgacacccctgttcgtctctcgggccccgaatcgcaagatgtccgggcagggacacatggagaccgtgaaaagcgcgaaaagactcgacgaaggcgtgtctgttctgcgggtccctcttacacaactgaagctcaaagatctggagaagatggtgaaccgcgagagagaacccaaactgtacgaggctcttaaggcccggctggaagcccataaagacgatcccgctaaggcctttgctgagcctttctataagtacgacaaagccgggaatagaacccaacaggtgaaggcggtccgcgtggaacaagttcagaaaacgggagtgtgggtccggaaccacaatggcatcgccgataacgctaccatggtgagagttgacgtgtttgagaaggccgggaaatattacctcgtcccgatctactcctggcaagtggctaagggcattctgcccgatcgcgccgttgtggcctatgctgacgaggaaggatggacagtcatcgatgagagcttccggtttaagttcgtgctctactccaatgacctgattaaagtgcagcttaagaaagattctttcctgggctattttagcgggctcgacagagcgaccggagccatctccctgcgcgaacatgatctggagaagtctaaaggcaaggacgggatgcaccggattggagtcaagacagctcttagcttccagaaataccagatcgacgagatgggcaaggaaatcagactgtgccgcctcaaaaagagacctcccgttcggtga

SEQ ID NO: 3868 - RNA, 3246 nt, synthetic construct
  misc_feature 1..3246: note = Cas9 variant
  source 1..3246: mol_type = other RNA
atgctgaagagagtgctcggcatcgacgtcgggattagctccatcggatgggccctgcttgagttccagggcgatattgacaacaaagatctgccctctgggaagatcctcgctagcggagttagagtgtttacccaagccgaaaatcctaaaaacggcgagtccctggcgaagccgcgcagagacgctcggcttgcccgcagacggacacgcagacgggcccagcgcctgacggatattaaagacctcttctttaagtacaagctggtgaccgggatctctagaaataaaatcaacagcatttataagacagaagagaataaaaaggatccctggaccctgcggaaagaagctctctaccgcaagctggacggagaggagttcgccagagtccttacacacatcgctaagcatcggggctttaaatccatgcgcaagtctgaagaggaaggcagcgataccaaagccaaggagacacagagagtgctgaccgagattgggaaaaacaaggacacgctcaaaaccggaatctggcagacagcgggcgaaatgattgcctcccggcctaagggggatgctagacgcaataagaccgacagctataaaaactctatctcccgggagctgcttcaagatgaaacaaagattatcttcgagaaacagagaggaatgaatagccagtttacctctgccgacctggaaaaggagtactccgacatcgctttccaccaggcccccattcaaagcatgctcaaaatggttggcgggtgcacgtttgagaaggatgaagagggaaagcgcctgaaacgggcgcctaagaactcttattccgccgaagtgttcacagctctgaccaaaatcaataacctcgtcctgaagacaaaaaccgccaatattaacgacagatttcttaccacagaggaacgcaagaaggctctggagctctgtcatagcaatgccaaagtgacgttcaagcagctgcggggcgagcttggcctgcccgaagattggatctttaacaccgttgactacgccaaaaagcctaaaaagacagctgtgaaggagaccgaaccggagtccgcgtgcttcttccagatgagagggtataacgaaattcgcaaatctgtcggaaaggatctctggacagagatcagcatgaaaaaggagatcctcaattccattgtgaccacgctggccacagagaaaagcgacgaagctatcaaggcccagctgaaaaagtctgaagtgcccgatgagattgccgagaaggtcctgggccttaactttcgggggttcctgcacctctccatcaaagctctggacaagattatcccttttatgatggccggagataaatacaccgacgcgtgtgataaggctggctacaaagaacaaatcagcgggattaagaagatcttccttagaaaactgaatgacgaggaaaacgagcagattaccaatcccgttgccaagcgcgccatcacacagtttcggaaagtgattaacgctatcattagagaatatggaaagttcgaccaaatgaatatcgagctcgcccgggatctggctaaatcttacgacgatcgcaagaagatcaaagagggccaggaagactttagagccgagaaggatcgggcggcccagagatgcaaagacaacggcctggatcctaatagcaaggacaacctctccaaatatcgcctgtgggaacagcaagataatgggttctgtatttactgcggaaagcccatcgagcttcagcggctggctgaacagggctattgtgaggtggaccatattctcccgtactctagaagcctggatgactcccagcacaacaaggtcctggcccacatccatgataatcaacagaaaaagaaccagattccttttgagcacttcgggggagacggccccaaatgggaagagtttgtggggcgccttaatagccagttcaagaacctccctaaatctaagctgaacagactggttaaacggaagtttgacgaaaaggatatggagggcttcaaagaacgcaatatcaacgacaccagatatatctcccggttcattaagaattttgtggagaaccatctcgagttcgctgaaagcgcccaaaaacagaaggtctttgtgcgctctggatccctgacagcgttccttagacaccagtggggcctgatcaaaaagcgggatgagagcgaccgccaccatgccctcgatgctctggttacggcctgcgctacccaggccatggtgaagtccacagccattaccgctcagaaaatggaatcttacaattggatcaacaaggagaaacccagaatgcccctgccttggcttaattttcgggacgatgtccaaaagagcctcgacgcggtgttcgtctcccgcgccccgagacacaaagttgggggagctgcccataaggagacaattcggtctatcagaaagtgtggcgaagagaacctgatcattgagaaaacgcccctggtggatatcgccaccaagagcgggattaaactcaaggacatcgaaaaactgtacaagaaggaacagaatcgcaaactttatgagaccctgaaggagcggctcgaacaaaacggaaatgatcctgtgaaggcttttggcaaccccgacgatcctgtcagaatgcccacaaatgacctgaccaagacagggccgattatcaaatccatcaagctgattaccaacaagaaaagcggccttaatgtgcgcgccggaatcgcggacaacggcgagattgctcggctcgatgtttacgaaagaaaggggaaattctatctgatccctaactacgtggccgactttgccaataaggagctgcccaaaaaggctattaaagccaacacgcctgaaacagagtggcccatcattgatcgcaattataacttcaagttttctctcttcaaggacgatctgatctccatcaaacagaaacttgacagccctgaggaattttactattacaaaggacccgatgtctctaccgcgtccattacagtggagagcgtggaccggaagagactgtgggaagagaaaaagaagggcaaaatcgaaaatgttttccacacccgcattgggaccaagacactcaaatctttccggaagtttaacctggatatcctgggaacgaaagctccggtcgagattaagaaggagacctgggtgggcgtgatccggaaaaatggggtcgccaacaatacaggcaacaaggccatgtga

SEQ ID NO: 3869 - RNA, 3249 nt, synthetic construct
  misc_feature 1..3249: note = Cas9 variant
  source 1..3249: mol_type = other RNA
atggccgctttcaagcccaaccctatgaattacatcctgggcctcgacattgggatcgccagcgtgggatgggcgatggtcgagattgataaagaagagaacccgatcagactgattgaccttggcgttcgggtgtttgaacgcgctgaggtgcccaagaccggggattccctggccatggccagacggctcgctcgctctgtcagacggctgacacgcagacgggcccaccgccttctgagagctcggcgcctcctgaaaagagaaggagtgctgcaggacgccgatttcgacgagaatggcctcgttaagagcctgcctaacacgccctggcaacttcgggcggccgctctggatcgcaaacttacctgcctggagtggtccgccgtgcttctgcatctcatcaagcacagagggtatctgtctcagcggaagaatgaaggagagacagctgacaaagaactgggcgccctcctgaagggcgtcgcggataacgcccatgctctccagaccggggactttagaacccctgccgagctggctctcaataaattcgagaaggaaagcggacacatccgcaaccagcggggcgattactcccatacattttctagaaaagacctgcaagccgagcttaatctgcttttcgaaaagcagaaggagtttagcaacccccacgtgtccgatagcctgaaagaagggattgagacactgctcatggcccagcgccctgctctgtctggagacgcggttcagaagatgcttggccactgtaccttcgagccggccgaacccaaagctgccaagaatacgtataccgccgagcggtttatctggctgacaaaactcaacaatctgcgcattcttgaacaagggtccgagagacctctgaccgacacagaacgggctaccctcatggatgagccctacagaaagagcaaactgacgtatgcccaggcgcgcaagctgctcggactggaggacacagctttctttaagggccttcggtacggcaaagataacgccgaagcccctaccctgatggagatgaaggcttatcatgccatctctagagctctcgaaaaagaggggctgaaggacaaaaagagccccctgaatctttccacagaactccaggatgagattggaaccgccttctctctgtttaagaccgacaaagatatcacaggccgcctgaaggaccgggtgcagccggagattctcgaagcgctgcttaaacacatctccttcgataagttcgtccaaatcagcctgaaagccctcagacggattgtgcctctgatggagcaggggaagcgctacgacgaggcttgcgccgagatctacggagatcattattgtaagaaaaacgctgaggaaaagatttacctgccccctatccccgccgacgagattagaaaccccgtggtccttcgggcgctctcccaggccagaaaagttatcaattgcgtggtgcgccggtatggctctcctgctagaatccacattgaaacggcccgcgaggtcggaaagagctttaaagacagaaaggaaatcgagaagcggcaagaggaaaaccgcaaagatagagagaaggctgccgccaaattccgggaatactttccgaatttcgtgggggagcccaagtccaaagacattctgaagctgcgcctctatgaacagcagcacggcaaatgtctgtacagcggcaaggagatcaaccttgttagactgaatgagaaggggtatgtggaaattgatcatgctctccctttttctcggacctgggacgattccttcaacaataaagtcctggtgctgggaagcgagaaccagaataagggcaaccaaacaccctacgaatactttaatgggaaagacaactctcgcgagtggcaggagttcaaggcgagagttgaaaccagccggtttcctcgctccaaaaagcagagaatccttctccagaagttcgatgaggaaggatttaaagagcggaatctgaacgacacaagatatgtgaatcgcttcctgtgccaatttgtcgccgatcacatcctcctgaccggcaaggggaaacggagagtgttcgcttctaacggccagattacgaaccttctgcgcggattctggggcctccggaaggtcagagccgaaaatgaccgccatcacgccctggatgctgtggttgtggcctgtagcacagtcgcgatgcagcagaaaatcacccggtttgtgagatacaaggagatgaacgctttcgacgggaagaccattgataaagagacaggagaagttctgcatcaaaaggcccactttccccagccgtgggagttctttgcccaggaagtgatgatccgcgtcttcggcaaacctgacgggaagcccgagtttgaagaggctgacacccctgagaaacttcggacactcctggccgaaaagctgtccagcagacccgaggcggtgcacgaatatgtgacgcctctcttcgtttctcgggctcccaatcgcaagatgtccggacagggccatatggagaccgtcaaaagcgccaagagactggatgaagggatttctgtgcttcgggtgccgctgacacaactcaaactgaagggcctggagaaaatggtcaaccgcgagagagaacctaagctctacgacgccctgaaagctcagctcgagacccacaaggataatcccgccaaggcttttgccgaacccttctataaatacgacaaggcgggaaaccggacacagcaagtgaaagccgttagaatcgaacaggtgcagaagaccggcgtctgggtgcgcaatcataacgggattgctgataatgccacgatggttcgggtggacgtctttgaaaaaggaggcaagtattacctggtgcctatctactcctggcaggttgctaaggggatcctcccggatagagccgtggtcgccttcaaagacgaggaggattggaccgtgatggacgatagctttgagttccgcttcgtgctgtatgctaacgaccttattaagctgacagcgaaaaagaatgaatttctcggatacttcgtctccctgaaccgggccaccggcgctatcgatattagaacacacgacaccgactctacgaaagggaagaatggcatctttcaaagcgttggagtgaagacagccctgtccttccagaaaaaccagattgatgaacttggcaaggagatccgcccctgccggctgaaaaagagacctcccgtgcgctga

SEQ ID NO: 3870 - RNA, 3249 nt, synthetic construct
  misc_feature 1..3249: note = Cas9 variant
  source 1..3249: mol_type = other RNA
atggccgctttcaagcccaaccctatcaattacattctgggcctcgacatcgggattgccagcgtgggatgggcgatggtcgagatcgatgaagaggaaaacccgattagactgatcgaccttggcgttcgggtgtttgagcgcgctgaagtgcccaaaaccggggattccctggccatggccagacggctcgctcgctctgtcagacggctgacacgcagacgggcccaccgccttctgagagctcggcgcctcctgaagagagagggagtgctgcaggccgcggacttcgatgagaatggcctcatcaaaagcctgcctaacacgccctggcaacttcgggccgctgccctggaccgcaagctcacccctctggaatggtccgctgttcttctgcatctcattaaacacagagggtatctgtctcagcggaagaatgagggagaaacagccgataaggagctgggcgcgctcctgaaaggcgtggccaacaatgctcatgcccttcagaccggggactttagaacacccgctgagctggccctcaacaagttcgaaaaagagagcggacacatccgcaatcagcggggcgattactcccataccttttctagaaaggacctgcaagccgaacttattctcctgttcgagaaacagaaggaatttgggaaccctcacgtcagcggaggcctgaaggaggggatcgagacactgctcatgacccagcgcccggctctgtccggagatgcggtgcagaaaatgcttggccactgcacgttcgaacccgccgagcctaaggctgccaaaaatacctatacagccgaacggtttatttggctgaccaagctcaacaatctgagaatccttgagcaaggcagcgaacgccccctgacagacaccgagcgggctacgctcatggatgagccttacagaaaatctaagctgacatatgcccaggcgcgcaaactgctcgggctggaagacaccgctttctttaagggacttcggtacggcaaggacaacgccgaggcctccacactgatggaaatgaaggcttatcatgccattagcagagctctcgagaaggaagggctgaaagataagaaatctcccctgaatctttccagcgagctccaggacgagatcggaaccgccttctctctgtttaagaccgatgaagacatcacaggccgcctgaaggatcgggttcagccggagattctcgaagcgctgcttaaacacatctccttcgacaagttcgtgcaaattagcctgaaagccctcagacggatcgtccctctgatggagcaggggaagcgctacgatgaggcttgtgccgaaatttacggagaccattatggcaaaaagaacacggaggaaaagatctacctgccccctatccccgctgatgagattagaaaccccgtggtgcttcgggccctctcccaggcgagaaaagtcatcaatggcgttgtgcgccggtatgggtctcctgcccgcattcacatcgaaaccgctagagaggtgggaaagagctttaaagacagaaaggagattgaaaaacggcaagaggaaaaccgcaaggatagagagaaggccgctgccaaattccgggaatactttccgaatttcgtcggcgagcccaagtccaaagacatcctgaagctgcgcctctatgagcagcagcacgggaaatgcctgtacagcggaaaggaaatcaaccttgtgagactgaatgagaaaggctatgttgaaattgaccatgccctccctttttctcggacatgggatgactccttcaacaataaggtgctggtcctggggagcgagaaccagaataagggcaaccaaaccccctacgaatactttaatggaaaagataactctcgcgagtggcaggagttcaaggctagagtggaaacaagccggtttcctcgctccaaaaagcagagaatccttctccagaaattcgacgaggatggctttaaggaatgtaatctgaacgacacccggtatgttaatagattcctgtgccaatttgtggcggatcacattctcctgacggggaagggaaaacgccgggtcttcgcctctaacggccagatcacaaaccttctgagagggttctggggactccgcaaggtgcgggctgagaatgacagacatcacgccctggatgccgtcgtggttgcttgtagcaccgtggccatgcagcagaaaattacccgctttgtccggtacaaggagatgaacgcgttcgacggcaaaacaatcgataaggaaaccgggaaggtgctgcatcagaaaacacactttccccagccgtgggagttctttgctcaggaagttatgattagagtgttcggcaagcctgacggaaaacccgagtttgaagaggccgatacgcctgagaaacttcgcaccctcctggccgaaaaactgtccagccggcccgaggctgtccacgaatatgtgacacctctcttcgtgtctagagcccccaatcggaagatgtccggccaggggcatatggagaccgttaagagcgcgaaacgcctggacgaaggagtctctgtgcttagagtgccgctgacacaactcaagctgaaagacctggagaagatggtcaaccgggagcgcgaacctaaactttacgaggctctgaaggccagactcgaagcccacaaagatgaccccgctaaggcctttgctgagcccttctataagtacgataaagccggcaatcggacccaacaggtgaaggcggttagagtggaacaagtccagaaaacgggggtgtgggttcgcaaccataatggaatcgccgacaacgctaccatggtgcgggtcgatgtgtttgagaagggcgacaaatattacctggttcctatctactcctggcaagtggccaaggggattctcccggatagagctgtcgtgcagggcaaggacgaggaagattggcagctgatcgacgatagcttcaattttaaattctcccttcaccccaacgacctggtggaggtcattacaaagaaagcccgcatgttcggatattttgcctcttgccaccggggcaccgggaatatcaacattagaatccatgatctcgaccacaagatcggaaagaatggcattctggaagggatcggagttaaaacagctctgagcttccagaagtaccagattgacgagcttggcaaagagatccgcccttgtcggctgaagaaaagaccccctgtgcgctga

SEQ ID NO: 3871 - RNA, 3249 nt, synthetic construct
  misc_feature 1..3249: note = Cas9 variant
  source 1..3249: mol_type = other RNA
atggccgctttcaagcccaaccctatcaattacattctgggcctcgacatcgggattgccagcgtgggatgggcgatggtcgagatcgatgaagacgagaacccgatttgcctgatcgatcttggcgttagagtgtttgaacgggctgaggtgcccaaaaccggggactccctggccatggcccgcagactcgctcggtctgtccgcagactgacacggcgcagagcccaccggcttctgcgcgctagacggctcctgaagcgcgaaggagtgctgcaggccgcggatttcgacgagaatggcctcatcaaaagcctgcctaacacgccctggcaacttagagccgctgccctggatcggaagctcacccctctggagtggtccgctgttcttctgcatctcattaaacaccgcgggtatctgtctcagagaaagaatgaaggagagacagccgacaaggaactgggcgcgctcctgaaaggcgtggccgataacgctcatgcccttcagaccggggactttcggacacccgctgagctggccctcaataagttcgagaaagaaagcggacacatcagaaaccagcgcggcgattactcccataccttttctcggaaggacctgcaagccgagcttattctcctgttcgaaaaacagaaggagtttgggaatcctcacgtcagcggaggcctgaaggaagggatcgagacactgctcatgacccagagaccggctctgtccggagatgcggtgcagaaaatgcttggccactgtacgttcgagcccgccgaacctaaggctgccaaaaacacctatacagccgagcgctttatttggctgaccaagctcaataacctgcggatccttgaacaaggcagcgagagacccctgacagacaccgaacgcgctacgctcatggacgagccttaccggaaatctaagctgacatatgcccaggcgagaaaactgctcgggctggaggataccgctttctttaagggacttcgctacggcaaggacaatgccgaagcctccacactgatggagatgaaggcttatcatgccattagccgggctctcgaaaaagaggggctgaaagataagaaatctcccctgaacctttccccggaactccaggacgagatcggaaccgccttcagcctgtttaagaccgatgaggacatcacaggcagactgaaggatcgcattcagcctgaaatcctcgaggcgctgcttaaacacatttctttcgacaagttcgttcaaatctccctgaaagccctccggagaattgtgcccctgatggaacaggggaagcggtacgatgaggcttgcgccgagatctacggagaccattatggcaaaaagaatacggaagagaagatctacctgcctcccattcccgctgatgaaatccgcaaccctgtcgtgcttagagccctcagccaggcgcggaaagtgattaacggcgtcgttagacgctatgggtccccggcccggatccacattgagaccgctagagaagtgggaaagtcttttaaagaccgcaaggagatcgagaaaagacaagaagagaatcggaaggaccgcgaaaaggccgctgccaaattcagagagtactttcccaacttcgtgggcgaacctaagagcaaagatatcctgaagctgcggctctatgagcagcagcacgggaaatgtctgtactccggaaaggagattaatcttggccgcctgaacgaaaaagggtatgtcgagatcgaccatgccctcccctttagcagaacatgggatgactctttcaataacaaggtgctggttctgggctccgaaaatcagaacaagggaaatcaaaccccttacgagtactttaacggcaaagataatagccgggaatggcaggagttcaaggctcgcgtggagacatctagatttccccggagcaaaaagcagcgcattcttctccagaaattcgacgaagatgggtttaaggagagaaacctgaatgacacccggtatgtcaacagattcctgtgccaatttgtggcggatcgcatgcggctcacgggaaagggcaaaaagagagttttcgcctccaatgggcagatcacaaacctgcttcgcggattctggggcctgcggaaagtgagagctgaaaacgaccgccaccatgccctcgatgccgtcgtggtcgcttgttctaccgtggccatgcagcagaagattacccggtttgttagatacaaagagatgaatgcgttcgacgggaagacaatcgataaggagaccggcgaagtgctgcaccagaaaacacattttccgcagccttgggagttctttgctcaggaagtcatgattcgcgtgttcggaaagcccgacggcaaacctgagtttgaagaggccgacacgcccgagaagctgcggacccttctcgccgaaaaactgagctccagacctgaggctgttcacgaatatgtgacacccctgttcgtcagccgggccccgaaccgcaagatgtctgggcagggacacatggagaccgtgaagtccgcgaaaagactcgatgaaggcgtgagcgttctgcgggtccctcttacacaactgaagctcaaagacctggagaagatggtgaatcgcgagagagaacccaaactgtacgaggctcttaaggcccggctggaagcccataaagatgaccccgctaaggcctttgctgagcctttctataagtacgataaagccgggaacagaacccaacaggtgaaggcggtccgcgtggaacaagttcagaaaacgggagtgtgggtccggaatcacaacggcatcgccgacaatgctaccatggtgagagttgatgtgtttgagaagggggacaaatattacctcgtcccgatctactcttggcaagtggccaagggcattctgcccgatcgcgctgttgtgcagggaaaggacgaggaagattggcagctcatcgacgattccttcaactttaaattcagcctgcatcctaatgaccttgtcgaggtgattacaaagaaagcccggatgttcggctattttgcctcctgccacagagggaccggaaacatcaatattcgcatccacgacctggatcataagatcggcaaaaacgggattctcgaaggaatcggcgtgaagacagctctgtctttccagaagtaccagattgacgagctgggggaggaaatccggccctgtagacttaaaaagcgccctcccgtcagatga

SEQ ID NO: 3872 - RNA, 3249 nt, synthetic construct; identical to SEQ ID NO: 3710
  misc_feature 1..3249: note = Cas9 variant
  source 1..3249: mol_type = other RNA

SEQ ID NO: 3873 - RNA, 3249 nt, synthetic construct
  misc_feature 1..3249: note = Cas9 variant
  source 1..3249: mol_type = other RNA
atggccgctttcaagcccaaccctatcaattacattctgggcctcgacatcgggattgccagcgtgggatgggcgatggtcgagatcgatgaagacgagaacccgatttgcctgatcgatcttggcgttagagtgtttgaacgggctgaggtgcccaaaaccggggactccctggccgccgctcgcagactcgcccggtctgtccgcagactgacacggcgcagagctcaccggcttctgcgcgccagacggctcctgaagcgcgaaggagtgctgcaggcggccgatttcgacgagaatggcctcatcaaaagcctgcctaacacgccctggcaacttagagctgccgctctggatcggaagctcacccctctggagtggtccgccgttcttctgcatctcattaaacaccgcgggtatctgtctcagagaaagaatgaaggagagacagcggacaaggaactgggcgccctcctgaaaggcgtggctgataacgcccatgctctgcagaccggggactttcggacacccgccgagctggccctcaataagttcgagaaagaaagcggacacatcagaaaccagcgcggcgattactcccataccttttctcggaaggacctgcaagctgagcttattcttctcttcgaaaaacagaaggagtttgggaatcctcacgtcagcggaggcctgaaggaagggatcgagacactgctcatgacccagagaccggcgctgtccggagatgccgtgcagaaaatgcttggccactgtacgttcgagcccgctgaacctaaggccgccaaaaacacctatacagctgagcgctttatttggctgaccaagctcaataacctgcggatccttgaacaaggcagcgagagacccctgacagacaccgaacgcgccacgctcatggacgagccttaccggaaatctaagctgacatatgcgcaggctagaaaactgctcgggctggaggataccgccttctttaagggacttcgctacggcaaggacaatgccgaggcttccacactgatggaaatgaaagcctatcatgctattagccgggccctcgaaaaggaggggctgaaagataagaaatctcccctgaacctttccccggaactccaggacgagatcggaaccgcgttcagcctgtttaagaccgatgaggacatcacaggcagactgaaggatcgcgttcagcctgaaattctcgaggccctgcttaaacacatctctttcgacaagttcgtgcaaatttccctgaaagctctccggagaatcgtccccctgatggaacaggggaagcggtacgatgaggcctgcgctgagatttacggagaccattatggcaaaaagaatacggaagagaagatctacctgcctcccatccccgccgatgaaattcgcaaccctgtggtgcttagagcgctcagccaggcccggaaagtcatcaacggcgttgtgagacgctatgggtccccggctcggattcacatcgagaccgccagagaagtgggaaagtcttttaaagaccgcaaggagattgagaaaagacaagaagagaatcggaaggaccgcgaaaaggctgccgccaaattcagagagtactttcccaacttcgtcggcgaacctaagagcaaagatatcctgaagctgcggctctatgagcagcagcacgggaaatgtctgtactccggaaaggagatcaatcttggccgcctgaacgaaaaagggtatgtggagattgaccatgctctcccctttagcagaacatgggatgactctttcaataacaaggttctggtgctgggctccgaaaatcagaacaagggaaatcaaaccccttacgagtactttaacggcaaagataatagccgggaatggcaggagttcaaggcgcgcgtcgagacatctagatttccccggagcaaaaagcagcgcatccttctccagaaattcgacgaagatgggtttaaggagagaaacctgaatgacacccggtatgtgaacagattcctgtgccaatttgttgccgatcgcatgcggctcacgggaaagggcaaaaagagagtgttcgcttccaatgggcagattacaaacctgcttcgcggattctggggcctgcggaaagtcagagccgaaaacgaccgccaccatgccctcgatgctgtggtcgtggcctgttctaccgttgcgatgcagcagaagatcacccggtttgtgagatacaaagagatgaatgctttcgacgggaagacaattgataaggagaccggcgaagtcctgcaccagaaaacacattttccgcaaccttgggagttctttgcccaggaagtgatgatccgcgttttcggaaagcccgacggcaaacctgagtttgaagaggccgacacgcccgagaagctgcggacccttctcgctgaaaaactgagctccagacctgaggccgtgcacgaatatgtcacacccctgttcgtgagccgggcgccgaaccgcaagatgtctgggcagggacacatggagaccgtgaagtccgctaaaagactcgatgaaggcgttagcgtcctgcgggtgcctcttacacaactgaagctcaaagacctggagaagatggtgaatcgcgagagagaacccaaactgtacgaggcccttaaggcccggctggaagctcataaagatgaccccgccaaggcttttgccgagcctttctataagtacgataaagcggggaacagaacccagcaggtcaaggccgtgcgcgttgaacaagtgcagaaaacgggagtctgggtgcggaatcacaacggcattgctgacaatgccaccatggttagagtggatgtctttgagaagggggacaaatattacctcgtgccgatctactcttggcaggttgctaagggcatcctgcccgatcgcgccgtggtccagggaaaggacgaggaagattggcaactcattgacgattccttcaactttaaattcagcctgcatcctaatgaccttgtggaggtgatcacaaagaaagcccggatgttcggctattttgcttcctgccacagagggaccggaaacattaatatccgcattcacgacctggatcataagatcggcaaaaacgggatcctcgaaggaattggcgtcaagacagcgctgtctttccagaagtaccagatcgacgagctggggaaagagattcggccctgtagacttaagaaacgccctcccgttagatga

SEQ ID NO: 3874 - RNA, 3249 nt, synthetic construct
  misc_feature 1..3249: note = Cas9 variant
  source 1..3249: mol_type = other RNA
atggccgctttcaagcccaaccctatcaattacattctgggcctcgacatcgggattgccagcgtgggatgggcgatggtcgagatcgatgaagaggaaaacccgattagactgatcgaccttggcgttcgggtgtttgagcgcgctgaagtgcccaaaaccggggattccctggccatggccagacggctcgctcgctctgtcagacggctgacacgcagacgggcccaccgccttctgagaacgcggcgcctcctgaagagagagggagtgctgcaggctgccaatttcgacgagaacggcctcatcaaaagcctgcctaataccctttggcaactgcgggcggccgctctcgatcgcaagctgacaccccttgaatggtccgccgttctgctccatctgattaaacacagagggtatctgtctcagcggaagaacgagggagaaaccgctgacaaggagctcggcgccctgcttaaaggcgtggcggggaatgcccatgctctgcagacaggagattttagaacccctgccgagctcgctctgaacaagttcgaaaaagagagcggccacatccgcaatcagcggggagactactcccatacattttctagaaaggatcttcaagccgaactgaacctcctgttcgagaaacagaaggaatttggaaatccccacattagcgacggcctgaaggaggggatcgagaccctcctgatgacgcagcgccctgccctttccggagatgctgtccagaaaatgctgggccactgcaccttcgaaccgacagagcccaaggcggccaaaaacacctatacaaccgaacggtttatttggctcacgaagctgaataaccttagaatcctggagcaaggcagcgaacgccctctcacagacaccgagcgggctacactgatggatgagccctacagaaaatctaagctgacctatgcccaggcccgcaaactcctggaacttgacgacattgctttctttaaggggctgcggtacggaaaggataatgccgaggcgtccaccctcatggaaatgaaggcttatcatgccatcagcagagccctggagaaggaaggcctgaaagacaagaaatctcctcttaacctctcccccgagctgcaggatgagatcgggacagctttcagcctgtttaagacggacgaagatattaccggacgcctcaaggaccggatccagccggagattctggaagcccttctgaaacacatcaacttcgataagttcgtgcaaatttctctcaaagctctgagacggatcgttcctctgatggagcagggcaagcgctacgacgaggcctgtgcggaaatctacggggatcattatggaaagaaaaatacagaggaaaagattgaccttccccctatccccgccgatgagattcacaaccccgtggtcctcagagctctgtcccaggcccggaaagtgatcaatggcgtggtcagacgctacggcagccctgctcggattcacatcgaaaccgccagagaggttgggaagtcctttaaagaccgcaaggagatcgaaaaacgccaagaggaaaaccggaaggaccgcgagaaggcggccgctaaattcagagaatattttccgaatttcgtgggagagcccaagtctaaagatattctgaagctccggctgtacgagcagcagcatggcaaatgcctttatagcgggaaggaaatcaacctgggacgcctcaatgagaaaggctacgtggaaattgaccacgccctgcctttttccagaacatgggatgacagcttcaacaataaggtcctggtgcttgggtctgagaaccagaataagggcaaccaaaccccctatgaatactttaatggaaaagataactcccgggagtggcaggagttcaaggctcgcgttgaaacgagcagatttcctcggtctaaaaagcagcgcatcctcctgcagaaattcgacgaggatggctttaaggaaagaaatctgaacgacacacggtacgtgaacagattcctctgtcaatttgtcgccgatcgcatgcggctgaccgggaagggaaagaaaagagtgttcgccagcaatggccagattaccaaccttctgcgcgggttctggggactccggaaagttagagctgagaatgaccgccatcacgcgctggatgccgtggtcgtggcttgctccacagtcgccatgcagcagaagatcacccggtttgtgagatataaagagatgaacgccttcgacggcaagacaattgataaggaaacgggggaggttctgcatcagaaaacccactttccccaaccgtgggagttctttgctcaggaagtgatgatccgcgtcttcggcaagcctgacggaaaacccgaatttgaggaggccgacacacctgaaaaacttcggaccctcctgacagagaaactgtctagcagacccgaagcggtgcacgagtacgttacccctctcttcgtgtcccgggctcccaatcgcaagatgagcggccaggggcatatggaaacggtcaagtctgccaaaagactggatgagggaatctccgtgcttcgggtgccgctgacccaactcaagctgaaagacctggagaagatggttaaccgcgaaagagagcctaaactttatgaagccctgaaggctcggctcgaggcccacaaagatgaccccgcgaaggcttttgccgaacccttctacaagtatgataaagccggcaatagaacacagcaggtcaaggctatgcgcgtggagcaagtgcagaaaaccggggtctgggtgcggaaccataatggaattgccgacaacgctacaatggttagagtggatgtctttgagaagggcgacaaatactatctggtgcctatctacagctggcaggttgccaaggggattctcccggatcgcgcggtggtccagggcaaggacgaagaggattggcaactgatcgacgattctttcaattttaaattctcccttcaccccaacgacctggtggaagttattaccaagaaagcccggatgttcggatactttgctagctgtcacagaggcacggggaatatcaacatccgcattcatgacctcgatcacaagatcgggaaaaatggcattctggaggggatcggagtgaagacagccctgtccttccagaagtatcagattgacgagcttggcaaagaaatccggccttgcagactgaagaaaagaccccctgtcagatga

SEQ ID NO: 3875 - RNA, 3249 nt, synthetic construct
  misc_feature 1..3249: note = Cas9 variant
  source 1..3249: mol_type = other RNA
atggccgctttcaagcccaaccctatcaattacattctgggcctcgacatcgggattgccagcgtgggatgggcgatggtcgagatcgatgaagacgagaacccgatttgcctgatcgatcttggcgttagagtgtttgaacgggctgaggtgcccaaaaccggggactccctggccatggcccgcagactcgctcggtctgtccgcagactgacacggcgcagagcccaccggcttctgcgcgctagacggctcctgaagcgcgaaggagtgctgcaggccgcggatttcgacgagaatggcctcatcaaaagcctgcctaacacgccctggcaacttagagccgctgccctggatcggaagctcacccctctggagtggtccgctgttcttctgcatctcattaaacaccgcgggtatctgtctcagagaaagaatgaaggagagacagccgacaaggaactgggcgcgctcctgaaaggcgtggccgataacgctcatgcccttcagaccggggactttcggacacccgctgagctggccctcaataagttcgagaaagaaagcggacacatcagaaaccagcgcggcgattactcccataccttttctcggaaggacctgcaagccgagcttaatctcctgttcgaaaaacagaaggagtttgggaaccctcacattagcgatggactgaaggaaggcatcgagacactgctcatgacccagagaccggctctgtccggggacgcggtccagaaaatgcttggacactgtacgttcgagcccgccgaacctaaggctgccaaaaatacctatacagccgagcgctttatttggctgaccaagctcaacaatctgcggatccttgaacaaggcagcgagagacccctgacagacaccgaacgcacgacactcattgatgagccttaccggaaatctaagctgacctatgctcaggccagaaaactgctcgagctggacaacacagcgttctttaagggccttcgctacgggaaggataatgctgaagcctccaccctgatggagatgaaagcctatcatgctatcagccgggccctcgaaaaggagggactgaaagacaagaaatctcccctgaacctttccccggaactccaggatgagatcggcaccgctttcagcctgtttaagacagacgaggatattacggggagactgaaggaccgcgtgcagcctgaaatcctcgaggccctgcttaaacacatttctttcgataagttcgttcaaatctccctgaaagcgctccggagaattgtgcccctgatggaacagggaaagcggtacgacgaggcctgcgctgagatctacggcgatcattatgggaaaaagaacaccgaagagaagatcgacctgcctcccattcccgccgacgaaatccgcaatcctgtcgtgcttagagctctcagccaggcccggaaagtgattaacggagtcgttagacgctacggctccccggcgcggatccacattgagacagccagagaagtgggcaagtcttttaaagatcgcaaggagatcgagaaaagacaagaagagaatcggaaggaccgcgaaaaggctgccaccaaattcagagagtattttcccaacttcgtgggggaacctaagagcaaagatatcctgaagctgcggctctacgagcagcagcacggaaaatgtctgtattccggcaaggagattaatcttgggcgcctgaacgaaaaaggatacgtcgagatcgaccatgctctcccctttagcagaacatgggatgactctttcaataacaaggtgctggttctgggctccgaaaatcagaacaaggggaatcaaaccccttatgagtactttaacggcaaagataatagccgggaatggcaggagttcaaggcccgcgtggagacgtctagatttccccggagcaaaaagcagcgcattcttctccagaaattcgacgaagagggatttaaggaaagaaacctgaatgatacacggtacgtcaacagattcctgtgccaatttgtggccgaccacatgctcctgaccggcaaggggaaacgccgggttttcgcttccaacggacagatcaccaatcttctgagaggcttctgggggctccgcaaggtgcgggcggagaacgatagacatcacgccctggacgctgtcgtggtcgcctgttctacagtggccatgcagcagaaaattacccgctttgttcggtataaggagatgaatgctttcgatggaaaaacaatcgacaaggaaacgggcgaggtgctgcatcaaaagacccactttccgcagccttgggagttctttgcccaggaagtcatgattagagtgttcgggaaacccgacggcaagcctgaatttgaggaggcggatacacccgaaaaacttcgcaccctcctggctgagaagctgagctcccggcctgaagccgttcacgagtacgtgacacccctcttcgtcagcagagccccgaaccggaaaatgtctggacagggccatatggaaaccgtgaagtccgctaagcgcctggacgagggggtgagcgttcttagagtccctctgacgcaactcaaactgaaggatctggagaaaatggtgaatcgggaacgcgagcccaaactttatgaagccctgaaagcgagactcgaggctcacaaggacgatcccgccaaagcctttgctgaacctttctacaagtatgacaaggccggaaaccggacccaacaggtgaaagctgtcagagtggagcaggttcagaagacaggcgtgtgggtccgcaatcataacgggatcgccgataatgcgaccatggtgcgggttgacgtgtttgagaaaggagataagtactatctggtcccgatctactcttggcaagtggccaaaggcattctccccgacagagctgttgtgcaggggaaggatgaagaggactggcagctgatcgatgactccttcaactttaagttcagccttcaccctaatgacctggtcgaagtgattacaaagaaggcccgcatgttcggctactttgcttcctgccaccggggaaccggcaacatcaatattagaatccatgatctcgaccacaaaatcgggaagaacggcattctggagggaatcggggtgaaaacggccctgtctttccagaagtatcagattgatgagcttggaaaggaaatccgcccctgtcggctgaaaaagagacctcccgtccgctga

SEQ ID NO: 3876 - RNA, 3249 nt, synthetic construct
  misc_feature 1..3249: note = Cas9 variant
  source 1..3249: mol_type = other RNA
atggccgctttcaagcccaaccctatgaattacatcctgggcctcgacattgggatcgccagcgtgggatgggcgattgtcgagatcgatgaagaggaaaacccgattagactgatcgaccttggcgttcgggtgtttgagcgcgctgaagtgcccaaaaccggggattccctggccgccgctagacggctcgcccgctctgtcagacggctgacacgcagacgggctcaccgccttctgagagcccggcgcctcctgaagagagagggagtgctgcaggcggccgacttcgatgagaatggcctcatcaaaagcctgcctaacacgccctggcaacttcgggctgccgctctggaccgcaagctcacccctctggaatggtccgccgttcttctgcatctcattaaacacagagggtatctgtctcagcggaagaatgagggagaaacagcggataaggagctgggcgccctcctgaaaggcgtggctgacaacacccatgcccttcagacaggggattttagaacccccgctgagctggccctcaataagttcgaaaaagagagcggacacatccgcaaccagcggggcgactactcccatacatttaatagaaaggatctgcaagccgaacttaacctcctgttcgagaaacagaaggaatttgggaatcctcacgtctctgacggactgaaggagggcattgagaccctgctcatgacgcagcgcccggctctgagcggggatgcggtgcagaaaatgcttggacactgcaccttcgaacccacagagcctaaggccgctaaaaacacctatacagccgaacggtttgtttggctgaccaagctcaataacctgagaatccttgagcaaggctccgaacgccccctgacggacacagagcgggccaccctcatggacgagccttacagaaaaagcaagctgacatatgctcaggcccgcaaactgctcgatctggacgataccgcgttctttaagggccttcggtacgggaaggacaatgctgaagcctctaccctgatggagatgaaagcctatcatgctatttccagagccctcgaaaaggagggactgaaagataagaaaagccccctgaacctttctccggaactccaggacgagatcggcacagctttctccctgtttaagacggatgaggacattaccgggcgcctgaaggatcgggtgcagcctgaaatcctcgaggccctgcttaaacacatcagcttcgacaagttcgtccaaatttctctgaaagcgctcagacggatcgtgcccctgatggaacagggaaaccgctacgatgaggcctgtacagagatttacggcgaccattatgggaagaaaaataccgaagagaagatctacctgcctcccattcccgctgacgaaatcagaaaccctgtggtccttcgggccctctcccaggctagaaaggttatcaatggagtggtgcgccggtatggcagcccggcccgcattcacatcgagacagcgagagaagtcggcaaatcctttaaggatagaaaagagattgagaagcggcaagaagagaaccgcaaagacagagaaaagtctgccgctaagttccgggagtactttcccaatttcgtgggggaacctaaaagcaaggatatcctgaaactgcgcctctatgagcagcagcacggaaagtgcctgtactccggcaaagagattaaccttgggagactgaatgaaaagggatatgttgagatcgaccatgccctcccctttagccggacctgggatgactctttcaacaataaagtgctggctctgggctccgaaaaccagaataaggggaaccaaacgccttacgagtactttaatggcaaggataacagccgcgaatggcaggagttcaaagccagagtcgagacatctcggtttccccgcagcaagaaacagagaatccttctccagaagttcgacgaagatggatttaaagagcggaatctgaacgacaccagatatattaaccgcttcctgtgtcaatttgtggccgatcacatgctcctgaccggcaaggggaagcggagagttttcgcttccaatggacagatcacaaaccttctgcgcggcttctgggggctccggaaagtgagagcggaaaatgaccgccatcacgccctggatgctgtcgtggtcgcctgctctaccattgccatgcagcagaagatcacacggtttgtgagatacaaagagatgaacgctttcgacggaaagacgattgacaaagagaccggcgaagttctgcatcaaaaggcccactttccgcagccttgggagttctttgcgcaggaagtgatgatccgcgtcttcgggaagcccgatggcaaacctgagtttgaagaggctgacacacccgagaaacttcggaccctcctggccgaaaaactgagctccagacctgaggccgtgcacaagtatgttacacccctcttcattagccgggctccgaatcgcaaaatgtctggacagggccatatggaaaccgtgaagtccgccaagagactggatgaggggatcagcgtccttcgggtgcctctgacgcaactcaaactgaaggacctggaaaagatggtgaaccgcgagagagagcccaaactttacgaagcgctgaaagctcggctcgaggcccacaaggatgaccccgccaaggcttttgccgaacctttctataagtacgataaggctggaaatagaacccagcaggttaaagccgtccgcgtggagcaagtgcagaagacaggcgtctgggtgcataaccacaatgggatcgcggacaacgccaccattgttcgggtggatgtctttgaaaaaggaggcaagtattacctggtgccgatctactcttggcaggttgctaaagggattctccccgacagagccgtggtccagggcaaggatgaggaggactggacagtgatggatgactccttcgaatttaagttcgttctgtatgctaatgaccttatcaaactgaccgccaagaaaaacgagttcctcggatactttgtgagcctgaatcgcgccacgggcgctattgatatccggacacacgacaccgattccacaaaggggaaaaacggaatcttccaatctgtcggcgtgaagaccgcgctgagctttcagaagtatcagattgacgaacttgggaaagagatcagaccttgtcgcctgaagaaacggccccctgtgagatga

SEQ ID NO: 3877 - RNA, 3249 nt, synthetic construct
  misc_feature 1..3249: note = Cas9 variant
  source 1..3249: mol_type = other RNA
atggccgctttcaagcccaacagcatcaattacattctgggcctcgacatcgggattgcctccgtgggatgggcgatggtcgagatcgataaagaagagaaccctattagactgatcgaccttggcgttcgggtgtttgaacgcgctgaggtgccgaagaccggggattctctggccgccgctagacggctcgcccgcagcgtcagacggctgacacgcagacgggctcaccgccttctgagaacgcggcgcctcctgaaaagagaaggagtgctgcaggccgcgaatttcgacaagaacggcctcatcaaatccctgcccaataccctttggcaactgcgggccgctgccctcgatcgcaagctgacacctcttgagtggtctgctgttctgctccatctgattaagcacagagggtatctgagccagcggaaaaacgagggagaaaccgccgacaaggagctcggcgcgctgcttaaaggcgtggccgggaatgctcatgccctgcagacaggagattttagaacccccgctgaactcgccctgaacaagttcgagaaagagtccggccacatccgcaatcagagaggggactactctcatacatttagcagaaaggatcttcaagccgaactgaacctcctgttcgagaagcagaaagaatttggaaatcctcacatttccggcgggctgaaggagggaatcgaaaccctcctgatgacgcagcgccccgctcttagcggcgacgcggtccagaaaatgctgggccactgcaccttcgagcctacagagccgaaggccgctaaaaacacctatacaaccgaacggtttatttggctcacgaagctgaataaccttagaatcctggagcaagggtctgaacgccccctcacagataccgagcgggccacactgatggacgaaccttacagaaaatccaagctgacctatgcccaggctcgcaagctcctgagccttgaggataccgccttctttaaaggactgcggtacggcaaggacaatgcggaggcttctacactcatggaaatgaaagcctatcatacgatttccagagccctggagaaggaagggctgaaagacaaaaagagcccccttaacctctctcctgagctgcaggatgaaatcggaaccgctttctccctgtttaaaacagacgaggatatcaccggccgcctcaaggaccggattcagcccgagatcctggaagcccttctgaaacacattagcttcgataagttcgtgcaaatctccctcaaagctctgagacggattgttccgctgatggagcaggggaagcgctacgacgaagcctgtgcggagatctacggagatcattatggcaagaaaaacacagaggaaaagatctaccttcctcccattcctgccgacgagatcagaaatcccgtggtcctccgggctctgtctcaggccagaaaagtgattaacggcgtggtccgccggtatgggagccccgctagaatccacattgaaaccgcccgcgaggttggaaagtcctttaaagatagaaaggaaatcgagaagcggcaagaggaaaatcgcaaagacagagagaaggcggccgctaaattccgggaatactttcctaacttcgtgggcgagcccaagagcaaagatatcctgaagctccgcctgtatgaacagcagcacgggaaatgcctttactctggaaaggagattaatctggtgagactcaacgagaagggctatgtcgaaatcgaccatgccctgcccttttcccggacgtgggacgatagcttcaataacaaagtgctggttcttgggtctgagaatcagaacaagggcaatcaaacaccttacgaatactttaacggaaaagacaatagccgcgagtggcaggagttcaaggctagagtggaaacctcccggtttccccgctctaaaaagcagcggattctcctgcagaagttcgatgaggacggctttaaagaacggaacctgaatgataccagatatgtcaaccgcttcctctgtcaatttgtggccgaccacatcctgcttacagggaagggaaaacggagagttttcgccagcaacggccagattaccaatctgctccgcgggttctggggactgcggaaggtgagagctgagaacgatcgccatcacgcgctggacgccgtcgtggtcgcttgctccacagtggccatgcagcagaaaatcacgcggtttgttagatacaaggaaatgaatgccttcgatggcaagaccattgacaaagagacaggggaggtgcttcatcaaaagacccactttcctcagccctgggagttctttgctcaggaagtcatgatccgcgtgttcggcaaaccggatggaaagcctgaatttgaggaagccgacacactcgagaaactgcggaccctgctcgcggagaagctgagctctagacccgaagctgttcacgagtatgtgacgcctcttttcgtctcccgggcccccaaccgcaagatgagcggccaggggcatatggaaaccgtgaaatctgccaagagactggatgagggagtgtccgttctccgggtccctctgacacaactgaaacttaaggacctggaaaagatggtgaatcgcgagagagagcccaagctctacgaagctctgaaagcccggctcgaggcgcacaaggacgatccggctaaggcctttgccgaacctttctataaatacgacaaggctggcaacagaacccaacaggtgaaagccgtccgcgtggagcaggttcagaagacaggggtgtgggtccggaatcataacggaatcgctgataatgccaccatggtgagagttgacgtgtttgaaaaaggcgataagtattacctggtccccatttacagctggcaagtggcgaaggggatccttcccgaccgcgccgttgtgcagggcaaagatgaggaggactggcagctgattgatgactccttcaactttaagttctctctccaccctaatgatctggtcgaagtgatcacgaaaaaggctcggatgttcggatattttgccagctgtcacagaggcacagggaacattaatatccgcatccatgacctggatcacaaaattggaaagaacggcatccttgaggggattggagtgaagaccgctctgtccttccagaaataccagatcgacgaactcggcaaggagattcggccgtgcagactgaaaaagcgcccgcctgtcagatga

SEQ ID NO: 3878 - RNA, 3249 nt, synthetic construct
  misc_feature 1..3249: note = Cas9 variant
  source 1..3249: mol_type = other RNA
atggccgctttcaagcccaaccctatcaattacattctgggcctcgacatcgggattgccagcgtgggatgggcgatggtcgagatcgatgaagaggaaaacccgattagactgatcgaccttggcgttcgggtgtttgagcgcgctgaagtgcccaaaaccggggattccctggccatggtcagacggctcgcccgctctgtgagacggctgacacgcagacgggctcaccgccttctgagagcccggcgcctcctgaagagagagggagttctgcaggctgccgacttcgatgagaatggcctcatcaaaagcctgcctaacacgccctggcaacttcgggcggccgctctggaccgcaagctcacccctctggaatggtccgccgtgcttctgcatctcattaaacacagagggtatctgtctcagcggaagaatgagggagaaacagctgataaggagctgggcgccctcctgaaaggcgtcgcggacaacgcccatgctctgcagaccggggattttagaacacccgccgagctggctctcaataagttcgaaaaagagagcggacacatccgcaaccagcggggcgactactcccataccttttctagaaaggatctgcaagccgaacttattcttctcttcgagaaacagaaggaatttgggaatcctcacatcagcggaggcctgaaggaggggattgagacactgctcatgacccagcgcccggccctgtccggagacgctgtgcagaaaatgcttggccactgcacgttcgaacccgcggagcctaaggccgctaaaaacacctatacagccgaacggtttatctggctgaccaagctcaataacctgcgcattcttgagcaaggcagcgaaagacccctgacagataccgagcgggccacgctcatggacgagccttacagaaaatctaagctgacatatgctcaggcccgcaaactgctcgggctggaagacaccgcgttctttaagggacttcggtacggcaaggataatgctgaggcctccacactgatggaaatgaaagcctatcatgctatcagcagagccctcgagaaggaagggctgaaagacaagaaatctcccctgaacctttccccggagctccaggatgagatcggaaccgctttcagcctgtttaagaccgacgaagatattacaggccgcctgaaggaccggatccagcctgagattctcgaagccctgcttaaacacatctctttcgataagttcgttcaaatttccctgaaagcgctcagacggatcgtgcccctgatggagcaggggaagcgctacgacgaggcctgtgctgaaatctacggagatcattatggcaaaaagaatacggaggaaaagatttacctgcctcccatccccgccgacgagattagaaaccctgtcgtgcttcgggctctcagccaggccagaaaagtgatcaacggcgtcgttcgccggtatgggtccccggcgcgcattcacatcgaaaccgccagagaggtgggaaagtcttttaaagatagaaaggagatcgaaaaacggcaagaggaaaatcgcaaggacagagagaaggctgccgctaaattccgggaatactttcccaacttcgtgggcgagcctaagagcaaagacattctgaagctgcgcctctatgagcagcagcacgggaaatgcctgtactccggaaaggaaatcaatcttggcagactgaacgagaaagggtatgtcgaaattgatcatgccctcccctttagccggacatgggacgattctttcaataacaaggtgctggttctgggctccgagaatcagaacaagggaaatcaaaccccttacgaatactttaacggcaaagacaatagccgcgagtggcaggagttcaaggccagagtggaaacatctcggtttccccgcagcaaaaagcagagaatccttctccagaaattcgatgaggacgggtttaaggaacggaacctgaatgataccagatatgtcaaccgcttcctgtgtcaatttgtggctgaccggatgagactcacgggaaagggcaaaaagcgcgttttcgcgtccaatgggcagattacaaacctgcttcggggattctggggcctgagaaaagtgcgcgccgagaacgatcggcaccatgctctcgacgccgtcgtggtcgcctgctctaccgtggctatgcagcagaagatcaccagatttgttcgctacaaagagatgaatgccttcgatgggaagacaattgacaaggaaaccggcgaggtgctgcaccagaaaacacattttccgcagccttgggagttctttgcgcaggaagtcatgatccgggtgttcggaaagcccgatggcaaacctgaatttgaggaggctgacacgcccgaaaagctgagaacccttctcgccgagaaactgagctcccggcctgaagccgttcacgagtatgtgacacccctgttcgtcagccgcgctccgaacagaaagatgtctgggcagggacacatggaaaccgtgaagtccgccaaacggctcgacgagggcgtgagcgttctgcgcgtccctcttacacaactgaagctcaaagatctggagaagatggtgaatagagaacgggagcccaaactgtacgaagcgcttaaggctagactggaggcccataaagacgatcccgccaaggcttttgccgaacctttctataagtacgacaaagctgggaaccgcacccaacaggtgaaggccgtccgggtggagcaagttcagaaaacgggagtgtgggtcagaaatcacaacggcatcgcggataatgccaccatggtgcgcgttgacgtgtttgagaagggggataaatattacctcgtcccgatttactcttggcaagtggctaagggcatcctgcccgaccgggccgttgtgcagggaaaggatgaagaggactggcagctcattgatgactccttcaactttaaattcagcctgcatcctaatgatcttgtcgaagtgatcacaaagaaagctagaatgttcggctattttgcctcctgtcaccgcgggaccggaaacattaatatccggatccacgacctggaccataagattggcaaaaacgggatcctcgagggaattggcgtgaagacagccctgtctttccagaagtaccagatcgatgagctggggaaagaaattagaccctgccgccttaagaaaagacctcccgtccggtga

SEQ ID NO: 3879 - RNA, 3249 nt, synthetic construct
  misc_feature 1..3249: note = Cas9 variant
  source 1..3249: mol_type = other RNA
atgagagtgctgggcctcgacgccgggatcgctagcctgggatgggcccttattgagatcgaagagtccaaccggggcgaactgtctcaggggaccattatcggagcgggcacatggatgttcgatgctcccgaggaaaagacgcaagccggggccaaactcaagagcgagcagcgcagaacctttcggggacagcgcagagtcgttcggcgcagacggcagcgcatgaatgaggtgagacggattctgcactcccatggccttctgccttctagcgaccgcgatgctctcaaacaaccgggcctggacccctggagaatccgggccgaagctctggatcgcctcctggggcctgtggagcttgccgtcgcgctgggacacatcgccagacatcggggcttcaagtccaactctaaaggggctaagacaaatgaccccgccgatgacaccagcaagatgaaaagagctgtgaacgaaacacgcgagaagctcgcccggtttggatccgcggccaaaatgctggttgaggatgagagcttcgtgcttagacagacccctacaaagaatggcgcttctgaaattgtccgccggtttagaaaccgcgaaggggactactcccggagcctgctcagagatgacctggccgctgagatgcgcgccctgttcaccgcccaggctcggtttcagtctgcgatcgccacggctgatctccaaaccgccttcacaaaagccgctttcttccagagacccctgcaggactccgaaaagctggtgggaccttgcccgtttgaggttgacgagaagcgcgcccccaaacggggctatagcttcgaactgtttagattcctctctcggctgaatcacgtgacccttcgcgatggcaagcaggagagaacactgacccgggacgaactcgcgctggctgccgccgatttcggggctgccgctaaagtctcctttacggccctgagaaagaaactcaagctgcctgagacaaccgtgttcgtgggagtcaaagcggacgaagagagcaaacttgatgttgtggcccgctccggcaaggctgccgaggggacagctcggctgagatctgtgattgtcgacgccctcggagaactggcgtggggcgcccttctgtgtagccccgagaagctcgataagatcgctgaagtgatttcctttcgcagcgacatcgggagaatttctgagggactggcccaagctggctgcaacgcccctctggttgatgccctcaccgctgcggcctccgacggccggttcgatccctttaccggggctggacatatcagctctaaagccgcccgcaatatcctgagcggccttagacaggggatgacatacgacaaggcttgttgcgccgcggactatgatcacacggcttcccgggaacgcggagccttcgacgtgggcgggcacggcagagaggccctgaaacggattctccaggaggaacgcatctctagagagctggtcggaagcccgaccgctcggaaggccctgattgaatccatcaagcaagtgaaagcgattgttgagcgctacggcgtgcctgatagaatccatgtcgagcttgctcgggacgtgggaaagagcatcgaagagagagaagagattacacgcgggatcgaaaaacggaacagacagaaggataaactccgcggcctgtttgagaaggaggtcgggcggccccctcaggacggagccagaggcaaggaggaactgctccgcttcgaactgtggtctgagcagatggggcggtgtctttataccgatgactacatttcccccagccaactggtggccacagatgacgctgttcaggtggatcacatcctcccctggtctagatttgccgacgattcctatgctaataaaaccctgtgcatggccaaggcgaaccaggacaaaaagggccgcacgccttacgaatggttcaaagccgagaagacagacaccgagtgggatgcttttattgtccgggtggaagccctggctgacatgaagggattcaaaaagagaaattacaaacttcggaacgccgaggaagccgctgcgaagtttcgcaatagaaacctcaacgatacccggtgggcctgtcgcctgctggctgaggccctcaaacagctgtatccgaagggcgaaaaagacaaggatgggaaggagagacggagagttttcagccgccccggagcccttacagaccggctgagacgcgcttggggcctccaatggatgaaaaagtccaccaaaggggatcggatccctgacgatagacatcacgccctggacgcgatcgtgattgctgccacaacggagtctctgcttcagcgcgccacccgggaagtccaggagatcgaagataagggactccactacgacctggtgaaaaatgtgacacccccttggcccggcttcagagagcaggctgttgaggccgtcgaaaaggtgtttgtggcgcgcgctgagagacggcgcgccagagggaaggcccatgatgctaccattcggcacatcgccgtccgcgaaggcgagcaaagagtgtatgaacggagaaaagttgctgagctgaagctcgccgacctggaccgcgtgaaagatgcggagcggaacgccagacttattgaaaagctgcgcaattggatcgaggctggaagcccgaaagacgatcctcccctctcccctaagggcgaccccattttcaaggtccggctggtgacaaaatctaaggttaacatcgccctggataccgggaatcctaaaagacccggaacggtggaccggggcgaaatggctcgcgtcgatgtgtttagaaaggccagcaaaaaggggaagtacgagtattaccttgttccgatctatcctcatgacattgccaccatgaaaacacctcccatccgggctgtgcaggcgtacaagcccgaagatgagtggccggagatggactccagctacgaattttgctggtctctcgtccccatgacctatcttcaggtgatttccagcaaaggagagatctttgaaggctactatcgcgggatgaacagatctgtgggcgccattcagctgtccgctcacagcaattctagcgatgtcgttcaaggaatcggcgcccggacactcaccgagttcaagaaatttaacgtggaccgcttcgggagaaagcatgaagtggagcgggagctgcgcacgtggagaggagaaacatggcggggcaaagcctacatctga

SEQ ID NO: 3880 - RNA, 3255 nt, synthetic construct
  misc_feature 1..3255: note = Cas9 variant
  source 1..3255: mol_type = other RNA
atgaagaacaccctgtacggcatcgggctcgacattggagtggccagcgtcggctgggctgttgtggggctgaatggaacaggcgagcccgtggggcttcacagactgggagtccggatcttcgataaagccgaacagcctaagacgggcgagtccctcgcggctccgcgcagaatggcccggggcatgcgcagacggctgcgcagaaaagcccttcggcgcgctgacgtgtatgccctgctcgaaagatctgggctgagcacccgggaggctctggcccatatgtttgaagcgggaggcctcgaggatatttacgccctgcgcacaagagctcttgacgagcccgttgggaaggccgagttctcccggatcctgctccacctggctcaacgcagaggatttaaatctaaccggagaaccgccagcgatggcgaagacgggcgccttctggcggccgtgaatgaaaaccggagacgcatggctcagggaggctggcggacagtcggcgagatgctctatagacatgaggccttcgctctgcacaagcgcaataaggccgatgaatacctgtccaccgtggggcgggacatggttgccgaggaggcttctctcctgtttcagagacagcgcgaacttggatgcgcgtgggccacacctgaactgcaagctgagtatctcagcattctgcttcggcagagatccttcgatgagggccccgggggaaacagcccttacggcgggaatcaggtggaaaagatggtcggacgctgtacctttgagcccgacgaacctcgggccgccaaggctgcctattctttcgagtacttttccctgctccagaaaatcaaccatatcagactggtggaaaatggcgagacgcggccgctgacccaacagcagcgccagcaactcctgagccttgcgcacaagacacccgatgtgtctctggctcggattagaaaagagctcgccctgcctgaaaccgtccagttcaacggcgttagatgccgcgccaatgagacacttgaagagtccgaaaagaaggagaaatttgcttgtctgcccgcctaccacaagatgcggaaagctctcgacggggtggtgaagggaagaatcagctctctgtccattagccagcgcgatgccgcggccaccgctctgtccctctataaaaacgaggacacgctgagagccaaacttacagaagctggcttccaagcccctgagatcgacgcgctggccgggctcaccggattttctaaattcggccatctgagcctgaaggcttgccggaaacttattccccacctcgaacaggggctgacatacgatcaggcctgttccgctgccggctatgacttcaagggacatggcgccggggagcgcgcttttaccctgccggcggccgctcctgagatggaacagatcaccagccccgtcgtgagacgggccgttgcccaaacaattaaggtggtcaatggaatcatccgcgagatggatgcttctcctgcctgggtgagaattgaactcgcgcgggagctgtccaaaacgttcggcgaacgccaggagatggacagaagcatgcgggagaacgctgcccagaatgaacgccttatgcaggagctgagagatacctttcacctcctgtctcccacagggcaagacctggttaagtaccggctttggaaagaacaggatggagtgtgcgcctatagcctcagacgcctggacgtcgagcggctgttcgaacccggctacgtggatgtcgaccacatcgtgccttattccctctcttttgatgacagacgcagcaacaaggttctggtgctttccagcgagaaccggcagaaggggaatagactgccgctccagtacctgcaaggcaaacgccgggaggacttcattgtctggaccaactcttccgtgagagattaccgcaagcggcagaatctgcttagagaaaaactcagcggagacgaggctgaaggctttcggcagcgcaacctgcaggatacacaacatatggccagattcctgtataattacatctctgaccacctcgcgtttgctcagtccgaggccctggggaagaaacgggttttcgccgtgagcggagctgtcacctcccatcttcgcaagagatggggcctgtctaaggtgcgggccgatggggacctccaccatgctctggatgccgcggtgattgcctgtacgacagacggaatgatcagacgcatcagcggctattacgggcacattgaaggcgagtatctgcaggatgctgacggagccggctcccaacacgctcggaccaaagagagatttcccgccccttggccccgcttccgggatgaacttatcgttagactctctgagcagcctggggaacatctgctggacattaaccccgagttttactgcgagtatggaaccgaacacatccgcccggtcttcgtgagccggatgcctagacgcaaggtgacaggccccgggcataaagagaccattaagggagccgctgcggccgatgaaggcctcctgacagtcagaaaagctcttacggagctgaagctcgacaaggacggggaaatcaaagattactacatgccttccagcgacaccctgctgtatgaggcccttaaggcccagctgcggcgcttcggcggagattctaaaaaggcttttgccgagcccttctacaaacctaaggcggacggcacacccgggccgctcgtgagaaaagttaagaccacagaaaaggctaccctgacggtgcctgtccacggaggcgccgcctccaatgataccatggtgcgggttgacgtgtttctcgtccccggggatggatattactgggtgcccgtttatacagctgacaccctgaaacctgagcttccgaaccgcgccgtggtccagggcaagccctacagcgaatggaaagagatgagagaagaggatttcatcttttctctgtatcctaatgacctcgtgtacgtggagcacaagtccggcctgaaattcacactgcaaaacgcggatagcacccttgaaaagacgcggacacagacctctgcttttgtctacttcgttgggggaagcatttccacagccagcatcaccattagaacccatgacaatgcctatggcatcccctctctgggggtgaagacactcaaaacgtttcacaagtaccaggtggatgtcctgggaaacgtgttccctgttcataaagagacccgccagaagtttcggtga

SEQ ID NO: 3881 - RNA, 3255 nt, synthetic construct
  misc_feature 1..3255: note = Cas9 variant
  source 1..3255: mol_type = other RNA
atgaagaacaccctgtacggcatcgggctcgacattggagtggccagcgtcggctgggctgttgtggggctgaatggaacaggcgagcccgtggggcttcacagactgggagtccggatcttcgataaagccgaacagcctaagacgggcgagtccctcgcggctccgcgcagaatggcccggggcatgcgcagacggctgcgcagaaaagcccttcggcgcgctgacgtgtatgccctgctcgaaagatctgggctgagcacccgggaggctctggcccaaatgtttgaagcgggaggcctcgaggatatttacgccctgcgcacaagagctcttgacgagcccgttgggaaggccgagttctcccggatcctgctccatctggctcagcgcagaggatttaaatctaaccggagaaccgccagcgatggcgaagacgggcgccttctggcggccgtgaatgaaaaccggagacgcatggctcagggaggctggcggacagtcggcgagatgctctatagacacgaggccttcgctctgcataagcgcaataaggccgatgactacctgtccaccgtggggcgggatatggttgccgaagaggcttctctcctgtttcagagacaacgcgaacttggatgcgcgtgggccacacctgagctgcaggctgaatatctcagcattctgcttcggcagagatccttcgacgagggccccgggggagatagcccttacggcgggaaccaggtggagaaaatggtcggacgctgtacctttgaacccgacgagcctcgggccgccaaggctgcctattctttcgaatacttttccctgctccaaaagatcaatcacatcagactggcggagaacggcgaaacgcggccgctgacccagccccagcgccagcaactcctgagccttgctcataagacacctgatatgtctctggcccggattagaaaagagctcgccctgcccgagaccgtgcagttcaatggcgtgagatgccgcgctaacgaaacacttgaggaatccgagaagaaggaaaaatttgcctgtctgcctgcttaccacaagatgcggaaagccctcgggggagtcgttaagggcagaatcagctctctgtccattagccagcgcgacgcggccgctaccgccctgtccctctataaaaatgaggacacgctgagagctaaacttacagaggccgggttccaagcgcccgaaatcgatgccctggctggactcaccggcttttctaaattcgggcacctgagcctgaaggcctgccggaaacttattccgcatctcgagcagggcctgacatacgaccaggcttgttccgccgccggatatgatttcaagggccacggggctggagaacgcgcgtttaccctgcctgccgctgcccccgagatggagcagatcaccagccctgtggtgagacgggccgtcgctcaaacaattaaggtggttaacggcatcatccgcgaaatggacgcctctcccgcgtgggtgagaattgagctcgctcgggaactgtccaaaacgttcggggagcgccaggaaatggatagaagcatgcgggagaatgccgccaagaacgagcgccttatgcaggaactgagagacacctttcatctcctgtctcccacaggacaggatctggtcaaataccggctttggaaggagcaagacggcgtgtgcgcttatagcctccagagactggatgttgaacagctgttcgagcctgggtacgtggacgtcgatcacatcgtgccgtattccctctcttttgacgaccgccggagcaataaggtcctggtgctttccagcgaaaacagacagaaaggcaaccgcctgcccctccaatacctgcagggaaagcggagagaggatttcattgtttggaccaattcttccgtgcacgactaccgcaaacggcagaacctgcttagagagaagctcagcgatgacgaagccgagggctttcgccagcggaatctgcaagatacacagcatatggcgagattcctgtataactacatctctgaccacctcgcttttgcccagtccgaagccctggggaaaaagcgggtcttcgctgtgagcggagccgttacctcccatcttcgcaagagatggggcctgtctaaagtgcgggctgatggggacctccaccatgccctggatgcggccgtcgtggcttgtacgacagacggaatgattcgcagaatcagcggctattacgggcacatcgagggcgaatattttcaagatgccgacggagctggctcccagcacgcccggaccaaggagagattccctgccccctggcctcgctttcgggatgagctgattgtgagactttctgaacagcccggggagccgctcctggacatcaatcctgctttctactgcgaatatggaaccgagcatattcgccccgttttcgtcagccggatgcctagacgcaaagtgacaggcccctcccacaaggagaccgtgaaaggggcggccgctgccgacgaaggactgctcacagtccggaaggccctgacggagcttaagctggataaagacggcgaaatcaaggattactacatgcctagctctgacaccctcctgtatgaggctctgaaagcccagcttagacgctttgggggcgatggaaagaaagcgttcgctgaacccttttacaagccgaaagccgacggcacacctgggcccctggtgagaaaggttaagaccacagagaaagccaccctcacggtgcccgtccatggaggcgctgcctccaacgataccatggtgcggattgacgttttctttatgcctggggatggatattactgggtgccgctgtatgtcgcggacacactcaagcccgagctgcctaatcgcgctgtggttgcccacaaaccctacagcgaatggcaagagatgagagaagaggatttcgtgttttctctttatcctaacgacctggtctacgtggaacacaagtccgagctcaaattcaccgtgcagaatgccgatagcacactggagaagacccggacgcaggcttctgcctttgtctacttcgttagcggcggcatctccgggggaacaatcaccgtgcgcacacatgacaacagctatggcattccctctctggggcttaagaccctgaaatccctctgtaagtaccaggtggacgtcctgggaaatgtgtttcctgttcacaaagaaaccagacaaaagttccggtga

SEQ ID NO: 3882 - RNA, 3255 nt, synthetic construct
  misc_feature 1..3255: note = Cas9 variant
  source 1..3255: mol_type = other RNA
atgaagaacaccctgtacggcatcgggctcgacattggagtggccagcgtcggctgggctgttgtggggctgaatggaacaggcgagcccgtggggcttcacagactgggagtccggatcttcgataaagccgaacagcctaagacgggcgagtccctcgcggctccgcgcagaatggcccggggcatgcgcagacggctgcgcagaaaagcccttcggcgcgctgacgtgtatgccctgctcgaaagatctgggctgagcacccgggaggaactggctcaaatgtttgaggccggaggcctcgaggatatttacgcgctgcgcacaagagcccttgacgaacccgttgggaaggctgagttctcccggatcctgctccatctggcccagcgcagaggatttaaatctaaccggagaaccgctagcgatggcgaagacgggcgccttctggccgcggtgaatgagaaccggagacgcatggcccagggaggctggcggacagtcggcgagatgctctatagacacgaggctttcgccctgcataagcgcaataaggctgatgactacctgtccaccgtggggcgggatatggttgccgaagaagcctctattctctttgagagacagcgcgctatgggatgcagctgggcggcccctgaactgcaagctgagtatctttccatcctgctccggcagcgcagcttcgacgagggccccgggggaaactctccttacggcgggaatcaggtggagaaaatggtcggaagatgtacatttgaacccgatgaacctcgggccgccaaggctgcctattccttcgagtactttagcctgcttcagaaactgaaccacatcagactcgcggaaaatggcgagacccggccgctgacgcaaccccagcgccagcagctgctctctctggctcataagacccctgacatttcccttgccagaatccggaaagagctggccctccccgaaacagtgcaattcaacggcgtgagatgccgcgctaatgagaccctggaagagagcgaaaagaaggagaaatttgcctgtcttcctgcttaccacaagatgcggaaagccctggatggggtcgttaagggaagaatttcttccctcagcatctcccagcgcgacgcggccgctacagccctgtctctgtataaaaacgaggacaccctcagagctaagctgacggaagccggcttccaggcgcccgagattgatgcccttgctgggctgacaggatttagcaaattcggccacctctccctgaaggcctgccggaagctgatcccgcatcttgaacaagggctcacctacgaccaggcttgtacagccgccggctatgatttcaaaggacacggcgctggggagcgcgcgtttaccctgcctgccgctgcccccgagatggaacagattaccagccctgtggtgagacgggccgtcgctcagacaatcaaggtggttaatggaatcattcgcgagatggacgcctctcccgcgtgggtgagaatcgaactggctcgggagctctccaaaacgttcggcgaacgccaagagatggatagaagcatgcgggagaacgccgcccagaatgaacgcctgatgcaggagcttagagacacctttcatctgctctctcccacagggcaggatctggtcaagtaccggctgtggaaagaacaagacggagtgtgcgcttatagccttagacgcctcgatgttgagcggctgttcgaacctggctacgtggacgtcgatcacattgtgccgtattccctgtcttttgacgacagacgcagcaacaaggtcctcgtgctgtccagcgagaaccggcagaaggggaatagacttcccctgcagtacctccagggcaaacgccgggaggatttcatcgtttggaccaactcttccgtgcacgactacagaaagcgccaaaatctgctgcgggaaaaacttagcggagatgaggccgaaggctttagacagcggaacctccaggacacacagcatatggcgcgcttcctgtataattacatttctgatcacctggcttttgcccaatccgaggccctcgggaagaaaagagtcttcgctgtgagcggagccgttacctcccatctgcggaagcgctggggcctttctaaggtgagagctgacggggatctgcaccatgccctcgacgcggccgtcgtggcttgtacgacagatggaatgatccggagaatcagcggctattacgggcacattgaaggcgagtatctgcaggacgccgatggagctggctcccagcacgcccgcaccaaagagcggtttcctgccccctggcctagattccgcgacgaactgatcgtgcggctttctgagcaacccgctgaaccgctcctggatattaaccctgagttttactgcgagtatgggaccgaacatatcagacccgttttcgtcagccgcatgcctcggagaaaggtgacaggacccggccacaaagagaccattaagggggcggccgctgccgacgaaggactgctcacagtgcgcaaagccctgacggagcttaagctggacaaggatggcgaaatcaaagactactacatgccttccagcgataccctcctgtatgaggctctgaaggcccagcttagacggttcgggggcgacggcaaaaaggcgtttgctgagcccttctacaaaccgaaggccgatggaacacctgggcccctggtccgcaaagtgaagaccacagaaaaggccaccctcacggttcccgtgcatggaggcgctgcctctaatgacaccatggtcagagtggatgtttttctggtgcctggggacggatattactgggtcccggtgtatacagcggataccctcaaacccgagctgcctaaccgggctgttgtgcagggcaagccctactccgaatggaaagagatgcgcgaagaggacttcatctttagcctttatcctaatgatctggtctacgtggagcacaagtctggcctcaaattcacactgcagaacgccgactccaccctggaaaagacgagaacacaaaccagcgcctttgcttacttcgtgtctgggagcatttccacagccagcatcaccattcggacccacgataatgcttatggaatcccctctcttggcgtcaagacactgaaaacgtttcataagtaccaggttgacgtgctcgggaacgtgttccctgtccacaaagagaccagacagaagtttcgctga

SEQ ID NO: 3883 - RNA, 3255 nt, synthetic construct
  misc_feature 1..3255: note = Cas9 variant
  source 1..3255: mol_type = other RNA
atgagactgggcctcgacatcgggaccaacagcattggatggtggctgtacggcacagaagggggacggatcacggaggtggtcgatggcggggttcgcattttctccgacggaagagatccccagtctaaggccagccttgctgtggaccggcgcgccgcgagatcccaacggcgcagacgggatcgctatctgagacggaaagctgccctcatgaagcgcatggcccaggtgggcctgatgcctgctgacccggccgaggctaaagtccttgaagtgctgaatccctacgagctcagagcctctggcctggatgggcctctgcccctcacccactttggacgggcgctgttccatcttaaccagcgcagaggctttaagagcaatcggaaaacagacagaggggataacgaatccggaaagatcaaggacgccaccgctcgcctggatcaggccatgatggctaaaggcgcccggacatatggggagttcctccacatgagacgcgcggccgctctggaccctaagtctgttcccagcgtgcggaccagacttacagtcgcccgccgggatgacgctgagaaagaagaggccggatacgacttttatcctgatagaaagcatctgtccgaagagttcgacaaactctgggccgctcaagcgcgccacgccccggatgtgctgaccgaggacctgcgggatgaaattgctacgatcatctttcatcagagacccctcaagacccctgaggttggcctgtgccttttcacaggccagcacggggtgcccgaacgcgacaagcggattcctagcgcccaccccctgaatcagagacggatcctcatggagaccgtcaacaatctgaaagtggccgctcaaggagaaccgtctcgccctcttacaagagaggagcgggatcagattgtgcatgccctggacaacaagaaacacaccaagtccctcagcggcatgacgatgaaactgaaggcgctggggaaagtcatcaagctcagacccgaacagggatttacactggagaccgctaatcgcgatgccattgcctgtgaccctgttcgggcttctctttcccatcccgatagattcggcgcccgctggagcacactggaatctgctgggcagtgggacgtggtgcaaagaatccgggccgtccagtccgacgcggagcacgccgatctcgtgggatggctgatggacgttcacggccttgatcgcgaccatgctgaagagaccgccaacgctcccctgcctgagggctacgggagactcggactgaccgccacaacgcggattctggcggccctcgaagctgatgtgctgaattatagcgccgctgtcgccgcctgcggctggcaccattccgacgggcgcaccggagaggtgcttgaatctctgccgtactacggcgagatcctcgaaagacacgttatccccgggacaggcgatcctaacgacgatgacgtgaagcggtatggacgcattaccaatcccacagtccatatcggcctgaaccagctgagacggcttgtgaatcgcattatcaccgtctacgggagacctgatgagattgtggttgagctcgctcgggacctgaaactgagcgaagatcaaaagaaagacgtgcagagagacatcaagaaaaacacggaggcggccatccgccggggaaagaagctcgaagagatgggcgtccccaacacaggggctaatagaatggtgctgcgcctttgggaggatctgggagacgatgttatgacccggaactgtccgtataccggcaaaagaatttccgccgggatgctctttgacggcagctgcgatgtggaccacatcctgccttactctcgcacactggatgactccttcgccaatcggaccctttgtctcaaggaagctaacagacagaaaacagataagacgccctgggaggcctggggagaaaccgagcagtgggaagcgattgctgccaatctgaaaaacctgcctgccaataaggcttggcgctttgcccccgacgcgatggagcggttcgagggcgaaaaggatttcagcgctagagccctcgccgacacacaatatctgtctcggatcgctcgcgcctaccttgatgctctgtatgacggggacgatggaaaaagccacgtctgggtggtgcctggcagactcaccgagatgctgcggcgccattgggggctgaacggagttgccgcgcttacagactccgataagcagaccgtcaaagccaagaatagaacggaccaccggcatcacgctattgatgccgctgtggtggccgccaccgacagaggcctcatcaaacgcatcgctgatatggcgaagcgggacgaatttaacggggccgaggaagtcgctagatctattcccccgccttgggagggcttccgcgatgacgtgagcgcccaggttacacggatcattgtgtcccacagagccgatcatggacgcatcgaccccgctgccagaaagagcggccgggactctacctccgggcagctgcacaatgatacagcgtacggaattggccgcgacgggaccgtcgtgagcagaaaacccctggcttctctctcccctaacgatatcgttgtgacgaagcggggagccaatattcgcgacgtcgatctgcaaaaacatcttgccagagtgacacacggcctggacgggaaggcttttgaggccgcgctcctggctttcgccgccagcccgatcctgcccgataacaccgacaatccttactttggccttcggcgcgttagactcgaagagacactgcaggaatccgctcgggtggaggtcgccgatcaggaaggaagaccctataaggcttacaagggcgactctaaccattgctatgagatctggtgtctgcctgatgggaaaattaagccccaggtggtgaccacctacgaggcccaccaaagcggagcggaaaagaaacctcaccccgccgctaagcgcctcatgcggatcttcaaaagagacatggtcatgctggagcgcgatggcgaaacaattatcgggtatgttcagaagatgaaacagaacggatccatttttgtggccccgcatacggaggctaatgccgacgcccgggacagagatcctaaggacgatttcaaacttatccagctgggcgctggctctctcgtgaaagcgaaggcccggcgcgtcatcgtggacgagatggggagactgcgggatcccggacctcccctgtga

SEQ ID NO: 3884 - RNA, 3258 nt, synthetic construct
  misc_feature 1..3258: note = Cas9 variant
  source 1..3258: mol_type = other RNA
atggacaagggcaccaacagcatcgggtgggccgctctgagactcgatgagcagggagaacccgtgggcattatcgaggccggggtccggatttacgcggacggacgcgaacctaaatccggcacatctctggctgaggggagacggatcgcccgcggaatgagcagacggcgcgatagatataagcggcgcagacggacggttcttaataccctgacagagttcggcctcatgccggccaccaaagctgcccgcaaggctctggtggccgagacaaacgacagacggtttggcgaggtggcgtccaatgtctacgcccttcgcgctagagccctggatgaaaaactccccctgtatcaactggggcgggctctcttccacctgaaccagagacgcggatttaagtctaatcggaagaccgacaaaagagataacgaccagggcaagattgccagcgcgatctcccgccttgggcggaaactggatgaggccggagctagaacactcggcgagttcctgcataagcagcacgccgctgggaaatgggtgcgcgttcggccttctagagtgcccggagaagacgataaggaggaagacggctacggcttttatcctgagcgcagcttccttgaacgggagtttgccgccatctgggaagctcaagcggccttctaccccgagctgctcaccgaggaaagacgcgatcatctgcactgggtcatgtttttccagcggcctctgaagagaccgacggtggggaaatgctcctttcatcccgacgaggaccggctccctaaggctcaccccctgttccaggaatttcgccttattaaagagctgaatgaactcgaggttgtgcacagaggagatcggagagagaagctgacccctgaccagcgcgatcggcttttcaaccaactgagaacacagcgcagctctgccttcaccgccctcagaaaaacaatcaaggctcccaccggcacgcggtttaataaagaatccgacgcccgcgataagctgaagggggacgaggtcgcggctgaaatgagccataaagatagattcggacaggcctggattggcatgccgctggccgagcggtgggctgtggtggccatgctcctggacacagaagatcctcttgaggtcaaggcttggctggaggaacgctatgggtttgccgcggacagaatcgatgccattgctgccgctaaactccccaccggatacggccggctgggcgagacagcccttcgcgacatgctggacgaactcagaaacgggaccgttaaggatgacgcgggacgggatgtggtgctgaccgagcgccaggccatggacaatatctggggcgataaccctgctctgcaaagagccgtcacagacgctcgggagctccctccctaccaggaagtgctggggagacgcattcccccgggaacgggcaaacccgccgatccttatgacgttcagaaggggcggcttaccaatcccacagtgcacatcggcctgaaccaactcaagagaatcgtcaatgtgctgatgcgccggcatggaagacctgagcagattgccctggaacttgctcgcgatctcaaactgaacgaggaacagaaggcggagaaaaaccgggagatcgccagaaataccaaggctgccgaagcccgcggcaaaaagctggaggaactcgggcacgctaacaatggatacaaccgggttctgcttaagctgtgggaggacctcaatctgaaacagcccgaaaacagagagtgtatttattgcggcaaggccatcgggattggaacactgctttctaatcaagtggatatcgaccacatcctcccgtggtccaaaaccctggatgacagccaggcgaaccggattgtctgtcatgtggagtgcaatcgccagaagggcaaccacgctcctgccgaagtcccccagtggcatgacagatacgatgacatcctggcccgggctgagcgcctccctagaaataaagcctggcggttcgggagagaagcgatgaagaagtttaaagatgacgagtctttcctggctcgccaacttacggatacacagtatctgtcccggctcgcccacgaatacctgggcgccctgtatcccgacgaggagcctgatgaatggggaggccccgctagacgcaaccatgtgcgggttattccggggagaatgaccgagatgcttcgccggcagtggggactcaatgccatcattagcgaccacaaccagaagaatagaaacgatcaccgccatcacgctatcgacgccatcgtggtcggcgtgaccacaagacggctgctgcaacgcattgcgaccgttgccgggggaagagaagctctcgccctggaggagacaatcggcaaaattgaacctccctggcccgggttttacgatgacgtgaaggctgccatcgatcggattgtcgtgtcccataaacctgaccacggctctcttccgaagcccggaaaacctggccgcacggccgggcagctgcacaacgacaccgcttacggattcacaggcgaggcgagaaatggggtgcccatcatggttcatcgggtcccttttgccagcctcaccgaaaaggatattccctccatcagagaccgccagctggctgatgccctgtatgccgctatcagcggaatttctggcaaggccgagcttgcggctgccctcgcccggttctccgaaagcgggccttacaaaggcatcagacacgtgcgcgtggtcgagcccgtgtctgttattgctatcaaggaccaggccggaaaagcgtataagggctacaaaggggatgctaactatcggtacgacgtgtgggagctgccgaatggaaagtggacacatgaagtcgtgagcatgtttaacgcccacagacctgattggcaatccgagattcggtctaagaatcccgccgctcgcaaagttctgagcctccatcagaacgacatggtggcctatgaacaccctcaggatggctacaccatcgggagagtcgtgaagttctccgctggaggccaaatggccctggcgggcaatcgggaagggggagcccttaaaagccgcgacgctgatcccgaagacagatttcggtacttctataagtctggcggggccatgcgcgacgttcagctgagacaggtgcgggtcgatgagacgggacgcgtgttcgacccgggccctcaggatagagagtcccggaacgctagaaaacaaaatgacgccgggtga

SEQ ID NO: 3885 - RNA, 3264 nt, synthetic construct
  misc_feature 1..3264: note = Cas9 variant
  source 1..3264: mol_type = other RNA
atgagatacaagatcggcctggacattgggatcaccagcgtgggatgggccgtcatgaacctcgatattccccggatcgaggacctgggcgttcgcattttcgatagagctgaaaatcctcagacaggggagtcccttgccctgccgcggcgcctcgcgagatctgctcggcgcagactgcggcgcagaaaacaccggcttgaacgcatcagacggctggtgatccgcgagggcattctcacgaaggaggaactggacaaactgtttgaggaaaagcatgagatcgatgtgtggcaactcagagtcgaagccctggaccggaaacttaacaatgatgagctggccagagtgctcctgcaccttgctaagcgccggggattcaagagcaacagaaaatccgagcgctctaataaggaaaacagcaccatgctgaaacatattgaggaaaatcgggccatcctctcctcttatagaacagttggggagatgattgtgaaggaccccaaatttgctctgcacaagcgcaacaagggagaaaattacaccaacacaatcgcccgggatgacctggagagagagattcgcctcatcttcagcaaacagcgggaatttggcaatatgtcctgcaccgaggagttcgaaaacgaatatatcacaatttgggcgagccagagacctgtcgcctctaaggatgacatcgagaaaaaggtgggcttttgtaccttcgagcccaaagaaaagcgcgctcctaaagccacgtacacctttcagtccttcattgcttgggagcatatcaataagctgcggcttattagcccctctggggccagaggactgacagatgaggaacggcgcctcctgtatgaacaagcgtttcagaagaacaaaatcacctaccacgacatcagaacacttctgcacctccctgacgatacctatttcaagggcattgtttacgacagaggggagtccagaaaacagaatgagaacatccgctttctggaactggatgcctaccatcagattcggaaggctgtggacaaagtctatggaaagggcaagtctagctccttcctcccgatcgatttcgacacgtttgggtacgccctgacacttttcaaagatgacgctgatattcacagctatctgagaaacgagtacgaacaaaatggaaagcgcatgcccaacctcgccaataaagtgtatgacaacgagctgatcgaggaacttctgaatctctcctttaccaagttcggccatctgtctctgaaagccctcagaagcatcctgccttacatggagcagggcgaagtgtattccagcgcttgcgagcgggcggggtacacatttaccggacccaagaagaaacagaagaccatgcttctgcctaacattcccccgatcgccaatcctgtcgttatgcgcgctctcacacaggccagaaaagtggtgaacgccattatcaagaaatacggctctcccgtctccattcacatcgaactggctcgggatctgagccaaacgttcgacgagcgcagaaagaccaagaaagagcaggacgaaaatcggaagaaaaacgagacagccattcgccagcttatggaatatgggctcaccctgaatcctacaggacacgatatcgtgaagtttaaactgtggtctgagcaaaacggcagatgtgcgtacagcctccagcccatcgaaattgagcggctgcttgagcccgggtatgttgaagtggaccatgtcatcccttactcccgctctctggatgacagctataccaataaggtgctcgttctgacgagagagaaccgggaaaaaggaaatcggattccggctgagtacctgggcgtgggcacagaacgctggcagcagttcgagacctttgtccttaccaacaagcaattctccaagaaaaagcgggatagactcctgcgcctgcactatgacgagaacgaagagacagaatttaaaaatcggaacctcaatgataccagatacatcagccgcttctttgccaacttcattcgggagcatctgaagttcgccgagtctgacgataaacagaaggtgtacacagtcaatgggagagtgacggctcaccttcgctcccggtgggaatttaacaagaatagagaggaaagcgacctgcatcacgccgttgatgctgtgatcgtcgcctgcaccacaccctctgacatcgcgaaagtgaccgccttctatcagcggcgcgagcagaacaaggaactcgctaaaaagaaagagcctcactttccccaaccttggccccatttcgccgatgagctgagagctcggctgtccaagcacccgaaggaaagcattaaagcccttaatctcggaaactacgacgaccagaagctggagtccctgcagcctgtttttgtgtctcgcatgcccaaaagaagcgtcacaggcgcggcccatcaggaaaccctccggagatatgtggggatcgatgagcgctccggaaagattcaaacggtggttaaaaccaagctgtctgaaatcaaacttgacgctagcggccacttccctatgtacgggaaagagtccgatccccggacatatgaggccattagacagcgcctgctcgaacacaataacgaccctaagaaggcttttcaggagcccctgtacaagccgaaaaagaatggcgaacctggacccgtcatccggaccgtgaaaatcattgatacaaagaaccaggtgatccccctgaatgacggcaagaccgtcgcctataacagcaacattgtgagagttgatgtgttcgagaaagacgggaagtactactgtgtccctgtgtatacgatggatatcatgaaaggcattcttccgaataaggccatcgaacccaacaaaccttactctgagtggaaggagatgacagaagactatacctttcgcttctccctctaccccaatgatctgatccggattgagctgcctagagaaaagacagttaaaaccgctgcgggagaggagatcaacgtgaaggacgtctttgtgtattacaaaaccattgatagcgccaatgggggactcgaactgatctctcatgaccaccgcttctcccttagaggcgttgggagccggacactgaagcgctttgagaaatatcaagtggacgtcctcggcaacatttacaaggtgagaggagaaaagcgggtgggcctggcttctagcgcccattccaaacccgggaagacgatccgccctctgcagagcaccagagattga

SEQ ID NO: 3886 - RNA, 3264 nt, synthetic construct
  misc_feature 1..3264: note = Cas9 variant
  source 1..3264: mol_type = other RNA
atgctgagaatgaagtacgccatcggcctcgacattgggatcgctagcgtgggatatgccgtcctggcgcttgatcacgaggaaaacccctggggcattatccggctggggtcccgcattttcgacgttgctgagaatcctaaagatggagcctctctcgccctgccgagacgggaagctcgcagcgtgagacggcgccttagacggcatcaccatcgcctggagagaatcaagaacctcctgatcaataccgaatttattacaaaagacgagctgctccacctgtacgatggcaacctttccgacgtgtatgagctgcgggtcaaggccctcgattactctgtgacgaatgctgaactgacccgcatccttctgcatctcgcccagagacgggggttcaaaagcaaccgcaagtccgacgcgaatgataaggaggccggacaactgctggaagctgtttctgccaacgctaaaagaatgcaggagaatcactatcggacagtgggcgagatgttttacaaggacgatctcttcagcaaatataagagaaacaaaggcgggacctacctgacaaccgtccaccgcgacatgattgccgcggaagcccggacaatccttgagaagcagtttgctctgggaaataacatttgcacccaggatttcatcgacaagtacctctccattctgcttagccaaagacagtttgacgaaggccccggggagccttctccctatgccggaaatcagatcgctaacatgatcggcaaatgtacgttcgaacctaatgagtaccgcgccgccaaggcttcctatagctttgagcggttcaacctgctccagaaagtgaaccatctgagactgctcctggaagggaagtctattgcgcttgataatgagcaacgcaaaaagatcattgccctggctcacgacaaagccgatctccggtactcccatatcagaaaggccctgggacttgacgaaaaggttctgtttaacaccattacatataatgatgacgtgagcgtcatcgagaaaaagaccaaattcaactttctccaggcttaccaccagatcaagaaagtgctggccgaagatatgcagaagctgacaaccgagcaactcgacaatattggccagatcctgtctacgtataagtccgataacaaacgcacagaggaacttagcgcgctgggcctcgagaagaaaattatcgacgctctgctggggattaatggactttccaagttcgcccacctctctctgaaagccctgcggaagatcaacccctacctcgaagagggcaagatctacaatgaggcttgcaccgccgctgggtatgatttcaaagcccatgcgaacacacagaagaccgagctgcttcctgcctacaaagaggaaatggacgacattaccagcccggtggctagacgcgccatcgctcaatccattaaggtcatcaatgccattatccgggagcagaaaggaagccccctgtatattaacatcgaactcgcgagagagatggccaagggctttgatgagcggacacagatcgacaaggctaataaagaaaaccaggccaagaatgagcgcattatggaaagaatccggacggagttccacaaagctaaccctaccgggatggatctgattaagctgaaactttgggaagaacaagacggaagatctccctactcccagaaggccatcagcattaaccgcctctttgagcctggctatgttgatatcgaccatatcgtgccctactctattagcttcgatgactcctttaaaaataaggtgctggtcttctctgatgaaaaccgggacaagggcaatagactgccgatcgcctatctccagagcaaatttggggctaaggcggccgagaacttcatgatttgggtgcagtccaatatcaaagattacaagaaacgccaaaagctgcttaagagagaaattacagaggaagacatcaacaaatttaaggagcggaatctgcaggataccaaaacaatcagccgcttcctctacaactatattaatgactacctgctgtttgctccttctgacaccggaaagaaaaagagagttacggccgtgaacggcacaatcaccgcctatcttcggaagcgctgggggattaataaaatcagagctaacggagataagcaccatgccgtcgacgcggtggttattgcttgtaccacagataaaatgatcaaggacctctccagcttctctcggtaccacgagctggaatatacccacacagatacggagtcctttctggtgaatagcctcaccggcgaaatcctgaaacgcttcccctacccttgggaggacttcagacccgaacttatggcccggctgtccgataaccccgccgacgctctccgcaagctgaatctgatcttttatcatgggattgatctttctacaattaagcctatcttcgtcagcagaatgccgcggcacaaagtgaccggcgccgcgcataaggctacaattaaatccgccagatgcctcgacaacggaatcgtcatttgtaagacctctctgcagaacctgaaactcgataaggagggcgagatcgccaattactacgctcccgaaagcgacacgatcctgtataacgcccttaaagagcgcctgcggtcctacgataataagcctgctaaggcctttgcggaacccttctataaacctaaggccgacgggacccccggaccgctcgtgaaaaaggttaaagtgtacgagaagtctacactgaacgtcgctgtgcagcaaaataccgccgttgctgacaacgattctatggtgagagtcgacgtgtttcacgtgaagggcaatgggtattacctggttcctatttatatcgccgatacacttaaaaaggagctgcccaacaaagccattgtcgcttacaagccttacgcggactggcccgtgatggatgactccaatttcatctttagcctctatcctaacgatctgattaaattcgaacacaagaatagcgtgaagtttgccaaagtcaacaaggagtccaccctcaatgacttctacagcacgaaatctgaaatcgtgtattttaagggatgcaacatcaatacaggcgctattaccatcattaaccatgagaacacatacgttgtgagctccctgggggtcaaaacccttcccagcctggaaaagtatcaggccgatgtgctcggcaattacaccaaggttaaaaaggaggtgcgcaaaccgttccggtga

SEQ ID NO: 3887 - RNA, 3264 nt, synthetic construct
  misc_feature 1..3264: note = Cas9 variant
  source 1..3264: mol_type = other RNA
atgagatacaagatcggcctggacattgggatcaccagcgtgggatgggccgtcattaacctcgatatcccccggattgaggacctgggcgttcgcatcttcgatagagctgaaaatcctcagacaggggagtcccttgccctgccgcggcgcctcgcgagatctgctcggcgcagactgcggcgcagaaaacaccggcttgaacgcatcagacggctgattatccgcgagggcattctcacgaaggaagaactggacaaactgtttgaggaaaagcatgagatcgatgtgtggcaactcagagtggaagccctggaccggaaacttaacaatgatgagctggccagagtcctcctgcaccttgctaagcgccggggattcaagagcaacagaaaatccgagcgctctaataaggaaaacagcaccatgctgaaacatattgaggaaaatcgggccatcctctcctcttatagaacagtgggggagatgattgttaaggaccccaaatttgctctgcacaagcgcaacaagggagaaaattacaccaacacaatcgcccgggatgacctggagagagagatccgcctcattttcagcaaacagcgggaatttggcaatatgtcctgcaccgaggagttcgagaacgaatatatcgcgatttgggccagccagagacctgtggcttctaaggatgacatcgagaaaaaggtcggcttttgtacattcgagcccaaagaaaagcgcgcccctaaagctacctacacgtttcagtccttcattgcctgggagcatatcaataagctgcggcttatcagcccctctgggaccagaggactgacagatgaggaacggcgcctcctgtatgaacaagcgtttcagaagaacaaaattacctaccacgacatcagaacacttctgcacctccctgacgatacctatttcaagggcattgtgtacgacagaggggagtccagaaaacagaatgagaacatccgctttctggaactggatgcctaccatcagattcggaaggctgttgacaaagtgtatggaaagggcaagtctagctccttcctcccgatcgatttcgacacgtttgggtacgccctgacacttttcaaagatgacgctgatatcagaagctatctgcgcaacgagtacgaacaaaatggaaagagaatgcccaacctcgccaataaagtctatgacaacgagctgattgaggaacttctgaatctctcctttaccaagttcggccacctgtctctgaaagccctccggagcatcctgccttacatggagcagggcgaagtgtattccagcgcttgcgagcgcgcggggtacacatttaccggacccaagaagaaacagaagaccatgcttctgcctaacattcccccgatcgccaatcctgtggtcatgagagctctcacacaggcccggaaagttgtgaacgccattatcaagaaatacggctctcccgtgtccattcatatcgaactggctcgcgatctgagccaaacgttcgacgagagacggaagaccaagaaagagcaggacgaaaatcgcaagaaaaacgagacagccatcagacagcttatggaatatgggctcaccctgaatcctacaggacacgatattgtcaagtttaaactgtggtctgagcaaaacggccggtgtgcgtacagcctccagcccatcgaaattgagcgcctgcttgagcccgggtataccgaagtggaccacgttatcccttactccagatctctggatgacagctatacgaataaggtgctcgtcctgacaaaagagaaccgggaaaagggaaatcggattccggctgagtacctgggcgtgggcaccgaacgctggcagcagttcgagacctttgttcttacaaacaagcaattctccaaaaagaaacgggatagactcctgcgcctgcattatgacgagaacgaagagaccgaatttaagaatcggaacctcaatgatacaagatacatcagccgcttctttgccaacttcatccgggagcacctgaaattcgccgagtctgacgataagcagaaggtgtacacggtcaatgggagagtgaccgctcatcttcgctcccggtgggaatttaacaaaaatagagaggaaagcgacctgcaccatgccgtcgatgctgtgattgttgcctgcacaaccccctctgacatcgcgaaggtgacagccttctatcagcggcgcgagcagaacaaagaactcgctaagaaaaccgagcctcactttccccaaccttggccccacttcgccgatgagctgagagctcggctgtccaagcatccgaaggaaagcattaaagcccttaatctcggaaactacgacgaccagaagctggagtccctgcagcctgtctttgtgtctcgcatgcccaaaagaagcgttacgggcgcggcccaccaggaaaccctccggagatatgtggggatcgatgagcgctccggaaagattcaaacagtcgtgaaaaccaagctgtctgaaatcaaacttgacgctagcggccatttccctatgtacgggaaagagtccgatccccggacatatgaggccatcagacagcgcctgctcgaacacaataacgaccctaagaaggcttttcaggagcccctgtacaagccgaaaaagaatggcgaacctggacccgtgattcggaccgttaaaatcattgatacgaagaaccaggtcatccccctgaatgacggcaagacagtggcctataacagcaacattgtgagagtcgatgtgttcgagaaagacgggaagtactactgtgttcctgtgtataccatggatatcatgaaaggaatccttccgaataaggccattgaacccaacaaaccttactctgagtggaaggagatgacagaagactatacctttcgcttctccctctaccccaatgatctgatccggattgagctgcctagagaaaagatcattaaaaccgctggcggggaggagatcaagattaaagacctctttgcgtattacaagacaatccacagcggaacggccggcctggaacttgtctctcatgattgctccttcagcctgtctggggtgggcagccgcaccctcaaaagatttgagaagtatcaagttgacgtgctgggaaacatctacaaggtccggggcgaaaaacgcgtggggctggcttccagcgcccactctaagacaggagagaccattagaccccttcagtccacacgggactga

SEQ ID NO: 3888 - RNA, 3264 nt, synthetic construct
  misc_feature 1..3264: note = Cas9 variant
  source 1..3264: mol_type = other RNA
atgagatacaagatcggcctggacattgggatcaccagcgtgggatgggccgtcattaacctcgatctgccccggatcgaggaccttggcgttcgcattttcgatagagctgaaaatcctcagacaggggagtccctggccctcccgcggcgcctggcgagatctgctcggcgcagacttcggcgcagacggcaccgcctggaaagaatccggcgcctcctgacgagagagaacgtgctgacccaagaggaactcgacaaactgtttgagaagaaacatgaaatcgatgtgtggcagcttcgggtcgaggccctggacagaaagctcaataacgatgaactggcccgcgtgcttctgcacctcgctaaacggagaggattcaagagcaatcgcaagtccgagcggtctaacaaagagaatagcacaatgctgaagcatattgaagagaacagatccatcctgaccggctatcgcacagttggggaaatgattgtgcgggaccccaaatttgtcctccacaagagaaataaaggagagaactacaccaatacaatcgcccgcgatgacctggaacgggagattcagcttatcttcgctagacagcgcgagtttggcaacatgatttgcaccgaagccttcgagaatgaatatatcgcgatctggtctagccaacggcctgtggcctccaaggatgacattgagaagaaagttggcttttgtacgttcgaacccaaggagaaaagagctcctaaggccacctacacatttcagagcttcatcgcttgggagcatattaacaaactgcggctcgtgtctccctccgggacccgcgaactgacagatgaggaaagacggcttctgtatgagcaggcctttcagaagaataaactcacctaccacgacatcagaacgctgctgcacctccctgacgatacatatttcaagggaattgtctacgactggggcgaaccgctgaagcaaaacgagaacatccgctttcttgagctggatgcgtaccatcagatccggaaaaccgtggacaaggtgtatgggagaggaaaatctagctccttcctccccattgatttcgacacatttggctacgccctgacccttttcaaggatgacgctcacatccgcagctatctgagaaatgaatacgagcagaacgggaaacggattgccaatctcgctaacaaggtctatgataatgaactgatcgaggagctgctcaacctgtcttttaccaagttcggacatctttccctgaaagccctccgcaatattctgccttacatggaacagggcgaggtttatagctccgcctgcgaaagagctggctacacatttacggggcccaccaagaaacaaaagacagtgctgcttcctaccattcccccgatcgcgaaccctgtggtcatgcgggccctcacacaggctcgcaaagtggttaatgccatcatcaagaagtacggatctcccgtgagcattcacatcgagctggccagagacctgtcccagaccttcgatgaacggaaaaagacgaaaaaggagcaagacgagaaccgcaaaagaaatgaaacagctattcggcagctcatcgagtatggcctgacccgcaaccctaccgggcacgacattgtcaagtttaagctgtggagcgaacagaatggaagatgtgcctactctctgcagcccatcgagatcaaacggctcctggaacccggctatgtggaggttgatcatgtgattccttactccagaagcctggacgattcttatacaaacaaggtccttgtgctcaccaaagagaatcgcgaaaaggggaaccggatcccggcggagtacctgggagtcggcacagaaagatggcaacagttcgagacgtttgtgctgaccaacaaacagttcagcaagaaaaagcgcgaccggctcctgagacttcactatgatgaaaatgaggaggctgaatggaagaaccgctccctgaatgacacacggtacatttctagatttttcgccaactttatccgcgagcatctcaaattcgccgatagcgacgataagcagaaagtttacaccgtgaatggcggggtcacagctcaccttcggtccagatgggacttcaacaagaatcgggaagagagcgatctgcatcacgccgtggacgctgccattgttgcgtgcaccacgctttctgatatcgcccgcgtgaccgctttttatcaaagacgggagcaggccaaagaactcgctaagaagacagagccccacttccctcagccctggcctcattttgccgacgaactgcgcgcgagactgtccaaaaaccccaaggagagcatcaaagccctcaatctgggaaactacgacaatgaaaaacttgagtctctgcagccggtcttcgtgtcccggatgcctaagagaagcgtgaccggcgctgcccaccaagagacactccgccggtatattgggatcgatgaaagatccggaaagattcagaccgttgtcaagacgaaactgtctgagatcaagctggacgctagcggccattttcccatgtacgggaaagaatccgatcctcgcacatatgaggccattcggcttagactcctggaacacaacaatgacccccgcaaggccttccaggagcctctgtacaaacccaagaagaacggcgagctcggaccgatcatccggaccgtgaaaattatcgatacaaagaatcaggtgattcctctgaacgacggcaaaaccgtcgcttataactctaatatcgtgagagttgatgtgtttgaaaaggacgggaaatactactgtgtccccgtgtataccatggatattatgaagaaagttcttcccaacaaggcgatcgagcctaataagccgtacagcgaatggaaagagatgacagaagactatacgttccgcttttccctgtaccccaacgatctcatcagaattgagctgcctcgggagaagaccgtgaaaacaaccgccggacacgaaatcaatattaaggacgtcttcgtgtattacaaaacaatcgatagcgctaccggcgggctggagcttatttctcatgacaactcctttagcctgcgcggaatcggctctagaacgctcaagcggttcgaaaagtatcaagttgacgtgctggggaatatttacaaagtccgcggcgagaagagagtgggactcgcctccagcgcccaccccgagacacgggaaaccatcagacctctgcagtctacccgcgattga

SEQ ID NO: 3889 - RNA, 3264 nt, synthetic construct
  misc_feature 1..3264: note = Cas9 variant
  source 1..3264: mol_type = other RNA
atgaagaaactggtgctcggcctggacatcggggtcgccagcgttggatggggcattatcgatgctgagaacggggacgtggtggataccggagtcagacttttctcctctcgggacgccagcgaaaatgagtcccgcagaacatctcggcagagccgcagactgtcccggcgcaagaaacacagacgggaacgcattaagcaactcctgcttgcgcatgatatggacatctgcgatattgtgaacgagaatccctacgaactgagagttaaaggcctcaacgagaagctggaggtgtctgaaatctatgtcgctctgacgcacctcgccaagcggcgcggggtgagctacctggacgatgttgtggaggaaggaggcaccatcaaatccgagcatcttaataagaacatggaggaaattaaaagcggcaagatgccttgtgagatccagctggaaagatttgagaaatatgggcaggtccggggaatgattgaaatcaatcaggacacagaggagtcttccttcctcgtgaacatttttcgcaccagcgattacatcaaggaagccaagacaattctggctacccaacagaaattccacaagcagatcacaaatgagtttatcgacgaatatattcatatcatggcctctaaaagagattacttcattggcccggggaacgagaagtcccggaccgactatggagtgtacagaacgaatggcgacacctgggataacctttttgaaatcctgattgggaaatgcagcgtcttccccgaggagacacgcgctgcccggtcttcctacgttgcgcaggaatttaatctcctgaacgacctgaataacctcaagatcagcaacctggagtccggaaaactttctgccagccaaaagcacgatatcgtggaaaaggtgaaaaattccaagaaattcggcaccaaggacctgctcaaatatattgctagcgtctgtgagtgcaagatcgaagatattggcgggtgtagagtggacaagaaccgcaaacctatcatgcacacatttgagaattaccggaaggttcataacgccctgaatgaggctggagtggatcttagactgtctgaaaccgactatgatgagctcatgaaaattatgacgctgaactccgaaacactggagatcaagaaacagtgcaaggagaagctcccccagctgaccgaagactaccttaatgtctgtctggtgctcaacaaaaagggcgccttcagcgggtggcacgcgctgtctcttaaagccatgaagctgatgatgcctgagctctatggaacaagcaaaaatcagatgcaaatcattcataccatgcagctgggcaaggcttacctgaagcccctcaaccagcaaaaatatcttaattccgaagccatccttgaggaaatttacaaccctatcgctgcccgctctattcggcagaccatcaaggttacaaatgccattctgaaaaagtacgggcacctcgatagcgtgatcatcgagatgccgagagactatcagacgtccgaggacgaacgcaaaatgattgagaagatgcagaaagaaaacgagaaggaaaagaaagctgcgctgaagcgggccagagaggagtacccctttcctgatgaggctttccgcaatcacaaagaactggccaccaagctgcggctctggtatcaacaggaccagttctgcgtctacagcggaagaaaaatctctgtggtcgatctggtgcggaaccccaaccagtttgaaattgaccatatcattcctcaatccgttagcctggatgactctctcaataacaaggtgctgtgtttctccgaggaaaatcagaagaaaggccagcagacacccttttattaccacaagggcaaaagcgggaactggacctatgagcaatacaaacttttcgtcgagaaactgtttgataagaagaaaatctccaataagaaacgcgaactcctgctgttcgaggaagacatcaacaagtgggatgtgagacggggatttattgccagaaatcttgttgacacacgctacgcttctcgggtgatcctcaacagctatcagcagtacttcggcaatcatgagatggggaccaaagtcaaggtggtgagaggaaagtttacgtcccagctgcgcaaaaagtggagaattttcaaagatcggaacgagtctcacagccatcacgccatcgacgcgctgattgttgctgccacagccaatctccgcctgtggaagaaaaacacccttggcgtctccgatgaagggaaggtgtatgacaaagagaccggcgaaatcctgccgtttgagaagctcacagaaagcgagtacaatgagatgatgaacaaggaaccttatctgaatttcaaaaccaagctgcaaaacatcgagacaaaagtgaagtactcttatagagtctccaaaaaggtgaaccggaagattagcgacgctacgatctactctacccgcgaaagagatggaattgactacatcgttggcaaaattaagaatatctatgatgtgaaaacatacaaggaccagtttcttaaacggtataagaagaacaaagagcagttcctcatgtaccaacacgatccccagaccttcgccatcctggaaaatattatggctacatatcaggacgccgagaacccttttctggcgtacaagaaagagtatggggtcatccgcaagtactccaaaaagggaggcgggagccccgtgacctctctcaagttcattgataaagttctgggacagaagatcgaccttacggccaaaaatcaagctgccctgcccaagaacaaaaaggtggtcctccagagcattaccccttacagagctgatgtgtattacgacgaaatcgataagcggtatcatctgattggcgttaaatactccctgtttagcttctctaagcaggggtatgtgatcaatccgatcgcctaccagaaacttctcgagaaggaacaaattcactccgagatgaaattttgcttcagcctgtatcgcgaagacatcattgagtttggcgaggatcccgactccctgacaagataccggttctggtctaagaacgaaagcggaaagaataagatcgaggtcaagcctattgaaaaacccaactttgagaagcagaccgtgctcacaatcaccaaaaagatcaaaattctgaataagtaccagacggacgtgcttggcaactccttcaaggcgcaggaggaaaaagatcctagaaatatcgagtga

SEQ ID NO: 3890 - RNA, 3264 nt, synthetic construct
  misc_feature 1..3264: note = Cas9 variant
  source 1..3264: mol_type = other RNA
atgagatacaagatcggcctggacattgggatcaccagcgtgggatgggccgtcatgaacctcgatattccccggatcgaggacctgggcgttcgcattttcgatagagctgaaaatcctcagacaggggagtcccttgccctgccgcggcgcctcgcgagatctgctcggcgcagactgcggcgcagaaaacaccggcttgaacgcatcagacggctggtgatccgcgagggcattctcacgaaggaagaactggacaaactgtttgaggaaaagcatgagatcgatgtgtggcaactcagagtcgaagccctggaccggaaacttaacaatgatgagctggccagagtgctcctgcaccttgctaagcgccggggattcaagagcaacagaaaatccgagcgctctaataaggaaaacagcaccatgctgaaacatattgaggaaaatcgggccatcctctcctcttatagaacagttggggagatgattgtgaaggaccccaaatttgctctgcacaagcgcaacaagggagaaaattacaccaacacaatcgcccgggatgacctggagagagagattcgcctcatcttcagcaaacagcgggaatttggcaatatgtcctgcaccgaggagttcgagaacgaatatatcacaatttgggcgagccagagacctgtcgcctctaaggatgacatcgagaaaaaggtgggcttttgtaccttcgagcccaaagaaaagcgcgctcctaaagccacgtacacctttcagtccttcattgcttgggagcatatcaataagctgcggcttattagcccctctggggccagaggactgacagatgaggaacggcgcctcctgtatgaacaagcgtttcagaagaacaaaatcacctaccacgacatcagaacacttctgcacctccctgacgatacctatttcaagggcattgtttacgacagaggggagtccagaaaacagaatgagaacatccgctttctggaactggatgcctaccatcagattcggaaggctgtggacaaagtctatggaaagggcaagtctagctccttcctcccgatcgatttcgacacgtttgggtacgccctgacacttttcaaagatgacgctgatattcacagctatctgagaaacgagtacgaacaaaatggaaagcgcatgcccaacctcgccaataaagtgtatgacaacgagctgatcgaggaacttctgaatctctcctttaccaagttcggccatctgtctctgaaagccctcagaagcatcctgccttacatggagcagggcgaagtgtattccagcgcttgcgagcgggcggggtacacatttaccggacccaagaagaaacagaagaccatgcttctgcctaacattcccccgatcgccaatcctgtcgttatgcgcgctctcacacaggccagaaaagtggtgaacgccattatcaagaaatacggctctcccgtctccattcacatcgaactggctcgggatctgagccaaacgttcgacgagcgcagaaagaccaagaaagagcaggacgaaaatcggaagaaaaacgagacagccattcgccagcttatggaatatgggctcaccctgaatcctacaggacacgatatcgtgaagtttaaactgtggtctgagcaaaacggcagatgtgcgtacagcctccagcccatcgaaattgagcggctgcttgagcccgggtatgttgaagtggaccatgtcatcccttactcccgctctctggatgacagctataccaataaggtgctcgttctgacgagagagaaccgggaaaaaggaaatcggattccggctgagtacctgggcgtgggcacagaacgctggcagcagttcgagacctttgtccttaccaacaagcaattctccaagaaaaagcgggatagactcctgcgcctgcactatgacgagaacgaagagacagaatttaaaaatcggaacctcaatgataccagatacatcagccgcttctttgccaacttcattcgggagcatctgaagttcgccgagtctgacgataaacagaaggtgtacacagtcaatgggagagtgacggctcaccttcgctcccggtgggaatttaacaagaatagagaggaaagcgacctgcatcacgccgttgatgctgccatcgtggcgtgcaccacaccctctgacatcgccaaagtcaccgctttctatcagcggcgcgagcagaacaaggaactcgccaaaaagacagagcctcactttccccaaccttggccccatttcgctgatgagctgagagcccggctgtccaaacacccgaaggaaagcattaaggcgcttaatctcggaaactacgacgaccagaaactggagtccctgcagcctgtgtttgtttctcgcatgcccaagagaagcgtgaccggcgccgctcatcaggaaacgctccggagatatgtcgggatcgatgagcgctccggaaaaattcaaaccgtggtgaagacaaaactgtctgaaatcaaacttgacgccagcggccacttccctatgtacgggaaggagtccgatccccggacctatgaggctattagacagcgcctgctcgaacacaataacgaccctaagaaggcctttcaggagcccctgtacaaaccgaagaaaaatggcgaacctggacccgttatccggacagtcaagatcattgataccaaaaaccaggtgatccccctgaatgacggcaagacggtggcctataacagcaacattgtcagagtggatgttttcgagaaggacgggaaatactactgtgtgcctgtctatacaatggatatcatgaagggcattcttccgaataaagctatcgaacccaacaagccttactctgagtggaaagagatgaccgaagactatacatttcgcttctccctctaccccaatgatctgatccggattgagctgcctagagaaaagaccgtgaagaccgcggccggagaggagatcaacgttaaagacgtgtttgtctattacaagacaattgatagcgctaatgggggactcgaactgatctctcatgaccaccgcttctcccttagaggcgtggggagccggacgctgaaacgctttgagaagtatcaagttgacgtgctcggcaacatttacaaagtcagaggagaaaagcgggtgggcctggcctctagcgcccattccaagaccggggagacagtgcgccccctgcagagcaccagagattga

SEQ ID NO: 3891 - RNA, 3264 nt, synthetic construct
  misc_feature 1..3264: note = Cas9 variant
  source 1..3264: mol_type = other RNA
atgagatacaagatcggcctggacattgggatcaccagcgtgggatgggccgtcatgaacctcgatattccccggatcgaggacctgggcgttcgcattttcgatagagctgaaaatcctcagacaggggagtcccttgccctgccgcggcgcctcgcgagatctgctcggcgcagactgcggcgcagaaaacaccggcttgaacgcatcagacggctggtgatccgcgagggcattctcacgaaggaagaactggacaaactgtttgaggaaaagcatgagatcgatgtgtggcaactcagagtcgaagccctggaccggaaacttaacaatgatgagctggccagagtgctcctgcaccttgctaagcgccggggattcaagagcaacagaaaatccgagcgctctaataaggaaaacagcaccatgctgaaacatattgaggaaaatcgggccatcctctcctcttatagaacagttggggagatgattgtgaaggaccccaaatttgctctgcacaagcgcaacaagggagaaaattacaccaacacaatcgcccgggatgacctggagagagagattcgcctcatcttcagcaaacagcgggaatttggcaatatgtcctgcaccgaggagttcgagaacgaatatatcacaatttgggcgagccagagacctgtcgcctctaaggatgacatcgagaaaaaggtgggcttttgtaccttcgagcccaaagaaaagcgcgctcctaaagccacgtacacctttcagtccttcattgcttgggagcatatcaataagctgcggcttattagcccctctggggccagaggactgacagatgaggaacggcgcctcctgtatgaacaagcgtttcagaagaacaaaatcacctaccacgacatcagaacacttctgcacctccctgacgatacctatttcaagggcattgtttacgacagaggggagtccagaaaacagaatgagaacatccgctttctggaactggatgcctaccatcagattcggaaggctgtggacaaagtctatggaaagggcaagtctagctccttcctcccgatcgatttcgacacgtttgggtacgccctgacacttttcaaagatgacgctgatattcacagctatctgagaaacgagtacgaacaaaatggaaagcgcatgcccaacctcgccaataaagtgtatgacaacgagctgatcgaggaacttctgaatctctcctttaccaagttcggccatctgtctctgaaagccctcagaagcatcctgccttacatggagcagggcgaagtgtattccagcgcttgcgagcgggcggggtacacatttaccggacccaagaagaaacagaagaccatgcttctgcctaacattcccccgatcgccaatcctgtcgttatgcgcgctctcacacaggccagaaaagtggtgaacgccattatcaagaaatacggctctcccgtctccattcacatcgaactggctcgggatctgagccaaacgttcgacgagcgcagaaagaccaagaaagagcaggacgaaaatcggaagaaaaacgagacagccattcgccagcttatggaatatgggctcaccctgaatcctacaggacacgatatcgtgaagtttaaactgtggtctgagcaaaacggcagatgtgcgtacagcctccagcccatcgaaattgagcggctgcttgagcccgggtatgttgaagtggaccatgtcatcccttactcccgctctctggatgacagctataccaataaggtgctcgttctgacgagagagaaccgggaaaaaggaaatcggattccggctgagtacctgggcgtgggcacagaacgctggcagcagttcgagacctttgtccttaccaacaagcaattctccaagaaaaagcgggatagactcctgcgcctgcactatgacgagaacgaagagacagaatttaaaaatcggaacctcaatgataccagatacatcagccgcttctttgccaacttcattcgggagcatctgaagttcgccgagtctgacgataaacagaaggtgtacacagtcaatgggagagtgacggctcaccttcgctcccggtgggaatttaacaagaatagagaggaaagcgacctgcatcacgccgttgatgctgtgatcgtcgcctgcaccacaccctctgacatcgcgaaagtgaccgccttctatcagcggcgcgagcagaacaaggaactcgctaaaaagacagagcctcactttccccaaccttggccccatttcgccgatgagctgagagctcggctgtccaaacacccgaaggaaagcattaaggcccttaatctcggaaactacgacgaccagaaactggagtccctgcagcctgtttttgtgtctcgcatgcccaagagaagcgtcaccggcgcggcccatcaggaaacgctccggagatatgtggggatcgatgagcgctccggaaaaattcaaaccgtggttaagacaaaactgtctgaaatcaaacttgacgctagcggccacttccctatgtacgggaaggagtccgatccccggacctatgaggccattagacagcgcctgctcgaacacaataacgaccctaagaaggcttttcaggagcccctgtacaaaccgaagaaaaatggcgaacctggacccgtcatccggacagtgaagatcattgataccaaaaaccaggtgatccccctgaatgacggcaagacggtcgcctataacagcaacattgtgagagttgatgtgttcgagaaggacgggaaatactactgtgtccctgtgtatacaatggatatcatgaagggcattcttccgaataaagccatcgaacccaacaagccttactctgagtggaaagagatgaccgaagactatacatttcgcttctccctctaccccaatgatctgatccggattgagctgcctagagaaaagaccgttaagaccgctgcgggagaggagatcaacgtgaaagacgtctttgtgtattacaagacaattgatagcgccaatgggggactcgaactgatctctcatgaccaccgcttctcccttagaggcgttgggagccggacgctgaaacgctttgagaagtatcaagtggacgtcctcggcaacatttacaaagtgagaggagaaaagcgggtgggcctggcttctagcgcccattccaagcccgggaaaaccatccgccctctgcagagcacaagagattga

SEQ ID NO: 3892 - RNA, 3264 nt, synthetic construct
  misc_feature 1..3264: note = Cas9 variant
  source 1..3264: mol_type = other RNA
atgagatacaagatcggcctggacattgggatcaccagcgtgggatgggccgtcattaacctcgatatcccccggattgaggacctgggcgttcgcatcttcgatagagctgaaaatcctcagacaggggagtcccttgccctgccgcggcgcctcgcgagatctgctcggcgcagactgcggcgcagaaaacaccggcttgaacgcatcagacggctgattatccgcgagggcattctcacgaaggaggaactggacaaactgtttgaggaaaagcatgagatcgatgtgtggcaactcagagtggaagccctggaccggaaacttaacaatgatgagctggccagagtcctcctgcaccttgctaagcgccggggattcaagagcaacagaaaatccgagcgctctaataaggaaaacagcaccatgctgaaacatattgaggaaaatcgggccatcctctccgggtatagaacagtgggagagatgattgttaaggaccccaaatttgctctgcacaagcgcaacaagggcgaaaattacaccaacacaatcgcccgggatgacctggagcatgagatcagactcattttctctaaacagcgcgaatttggcaatatgagctgcaccgagaagttcgaaaacgagtatatcacaatttgggcgtcccagcggcctgtggccagcaaagatgacatcgaaaagaaagtcgggttttgtaccttcgagcccaaggagaaaagagctcctaaggccacgtacacctttcagtctttcattgcttgggaacacatcaataagctgcgccttatctttccctccggagcccggggcctgacagatgaggaaagacggctcctgtatgagcaagcgttccagaaaaacaagattacctaccacgacatccgcacacttctgcatctccctgacgatacctattttaaagggattgtgtacgacagaggagaaagccggaagcagaatgagaacatcagattcctggagctggatgcctaccaccagattcgcaaagctgttgacaaggtgtatggcaaggggaaatcttccagcttcctcccgatcgattttgacacgttcggatacgccctgacactttttaaggatgacgctgatatccattcttatctgcggaacgaatacgagcaaaatggcaaaagaatgcccaacctcgccaataaggtctatgacaacgaactgattgaggagcttctgaatctctccttcaccaaatttggccacctgagcctgaaggccctccgctccatcctgccttacatggaacagggggaggtgtattctagcgcttgcgaaagagcgggatacacattcaccggccccaagaaaaagcagaaaaccatgcttctgcctaacattcccccgatcgccaatcctgtggtcatgcgggctctcacacaggcccgcaaggttgtgaacgccattatcaaaaagtacgggtcccccgtgagcattcacatcgagctggctagagatctgtctcaaacgtttgacgaacggcgcaagaccaaaaaggagcaggacgagaatcggaaaaagaacgaaacagccatcagacagcttatggagtatggactcaccctgaatcctacaggccatgatattgtcaaattcaagctgtggtccgaacaaaacgggcgctgtgcgtacagcctccagcccatcgagattgaaagactgcttgagcccggatatgtggaggttgaccacgtgatcccttactctcggagcctggatgactcctataccaataaagtcctcgtgctgacgcgcgaaaacagagagaagggcaatcggattccggctgaatacctgggcgttgggacagagagatggcagcagtttgaaaccttcgtgcttaccaacaagcaattttctaaaaagaaacgcgatcggctcctgagactgcattatgacgagaacgaggaaacagagttcaagaatcgcaacctcaatgatacccggtacatcagcagatttttcgccaacttcatccgcgaacacctgaaatttgccgagtccgacgataagcagaaggtctacacagtgaatggacgggtcacgagccatcttagatctcgctgggacttcaacaaaaatcgggaggaatccgatctgcaccacgctgtggacgccgctattgttgcctgcaccacacccagcgatatcgcgaaggtgaccgccttttatcagagacgggagcagaacaaagaactcgctaagaaaacagagcctcatttcccccaaccttggccccactttgccgacgaactgcgcgctagactgtctaagcatccgaaggagtccattaaagcccttaatctcggcaactacgacgatcagaagctggagagcctgcagcctgtcttcgtgtcccggatgcccaaacgctctgttaccggggcggcccaccaggaaacgctcagacggtatatcggaattgacgagagaagcggcaagatccaaaccgtggtcaaaacaaagctgtccgaaatcaaacttgatgcttctgggcactttcctatgtacggcaaagagagcgacccccgcacctatgaagccattcggcagagactgctcgagcataataacgatcctaagaaggctttccaggagcccctgtacaagccgaaaaagaatggagaacctggccccatcattcgcacagtgaaaatcattgacaccaagaaccaggtgatccccctgaatgatgggaagacggttgcctataactccaacatcgtccgggtggacgtgtttgagaaagatggaaagtactactgtgtccctgtgtatacaatggacattatgaaaggcatccttccgaataaggccattgaacccaacaaaccttacagcgagtggaaggaaatgaccgaggattatacattcagattttctctctaccccaatgacctgatccgcattgagctgcctcgggaaaagaccgttaaaaccacaacgggggaggaaatcaacgtgaaggatgtcttcgtgtattacaaaaccattgactccgctacaggaggcctcgagctgatcagccacgacaatagattttctcttcgcggggttggctccagaaccctgaagcggttcgagaaatatcaagtggatgtcctcggaaacatctacaaggtgcgcggcgaaaagagagttgggctggcgagctctgcccatagcaaaacaggagagaccattcggcccctgcagtccacgcgcgactga

SEQ ID NO: 3893 - RNA, 3264 nt, synthetic construct
  misc_feature 1..3264: note = Cas9 variant
  source 1..3264: mol_type = other RNA
atgagatacaagatcggcctggacattgggatcaccagcgtgggatgggccgtcattaacctcgatatcccccggattgaggacctgggcgttcgcatcttcgatagagctgaaaatcctcagacaggggagtcccttgccctgccgcggcgcctcgcgagatctgctcggcgcagactgcggcgcagaaaacaccggcttgaacgcatcagacggctgctcattcgcgagggagtgctgacgaaggaagaactggacaaactctttgaggaaaagcatgagatcgatgtgtggcaactgagagtcgaagcccttgaccggaaactgaacaatgatgagctcgtgagagttctgcttcacctggccaagcgccggggcttcaagagcaacagacagtccgagcgctctaataaagaaaacagcaccatgctcaagcatattgaggaaaatcgggctatcctgtccgggtatagaacagtgggagagatgattgtcaaagaccccaagtttgccctgcacaaacgcaacaagggcgaaaattacaccaacacaatcgctcgggatgacctcgagagagagattcgcctgatcttctctaagcagcgggaatttggcaatatgagctgcaccgaggagttcgagaacgaatatatcgccatttgggcgtcccagagacctgtggccagcaaagatgacatcgagaagaaagttgggttttgtacattcgagcccaaggaaaaacgcgctcctaaggccacctacacgtttcaatctttcattgcttgggagcatatcaataaacttcggctgatttcccccagcggaaccagaggcctcacagatgaggaacggcgcctgctttatgaacaggcctttcagaagaacaagatcacctaccacgacatcagaacactgctccatctgcctgacgatacctatttcaaagggattgtgtacgactggggagagtctctgaagcagaatgagaacatccggtttctcgaactggatgcgtaccaccaaattagaaaagccatcgacaaggtctatggcaaagggaagtccagctctttccttccgattgatttcgacacgtttggatacgctctgacactcttcaaggatgacgccgatatccgctcctatctgcggaacgagtacgaacagaatggcaaaagaatcgctaaccttgccaataaggtgtatgacaacgagctgattgaggaactcctgaatctgagctttaccaaattcggccacctctccctgaaggcccttcgcaacatcctgccctacatggagcagggggaagtgtattctagcgcttgcgagaaagcgggatacacatttaccggccctaagaagaaacagaagaccgtcctcctgcccacaattcctcccatcgttaatccggtggtgatgagagccctgacgcaagctcggaaagtcgtgaacgccattatcaagaaatacgggtcccctgttagcattcatatcgaacttgcccgcgatctctctcagaccttcgacgagagacggaagacaaagcgcgagcaggacgaaaatagaaaacggaacgagaccgctatccgccaactgatggaatatggactgacactcaatcccaccggcctggatattgtgaagtttaaactttggtccgagcagaacgggagatgtgcctacagcctgcagcctatcgaaattgagcggctcctggagcccggatatgtcgaagtggaccacgttatcccctactctcgcagcctggatgactcctatacgaataaggtgcttgtcctcacaaaagagaacagagaaaagggcaatcggattcctgcggagtacctgggcgtggggaccgaaagatggcagcaattcgagacctttgtcctgacaaacaaacagttctctaagaagaaacgcgatcggctcctgagacttcactatgacgagaacgaagagatggaatttaagagccgcaatctgaacgatacccggtacatctccagattctttgctaatttcatccgcgagcatctcaaattcgccgagagcgacgataagcagaaagtgtacacagttaacggacgggtgacgtctcacctgagatcccgctgggactttaataagaaccgggaagagagcgatctgcatcacgccgtcgacgctgccattgtggcttgcaccacaccgtctgatatcgccaaggttaccgcgttctatcagagacgggaacaaaataaagagcttgccaagaaaacagaaccccagtttcctcagccctggcctcatttcgctgacgagctccgcgccagactgtccaagcaccccaaagagagcattaaggctctgaacctcggcaattacgacgatcagaagctggaatcccttcaaccggtgtttgtctctcggatgcctaaacgcagcgtgaccggggccgcgcaccaggagacgctgagacggtatatcggaattgacgaaagatccggcaagatccagaccgtggttaaaacaaagctctctgagatcaaactggatgccagcgggcatttccccatgtacggcaaggaatccgaccctcgcacctatgaggctattcggcagagactgcttgagcacaacaatgatcccaagaaagcctttcaagaacctctctacaagcccaaaaagaacggagagccgggccctatcattcgcacagtcaaaatcattgacaccaagaatcaggtgatccccctgaacgatgggaaaacggtggcttataatagcaacatcgtccggattgacgtgttcgaaaaggatggaaagtactactgtgttcccgtgtatacaatggacatcatgaaaggcgtcctgcctaacaaggccattgagccgaataaaccctactctgaatggaaggagatgaccgaggattatacatttagattctccctctaccctaacgacctgatccgcattgaacttccccgggagaaaaccgtgaagaccgccgctggggaagagatcaatattaaggatatgtttgtttattacaaaacaatcgacagcgcgaacggaggcctggagctcatctctcatgacaattccttcagcctgagaggggtgggctctcgcacgctgaagagatttgaaaaatatcaggtcgatgtgcttggaaacatttacaaggttcggggcgagaaacgcgtggggctggccagctccgctcacagcaagaccggagaaacaatcagacctctccaatctacccgggactga

SEQ ID NO: 3894 - RNA, 3267 nt, synthetic construct
  misc_feature 1..3267: note = Cas9 variant
  source 1..3267: mol_type = other RNA
atgcccaaggagttcgaccctctgaaaccggccaagtacagactcgctctggatatcggcagcaaatccattgggtttgccatcattttccttaaggaagacgtgaacaaactgctcaagccctatgcgatcgtccggtctggagttcgcatttttggcgatgggagaacccctgctgcccccggacagctgggcagctcccttgccgctgagcggcgcgtgaagagatctatccggcgccaatacgccagaaaacggaagcgcctgcagagactcctgcggaatctgaaagaactcgggttctttcctgacgatagcaagctgtgcaaatccttcgaggaccttaacccctatgaactgcgccacaagggactcacaaaggagctgaaacctcatgagtttggcagacttctgatgcacatggctaagaatcggggcttccagtctaaccgcaaagtggatctcctggccgacaatatcgatagccaggcgaaggccgaaacgtccgctatgaaaagcgccattgctaccctgcaatctagactcaacggggagtttgaaacactgggagcctacctttatgagcggttcaagaaaggcgagaccatcaagtccagcaagacacagaaagggcagaaggcggaatacgagttttctatttccagacgcatggtcaaacaggagttcgaccggctgtgggccgctcaagagcagtttaatccggaactcttcaacgagcaggccaagaataccctgaaagatacaatcttctttcagagaaaccttctgccccaaaaggtgggaaagtgtaccttcctccctgagcatgaacgcgctagcaaagccctgccctcttcccagtattttcggattatcagcgagctgaataagatttccttcacggacgccgaaggcctcatcctgcctatctctcttgagcagagaaacaaactgctcaagagcctgcgcattaaacaaaaactttcctttgatcggatcagaaccgaactgaatctcgacagcacagttctgattaacctggagcacgcttctaaggactccatcgagggggataagaccggatacctcctgagcaagaaagaatacttcggccccgcgtggcgcgacctttctctggagacacaggatgccattgtgaccgctctcctgacgcatgaaaatgaggccgaactggtccagaaacttgtggacgattttaacatcgcccacgacgttgctaaggccctcgcgaacgctcggctggagagccagtatatgagactgtccaaggaggccatcgaacgcctcattccggagctggaaaagggcgtggattctcaagacgggtacaaagtccctgtgaagtatcacgaggccacagaggctgccggattcggccatcacagcgcccttcaggaaaattgggctgattttcccaccctggacctcaaacagctgcattccgatgacaacgacaagtacacagtggcggagctgcctcttccctattacgggaaagtcatcacccggcaggttgccttcggaaccggcgatgtgaatgaccccgtggaaaagagatttgggaaaattgctaaccctacagtccacatctgcctcaatcaagtgcgggttctgctggatgagattatcgccaagtatggatacccgtacgaagtgaacatcgagctcgctcgcgagctgaagcagaatcacgaacagagacagcggagcattaaacaacaggccgcgaacaagaaagagaatgaagagatcagacgcgaaattaagcaggcctataaagtcgagaaggctcggatcattacggactctgagatctccagagccgatattgaaaagtggcgcctttggagacggagcaaatctaagctgtgtgtgtactccggcaaaaagatctgcgagaccatgatcctcaacaatgaagttgaggtggaccatattctgccccgcagcagaacaggcgataactcctatcagaataaagtcctggtgcttaacaaggctaatcggatcaagtctaaccgcaccccttgggaagccaaagaactcttcgaggcccaagggtggagctacgaagacattctgaacagaatgcgggctctggataagcaccagctctttcgcttcgcggagaatagcatggacatctgggataaaaactatagatctttcgaagcccgggctctgaatgacacacgctacattagcagagtcgtgaaggattatcttaaagttgtgtgtcataaggaccggatcgtcgtgtccaacggagcccacaccgccctgatcagacgcgagtttggcctcaatgacctgctggggaagaaaggagagaagaaccgggatgaccatagacaccacgctattgatgcctgcgttatcggcgcgcttgaccgcagcatgctccggaaactgcagattgctatggaagtggccgagaagcaaaattctgccagaaacttcgtcgggctgcaggaaccctggtttaatttctccacacaggtgcgccggagcatcggccagatttacgtgtctcataaacctaaccacaattacgagggagaaatctttgaggcttccatctatggcctcagactgattagcgataagcgcacggagaaatacgttgggatcaagcggaaccccgaaaccggaaagaccgacaaaccgaagaaatctgtcgtggtgattagcgatcctaagacacaaaatagatatggccttcggcataaattccactccgaggggctgcccaagaagtactatggactctcctcttccagcgtcttttgtctggaaatctaccgcgacgagaaaggcaactggcaggcctataccattcctagatacgaagcgtaccggatcgtgaagcgcagaggggttaatgctctgtatgataacaaacggtccaacttcgagggcagaccccttgtgatgcgcctgatgcgggacgattgcatcgcctttgagaagaatggagtcaaagaagtgtaccgcattcagaagatcaacggcctcaagaaaaatattacactgacgagacacttcgacgccaacgttgatgaccggtatagacgcatgctcaaggctcagaaagccgagaaggctggggaagactttgattctgaggacctgtgtgatgaccttgtgttcagctcctttggagcctctagcctgtactccaataaagcgcggaaggtcaccatctctcctatgggcgtgctcagagatcccgggttcaagggatga

SEQ ID NO: 3895 - RNA, 3267 nt, synthetic construct
  misc_feature 1..3267: note = Cas9 variant
  source 1..3267: mol_type = other RNA
atgaagaaactggtgctcggcctggacatcggggtcgccagcgttggatggggcattatcgatgctgagaacggggacgtgcttgatgccggagtgagactgttctcctctcgggacgcgagcgaaaatgagtcccgcagaacctctcggcgccagagcagacggctctcccgcagaaagaaacaccggcgcgaaagaattaagcaactgcttctggctcatgatatggacgtctgcgatatcgtgaacgagaatccctaccagctccgggttaaaggcctgaacgaaaagctggagatttctgagatctatgtggccctcacacacctggccaagcgcagaggggtcagctaccttgacgatgtggttgaagagggaggcgctatcaaatccgaacatctgaataagaacatggaggagattaaaagcggcaagatgccttgtgaaatccagctcgagcggtttgaaaaatatggacaggtgcgcgggatgattgagatcaatcaagacacggaagagtcttccttcctggtcaacatttttagaaccagcgattacatcaaggaggccaagacaattcttgctacccagcagaaattccacaagcagatcacaaatgaatttatcgacgagtatattaacatcatggcctctaaacgggattacttcattggcccggggaatgaaaagtccagaaccgactatggagtgtaccgcacaaacggcgacacctgggataatctgtttgagatcctcattgggaaatgcagcgtgttccccgaagagacgcgggcggccagatcttcctacgtcgctcaagagtttaacctgctgaatgacctcaacaacctgaagatcagctcccttgaatctggaaaactgagcacctcccagaagcatgatatcgttgagaaggtgaaaaatagcaagaaattcggcacaaaggacctcctgaaatatattgcctctgtgtgtgaatgcaagatcgagaacattgatggctgtcgcaaggacaaaaatcggaagcctatcatgcacacctttgaaaactacagaaaagtccacaatgctcttaacgaggccggggtggatctgcgcctctccgaggcggactatgatgaactgatgaagattatgacactgaatagcgagaccctcgaaatcaaaaagcagtgcaaggagaaactgccccatcttacggaggactacctgaacgtttgtctcgtgctgaataagaaaggagccttctctggctggcacgctcttagcctgaaggccatgaaactcatgatgcctgaactgtatgggacatccaagaaccagatgcaaatcattcataccatgcagctgggaaaggcttacatcaaacccctcaatcagcaaaagtatctgaactctgaggccattcttgaagagatctacaatcctattgccgctcggagcatcagacagacaattaaagtcaccaacgcgatcctgaagaaatacggcccgctcgattccgtgatcattgaaatgccccgcgactatcagaccagcgaggacgagcggaagatgatcgaaaagatgcagaaggagaatgaaaaggagaaaaaggccgctctgaaaagagcccgcgaagagtacccttttcccgatgaggccttccggaaccacaaggaactggctacaaaacttagactctggtatcaacaggaccagttctgcgtttactctgggcggaagatttccgtggtcgatctggtgcgcaaccctaatcagtttgagatcgaccacattatcccccaaagcgtctctctggatgactccctcaacaataaggtgctgtgtttcagcgaagagaaccagaaaaagggacagcagacgccgttttattaccataaaggcaagtccggcaattggacctatgaacaatacaaacttttcgttgagaagctgtttgataagaaaaagatctctaacaaaaagagagagctcctgctgttcgaagaggacattaataaatgggatgtgcggagagggtttatcgcccgcaaccttgtcgacacacggtacgcgagcagagtgattctcaattcctatcagcagtacttcggaaaccacgaaatgggcaccaaggttaaggtggtccgcgggaaatttacatctcagctgagaaagaaatggaagatcttcaaagatcggaatgagagccattcccaccatgctattgacgccctgatcgtggccgctaccgccaacctccgcctgtggaagaaaaataaacttggaatcagcgatgagggcaaggtgtatgacaaagaaacgggggagattctgccttttgaaaagctcacagcttctgagtacaacgaaatgatgaataaagagccctatctgaacttcaagaccaaactgcaaaacatcgagaccaaggttaagtactcctataaagtcagcaagaaagtgaatagaaagatttctaacgacacaatctactccacccgggaacgcgatggcattgactacatcgtgggaaaaatcaagaatatttatgatgtcaagacatacaaagaccagtttcttaagagatataaaaagaacaaagagcagttcctcatgtaccaacacgatcctcagacgttcgccatcctggaaagcattatggcgacctatcccgacgccgagaatccctttctggcttacaagaaggaacacggcgtgatccggaaatatgccaagaacaaagctggggcccctgttacatctctcaagttcattgatggagcgctgggccagaaaatcgacgtgacctacaagaataaggccgcccttccgaaaaacaagaaagtcgtgctgcagagcattaagccctaccgcgctgatgtttattacgacgaggggaataaaagatatcatctcatcggagtgaagtactccctgtttagcttctctaaacaaggctatgtcatcaaccctattgcttaccagaagctgcttgagaaggaacagatccactccgagatgaaattttgcttcagcctctatcgggaagatattatcgagtccggggaagaccccgattctctgacacgctacagattttggagcaagaatgagtccggcaaaaacaagattgaggtgaaacctatcgaaaagcccaatttcgaggaccggaaggttatcaccattacgaaaaagatcaaaattctgaacaagtaccagaccgacgtgctcggaaattcttttaaagcccaagaagagaaggatccgagaagcatcgagtga

SEQ ID NO: 3896 - RNA, 3267 nt, synthetic construct
  misc_feature 1..3267: note = Cas9 variant
  source 1..3267: mol_type = other RNA
atgaactacaagatgggcctggacatcgggattgccagcgtgggatgggctgtcatcaatctcgatctgaaaagaattgaggaccttggcgttcggatcttcgataaggccgaacacccccagaacggggagtccctggcgctccctcgcagaattgctcggtctgcccgcagacggctgcgcagacggaaacatcgccttgaaagaatccggcgcctgctcgtgagcgagaatgtgctgaccaaggaagagatgaacctgctctttaaacaaaagaagcagatcgacgtctggcagctgagagtggatgcccttgagcggaaactgaataacgacgaactcgctcgcgttctgcttcacctggccaagagacggggattcaaatccaatagaaagtctgagcgcaacagcaaagaatcctctgagtttctcaagaatattgaggaaaaccagagcatcctggctcaatatcggtccgtgggcgagatgattgtcaaggatagcaaattcgcctaccataagagaaataaactggactcttattccaacatgatcgcgcgcgatgacctcgaacgggagattaagctgatctttgaaaaacagagagagttcaataacccggtgtgcacagagcgccttgaagagaagtacctgaatatttggagctctcagcggccctttgcctccaaagaagatatcgagaagaaggttgggttctgtacgtttgaacctaaagagaagagagctcccaaagccacctatacattccagagctttatcgtgtgggagcacattaacaagctccgcctggtctctcctgacgaaacccgggctcttacagagatcgaaagaaacctgctctacaaacaagccttctccaagaataagatgacctattacgatattcgcaaactgctgaacctcagcgacgacatccattttaagggactgctttacgatcccaaatcctctctgaagcagattgagaatatccggttcctcgaactggacagctatcacaaaatcagaaagtgcattgagaacgtgtacggcaaggatggcatccggatgttcaatgagacagacattgatacctttgggtatgcgcttacgatcttcaaagacgatgaagacattgtggcctacctgcagaacgagtatatcaccaagaatggaaaacgcgtctccaacctcgctaataaggtttacgataaaagcctgatcgacgaactgctcaacctgtctttttccaagttcgcccaccttagcatgaaggctattagaaatatcctgccttatatggagcagggcgagatttactctaaagcctgtgaactcgccgggtacaactttacaggaccgaagaaaaaggagaaagctctgctgcttcccgtgatccctaatattgcgaaccccgtggtcatgcgggccctcacccaaagcagaaaggtggttaatgctatcattaaaaagtatggctcccctgtgtctatccatatcgaactggcccgcgatctgagccactccttcgacgagcggaagaaaattcagaaggaccagacagaaaacagaaagaagaacgagaccgccatcaaacaactcattgagtacgaactgacgaagaatcccacagggcttgatatcgtcaagtttaaactgtggagcgagcagcagggacgctgcatgtattctctcaagccgattgaactggagagactgcttgaacctggctacgtggaggttgaccatatcctcccctattcccggagcctggatgactcttacgctaacaaagtgctggtcctcaccaaggagaatcgcgaaaaaggcaaccacacacctgtggagtatctggggcttggatccgaaagatggaagaagttcgagaaatttgtcctggccaataagcagttcagcaaaaagaaaaagcaaaacctcctgcggctgcgctacgaagagaccgaggaaaaggagtttaaagaaagaaatcttaacgatacccggtacatctccaagttctttgcgaatttcattaaagagcacctcaagttcgctgacggcgatgggggacagaaagtgtatacaatcaacggcaagattacggcccatctgcgctctagatgggactttaataaaaaccgggaggaaagcgatctgcaccatgccgttgacgctgtgatcgtcgcctgtgctacccaggggatgattaagaagatcacagagttctacaaagcccgcgaacagaataaggagtccgcgaaaaagaaagaacccatctttccccaaccttggccgcacttcgccgatgagctcaaggctagactgtctaagtttccccaggagagcattgaagccttcgctcttggaaactatgaccggaaaaagctggagtccctcagacctgtgtttgttagccgcatgcccaaacggtctgtgaccggcgccgcgcatcaggaaacactgagacgctgcgtcggcatcgatgagcagtccgggaagattcaaaccgccgtgaaaacgaagctgagcgacatcaaacttgacaaagatggacacttccctatgtaccagaaggaatctgacccccggacatatgaggctattagacagcgcctcctggagcacaataacgatccgaaaaaggcctttcaggaacctctgtacaaacccaagaagaacggcgagcctgggcccgtgatccggaccgttaaaatcattgacaccaagaataaagtcgtgcatctcgatggatccaagacagtggcttataacagcaatatcgtcagaaccgacgtgttcgaaaaagatggcaagtactactgtgttcctgtgtatacaatggacattatgaaggggacgctgcccaacaaagccatcgaggccaataagccgtactctgaatggaaagagatgaccgaggaatatacatttcaattcagcctttttcctaacgatctggtccgcattgtgctcccccgggagaagaccatcaaaacatccaccaatgaagagattatcatcaaggacattttcgcttactataaaacgatcgatagcgcgaccggcggactggagctgatttctcacgacagaaacttctcccttcggggcgttgggagcaagacactgaagcgctttgaaaaataccaggtggatgtcctcggaaatatccataaggtgaaaggcgagaagagagttgggctggccgctcccaccaaccagaaaaagggaaagacagtggactccctccaatctgtcagcgactga

SEQ ID NO: 3897 - RNA, 3270 nt, synthetic construct
  misc_feature 1..3270: note = Cas9 variant
  source 1..3270: mol_type = other RNA
atgaccgccttcaagcccaaccctctgaattacatcctcggcctggacattgggatcgctagcgtgggatgggccatggtcgagattgatgacaaagaaaacccggttagacttatcgatctgggcgtgcgggtgtttgagcgcgcggaaatgcccaagacaggggactccctcgctgccgccagacggctggctcgctctgtcagacggcttacgcgcagacgggcccaccgcctgctcagagctcggcgcctgctgaaacatgagggagtgctcaagcctgaagatttcgacgagaatggcctggttaaaccccttccttatattcccaagcagcctagaaacaccccgtggcaactgcgggccgcggccctcgatcgcaagctgacaccccttgagtgggctgccgtgctgctccacctggtcaaacatagagggtacctgagccagcggaagaatgaaggagagaccgacgataaagaactcggcgctctgcttaagggcgtggccgacaacacacacgcgctgcaggccgggaattttagaacccctgctgagctcgccctgaacaaattcgagaaggaatccggacatatccgcaatcagcggggcgattattctcacacatttagcagaaaggaccttcaagctgagctggttctcctgttcgaaaaacagaaggagtttgggaacccctacgtgtccgatgacctgaaaaatggaatcgaaaacctcctgatgacccagcgccctgccctttctggcgacgccattcagaagatgctggggcactgcacgttcgagcccgctgagccgaaagcggccaagaatacctatacagctgaacggtttatctggctcaccaaactgaacaatcttcgcattctgaaccaaggaaacgagcgccctctcacagatgccgaacggaccacgctgatggacgagccctacaaaaagagcaaactgacatatgcccaggctagaaagctcctggatcttgacgataccgccttctttaaaggcctgcgctacggcaaggacaatgcggaatccgctacactcatggagatgaaagcctaccatgccatcagccgggctctggagaaggaagggctgaaggataaaaagtctcctctttccctcagccccgagctgcaggacgaaattggaaccgccttctctctgtttaaaaccgatgaggaaatcacaggcagactcaaggggtgtctgcagcccgagattcttgacgctctgctcaaacacatctccttcgataagttcgtccaaatcagcctgaaggccctgcgccggattgtgcctcttatggagcagggaaaaagatatgacgaagcgtgcgccgagatctacggcgaccatcacgggcggcgcaactctgaagagacgctctatctgccgcccattcctgctgatgagatcagaaatcccgtggtcctgcgggccctctcccaggctagaaaggttattaacggagtgggccgccggtacggcagccctgccagaatccacatcgaaaccgcgcgcgaggtggggaaatcctttaaggacagaaaagaaattgagaagcggcaagaagagaatcgcaaggatagagagaaagccgctgccgagttccaggaatattttcccaacttcgtcggagaaccgaagtctaaagacatcctgaaacttcggctgtaccgccagcagaattgtaagtgcctctatagcggcaaggagattaacctggggagactgaatgaaaaaggatacgtggagatcgatcatgcccttcctttttcccggacatgggacgatagcttcaacaataaggttctcgtgctgggctctgagaaccaaaataaggggaaccgcaccccctacgaatatctgaatggcaaagacaactccagagagtggcaggaatttaaggctcgggtcgagacaagccgcttccctcactctaaaaagcagcggattctcctgcagaaatttgatgaagagggattcaaggagagaaaccttaatgacaccagatacgtgaaccgctttctgtgtaagttcgttgccgatcatatgcaactcacgggcaaagggaagcggagagtgtttgctagcaatggacagatcacaaacctgctgcgcggcttctgggggcttcggaaagtcagagcggaaaatgaccgccaccatgccctcgatgctgtggtcgtggcctgctccaccgttgccatgcagcagcggatcaccagattcgtgcgctataaggagatgaacgcttttgacggaaaaacagtcgacaaggaaaccggcgaggtgctgcaccaaaagacacacttcccccagccttgggagtttttcgcccaggaagttatgattcgggtgtttgggaaacccgatggcaagccggagctggaagaggcggacacgcctgaaaaactcagagctctgcttgccgagaagctgtctagccggcccgaggccgtccatgaatacgtggctcccctcttcgtgtcccgcgcccctaatagaaaaatgagcggacagggccacatggagaccatcaagtctccgaagcggctggatgaagggatttccgttgtccgcgtgcccctgacacaacttaaactgaaggacctcgagaaaatggtgaacagagaacgggagcctaagctgtatgaggcgctcaaagctagactggaagcccataaggatgaccccgccaaggcttttgccgagcctttctacaagcaggataaggctggaaatcgcacccagcaagtcaaagccgtgcggatcgaacaggttcagaagacaggcgtgtgggtcagaaaccagaatgggattgcggacaacgccaccatggtgcgcgttgatgtgtttgagaaaggaggcaagtattaccttgtccccatctacagctggcaagtggctaaagggattctgcctgacaaggccatcatcgctttcaaggatgaagaggagtggcagctcattgacgattcttttaatttcaaatttcccctgcacccgaacgacctggttgaagtgatcacgaagaaagcccggattttcggctatttcgcctcctgtcacagaggaaccggcaatatcaacattcgcatccatgaccttgataacaaggtcgggaaaaatggaatcctggagggcattggggtgaagacagctctcagctttcagaagtaccagatcgacgaactgggaaaagagattcggccttgcagactcaagaaaagaccccctgtgagatga

SEQ ID NO: 3898 - RNA, 3270 nt, synthetic construct
  misc_feature 1..3270: note = Cas9 variant
  source 1..3270: mol_type = other RNA
atgaacgtgagatacaagatcggcctggacattgggatcaccagcgtcggatgggccgttgtgaatctcgatattccccggatcgaggacctgggcgtgcgcattttcgatagagctgaaaaccctcagacaggggagtcccttgccctgccgcggcgcctcgcgagatctgctcggcgcagactgcggcgcagaaaacaccggcttgaacgcatcagacggctgctcatccgcgagggcattctgatgaaggaagaactggacaaactctttgaggaaagacatgagatcgatgtctggcaactgcgggtggaagcccttgacagaaagctgaatagcgatgagctcgcccgcgttctgcttcacctggctaaacggagaggattcaagtccaaccgcaagtctgagcataatagccgggaaaactccacgatgctcaaacacattgaggaaaatagagccatcctgtctagctatcgcaccgtggctgagatgattgtcaaggaccccaaatttgccctgcataagcggaacaaaggggaacactacacaaataccatcgcgagagatgacctcgagcgcgagattcagctgatcttcacaaagcagcgggaatttggaaacatgaattgcaccaaggagttcgaaaacgagtatatcgccatttgggcttcccagagaccttttgccagcaaagatgacatcgaaaagaaagtgggcttctgtacatttgagcccaaggagaaacgcgctcctaaggccacctacacgttccaatcttttattgcgtgggaacacatcaataaacttcggctggtttcccccgccggcaccagagggctcacagatgaggaacggcgcctgctttatgagcaggctttccagaagaacaagattacctaccatgacatcagaacactgctccggctgcctgacgatacctattttaaaggagtggtctacgacagaaatatgccgctgaagcagaacgaaacgatccgcttcctcgagctggatgcctaccaccaaattcggaaagtgatcgacaaggcttatggcaaagggaagtctagctccttccttcccattgattttgacacattcggatacgccctgaccctctttaaggatgacgccgatgtgagaagctatctgcagaacgagtacgaacagaatggcaaacctatgcccaaccttgctaataagacatatgacaacgagctgatcgaggagctcctgaatctgtctttcaccaaatttgggcatctctccctgaaggcgcttcacaacattctgccttacatggagcagggagaagtctatagctccgcctgcgagcgcgctggctacaaattcaccggccccagaaagaagcagaaaacaatgctcctgccgaatatcccttctatcgccaaccccgttgtgatgcgggccctgacgcaagctcgcaaggtggtcaatgccattatcaaaaagtacgggagccctgtgtccattcacatcgaacttgcgagagatctcagccagacctttgacgagcggcgcaaaacaaagagagaacaagacgagaaccggaagaaaaatgagaccgctattcgccagctgatggaatatggactgacactcaaccccaccggccatgatatcgttaagttcaaactgtggtctgagcagaatgggagatgtgcctactcccttcagcccattgaaatcgagcggctgctcgaacctggatatacggaggtggaccacgtcatcccgtacagccgctctctggatgacagctatacaaacaaggtgctggttcttaccaaagagaatagagaaaagggcaaccggacccccgccgagtacctcggggtgggaacagaaagatggcatcaatttgagaccttcgtcctgacaaacaaacagttttccaagaagaaacgcgatcggctgctcagactgcactatgacgaaaatgaggagacggagttcaagaaccgcaatcttaacgatacccggtacatttctagatttttcgctaatttcatccgcgaacatctgaaatttgccgaaagcgacgataagcagaaagtgtacacagtcaacggccggattaccgctcacctcagatcccgctgggagttcaataagaaccgggaggaaagcgacctgcaccatgccgtggatgcggccatcgttgcttgcacaaccccttctgacattgccaagatcacggctttttatcagagacgggagcaaaataaagaactggccaagaaaaccgagccccacttccctcagccctggccgcattttgcggatgaacttcgcgccagactctccaagcaccctaaagagagcatcaaggctctgaacctgggcaattacgacaacgagaagctcgaatctctgcaccccgtgttcgtctcccggatgcctaaacgcagcgtgacaggggccgctcatcaggagacccttagacggtatgttggaattgacgaaagatccggcaagatccagacagtggtcaaaaccaagctgtctgagattaaactcgatgccagcgggcactttcccatgtacggaaaggaatccgaccctcgcacgtatgaggccatccggcaaagactgctggagcataataacgatcccaagaaggctttccaggaaccgctttacaaacctaaaaagaatggcgagcccgggcccattatccgcacagtgaaaatcattgacaccaagaaccaggtggttcctctcaacgatggcaaaacagtcgcgtataattctaacatcgtgcgggtggacgtctttgaaaaggatggaaagtactactgtgtgccggtttataccatggacattatgaaaggcgtgctgcccaataaggccatcgagcctaacaaaccctacagcgaatggaaggagatgaccgaggattatacattccagttttccctgtaccctaatgacctcattagaatcgaactgccccgcgagaaagctatccggacgagcaccggggaagagattaagatcaaggatttctttgcctattacaaaacaattcactctggaaccggcgggatggagcttatctcccatgaccgcagcttctctctgtccggagtcggcagcagaacactcaagagattcgaaaaatatcaagtggatgttctggggaacatttacaaggtgcggggcgagaaacgcgtcggactggcctctagcgctcactccaagaccggcaagacggtgagacctcttcagagcacacgggactga

SEQ ID NO: 3899 - RNA, 3273 nt, synthetic construct
  misc_feature 1..3273: note = Cas9 variant
  source 1..3273: mol_type = other RNA
atgagatggcggctgggcctcgacatgggggccggaagcctgggctggtgcgctgtggggcttgatgaccagggataccccgattccatcctggccgcgggctctcacattttcggggacggacgcgctcctagcagaggcgatcagcagggcaccccgctcggggtcgagcggcgcgccgccaaggctatgagacggcgcagagaccggtttctgggacgccaggccaaacttctggctagactcacactggccggcctgttccccgcggatcctgttcgggccaaggctctcgaactgcttgacccctatgtgctgcgcgccagagctctcgatgaggccctgcctccccatcagcttgggcgggcgtttttccacctgaaccaacgcagaggatttaaatccaatcggaagacggacagaggcgtggatgacgaagccgggaaaatcgctattggaatcgatcgcctccgggccgctattgccgccgctgaggcgagaaccatgggcgaatttctgcataagcgccggcagtctgcccctgacgtcaaccagatcccgagcgtgagaacacgcctgcggcccgagaccggcgaggaagctaagggggacggatacgatttttatcctggcagagagctcgttgaagaggagttcgacgccatctgggatgcccaggctccccaccatccttccctgcttacacccgacaatcgcgccctgctccacgaagcgattttctaccaacggccgctgaaagctcctaagatcgggaaatgtacccttctgaacaatgagcccagactccctaaggcccaccccctgttccagcgccggagactgctcgaagaggtgaacgccctgcggattgtccgccccggagaagtggctacaaaacttacctgcgagcagagagatctgctcatgctgaagctgaaggacaaagccaaggtttcttttgagacgctgcggagcaaagtgctcaagctggaacctgaggctagattcaataaagaaggcgagaaccgcaccgaactggtcggggatgaggtgtgtgcccagatgtccgcgaagacacggtttggaaaagcctgggctcatttcaccgacgagaagagatgggccatcctcagccgcctgattgaagaggaagatgaggaaagacttgacacatggctgcggaccgagcacggcctcgatgctgagcaagcccgcgcggtggccggcgctagactgccggccgggttcggacggtttggcgaaacggctacacgcagactgatcgccgcccttcaggctgaggtcattgtttattctgaagcggtggtggccgctgggctcggacatcactccgacatgcggaccggcgaggtcctggccgagctgccctactatgggatgacactcgaacgccaccttcttcctggcaccggagacaaggccgatcccgaggaactgagaatcggccggctcaccaatcctacagtgcatatcgctctgaaccgcctgagacggattgttaatagacttatcaaaacgtacgggcgccccgagcagattgccatcgaactcggacgggagctgaagctgaccgacgaggataaacaaagactcagccgccagaacaatcggaacagagcggacgctgaagcccgctctaagaaactggccgagcttggccaggctgataatggggccaaccgggcgagactgaagctctgggaggaactgaaccgcgaaaatgctctggaccggagatgcatttactccggacagcaaatcagcatcgccatgcttttctctgatgccgtggaggtcgaccacattctcccgtttgatgctacactggacgattccaacaataaccggatcctgtgtctccgcgagtggaatagacggaagcgcaaacagagcccttatgaagcctggggccataccgactactggcccgatattgctgccagagcggcccggctgcctaaggagaaaagatggcgcttcgaacccgacgctatgcagcggttttccgccgaggacagattcatcgctcgccaccttgtggatacacagtatatgtctcggctggccagagaatacctcgaggccctgtatcctgagaagggggaaggcagcggacatgtttgggtgtcccccggccgcctgaccgagcttattcggagaaaactcgggctgaacgaactgctcccggaccacaattttgctggagtcaagaaccgcctggatcacagacatcacacgatcgacgcgttcgtggtcgccgtgacagatcggagccttctgcaaggcatctctcgcgcttccgccctcgagggggaggaaggaagagagcgggttattgtgcctgaaccctgggacggctttcgcgaggccctgagaaccaccctgaatacaatcaccgtctggcatcggcaggatcacgggacagctagcaaggccggccttgcgcagggaagagaccagacggctggcaaactgcacaacgataccgcctacgggctcacaggacgccaagacaccaagggcaatgatctggtggtttctcggaaacccctcatgagcctgaagcctgccgacattgaaccggtgcccgatgtcgctcctatcacaaaaggggtgagagaccgcgaccttcggaaggccctggcgcatttcacccaggctacggagggaaagggctttctccaggccctggagagattcacccggctggggccccttcactttcgcggcattagacgggtgcgcctgatccagcctctcgccgttattcccatcaaaggacctggcggggtcccctataagggatacctgggcggggaaaacttcagatgcgatgtgtgggagatgccggacggagcttggaaacctgaagtgacatccatgttccaagcccatcagcccggctggacctctgctatccgggccgcgtgtcctacagcccgcaaggtcctcagcctgcacaaaagagatatgattgctatcgagcgggaagagggcgtgcgcacccttatggttgtggcccagatttggtccaatgggcaagtcacgctggtggagccccatgaagctggagacctcaacaagagaaataaaagcgaggatgacccgtttggctacttcatgcctacagccgggggactgaagcggctgaaggccagacaggttcgcgtggatgaacttggccgggtccaggaccccgggtttcctgctagaaaagcgcgccggagaacccgccccaagcaagtggattga

SEQ ID NO: 3900 - RNA, 3273 nt, synthetic construct
  misc_feature 1..3273: note = Cas9 variant
  source 1..3273: mol_type = other RNA
atggactggagactgggcctcgatctgggggccaacagccttggatgggctgccctgcggctcgaccgcgcgggcgatcccatcgggattctggctatgggatccagaatcttctctgacggccgggatcctaagagcggggcctcccttgccgtggaccgcagagctgcccgggctatgcgcagacggcgcgatagatttaaacagcggcaagccgcgctgctcaagtacctgattcgcgacggactgttcccggccgatcaggctgacagacagcggctcgccgatgaggacccctatgctctgcgcgccagagcgcttgatgaagaactgtctctctttgaaatcggccgggccctgttccaccttaatcagagacgcggctttcaaagcaaccggaaagctgacagagggcaggacgatgaggccggaaagattgctgtcggcgttgaccgcctgaatcagcagatggaggagcaaggggcccggaccctcggagagttcctgcatcagagacgccgggccgctacagatgcgaaccacatcccttccgtgagaacgcgcctgcggcccgaaaccggcgagggggccaaaggagacggctacgatttttatccttctagagctctcatcgccgaagagttcgaggaaatttgggccgctcaggctccccattaccctgacacactgacccagcaagtgcacgatcgcctttatgagatcatttttcatcagcggccgctgagagcgccccaggtcggccaatgcacactcgtggctggggaaacccggctgcctaaggcccacccccttttccagaagcgcagactgctcgaggaaatcaatgccctgatgattgttcggcctggagagatcgctcagagactgacacccgaggaacgcgacaccctctacctgaaacttaaggataaacggacggtgagctttgccaccctgagaaagacactcaaactggactccgctgcccgcttcaacaaggagagcgaaaatagaaccgagcttaagggcgatgaagtcgcggccgagctgggggctaaaacacggctcggaacccgctggcagcacctgtctggcgaccaacagtgggaggtggttcatagactgatggccctcgaatcccaggctgacgaggccgcgtttcgggattggattagccagacgtatgacctgcttccggaacaagccgctgccgtgctgggggctcgcctccctcagggacacggcagattcggccccacagccaccacaaccctgatcgattctctgcttcatgaccggaccgaggatgggcgcgtcgtggtgtactccgaagccgtccagagaagcggactcggccaccactctgacctgcggcatgatcgcgacgatgaggacgttacagagctgccttactatggggtggctctcgaaagacacatcatgcccggaacggcggagcccaccgatcctgaagagatgcggattggcagactgacaaacccgaccgtgcatatcgggcttaatcagctgcgccacgtcgtgaaccggctcattagagcctacggaccccctaaggagatcgctattgaactggcccgcgagctgaaactttccgaagacgagaagaaaaagcggaatagcgaaaacagagataatcgcctcgccgctgagggccggtccaaaaagctggaggaaatcagacaacgcgacacaggcgccaaccgggcgctgctcaagctgtgggaggaacttaatcccgggaacgttctggacagacggtgtatctataccggagagcagatttctatcgatatgctgttcagcgaccgcgtggaagtcgatcatattctcccttttgctcagacgctggacgattccaacggcaataaacttctctgcctgagagaggccaaccgggagaagcgcagacggagcccctacgaagcctgggggcacacagacagatggccggatatcgctgagcgcgcctctcggctgcctaaacccaagagatggcgcttcgaacctgacgcgatgcagcggtttgctaccgaggatggattcctcgccagacacctggtggacacccaatatcttggccgcctggcccgggaatacctctcctggctgtatcccgggagaggcgagggaagcggccatgtttgggtgtctcctgggcgcctgacagagatggtcagacggaaacttggactcaatgatctgctgcccgaccacaactttggcgggggagctgatcagccgaagaatcgcctcgaccatagacaccacgccattgacgctctggtggtcgccatcgtggatcggggcatgcttcaggcgatcgcccgcgctagcgggcaagacggctccgaaggaagagagcggattcatatccctgccccctgggatggcttcagagacgatctgcgcgttgctgtgaacgggattatcgtctctcaccggcccgaccatggaaccgtggccaaggccggcctcgctagagggcgcgatcagacagcgggacggctgcacaatgacacggcctacggcctgaccggggaaacagatgctaaaggcaacagcattgttgtgagacggatccctctttccgccattaagaaaccggccgacatcgctcgcgtcagagatcccctgctccggaatgccctggcggagtttaccaagggactcgacggcaaagccttcgaggcccgcatcgggagatttcatgaactgggacctcttctgtaccggggcattcgcagagtgcgggtggttgagacactcaccgtcatccccattcgcgacgccgaagggagagcttataagggatacaagggcgatagcaactatcggtacgacgtgtgggagatgcctgatggcaaatggagatgtcaggtggtctctatgttcgacgcccaccagtccacggaacaagcgcgcccccaccctgctgcccggaagatcctgagcctgcagagaaatgatattcttgccatcgagcgcaccgagggggaccgggaactggtgagagttgtgaaattttctgagaagcagttcgctgtcgctcccccgcatgaaggaggctccctcaaaacacgcgatgggaacgccgacgatccttttcggtatctgtaccccagccctaataccctcaagggatggagagcccgccaggtgcggatcgacgagctgggcagagttcttgatcccgggttcccggcgcgcaagtccgtgcggagaacacgccctagagccgctcccgtcgactga

SEQ ID NO: 3901 - RNA, 3276 nt, synthetic construct
  misc_feature 1..3276: note = Cas9 variant
  source 1..3276: mol_type = other RNA
atgtacagcaacctcctcttctcctttgacatcggcaccaattctattgggtggtgcgtgttcgccctggatgaggctggagaaccctatagaatcgtcgaccttggcgcccggatttacgcggatgggcgcgaccctcagagcaagacatccctggctgttgccagacgggaggcccgcgctatgtctagacggcgcgatagatatctccggcgcagaaaagccacgctgcggaccatgatcgaatacggacttatgccgggcgacaaggctgggcaagaggccgtgctgcgcgaaacaggagatagagagggcggcgacgagagctttaacccctatgcgctccgggcccgcgctctgtccgaaaaactgcctcccgcctacattgggagagtgctgttccacctgggacagcggagaggctttaagtctaatcgcaaaaccgatcggaaggacaacgataaggggaaaatcgctcttggaatcgacgagctgacagccgcgatgcatagaagcggctcccctaccctcggggcctggctggctatgcgccgggccgaaggacacagcgtcagacttcgcgctggctctgaggtgttcgatgccgagggctatgccttttaccccgaacggtccctgctcgaggacgagttcagacagatttgggacgctcaggcggttcatcaccctgatatcctgacaccggaacgccgggcccatctgtttagagtgatgttctaccaacgccccctcaagaaacctctggtcgggcggtgtagctttaatcccgctgaatttagactttctcgggcccaccctctgttccaggagttccgcctctataaggagattaacgacctggaagtggttcttcccgatcagtcccacagaaaactgaccctcgacgagcggaatgccctggtggctaagctgaagacgagcagaaaagcctctttctccgcgctccgcaagaccctgaaacttacaccggatctggtctttaacaaggaaagcgaggctcggaaagaactcctgggagacgagatctactccgtgcttgccgatgccaagatgttcggcgctagatggggagggttttctcgcgccagacagtgggagattatcacccggctgaaagaagaggaagaccctgctagcctctccagctggctgaagtctgagttcggcctggatgacgaacgcgtgacagccattgcgaatgcctccctccccgatgggtatggaagactgggcgagaccgctcttgccagcatgctggaggaactcaagacggctgtcatccctgagtctgaagccgcgcggctgtgcggctacgaccatagcaacctggccaaagagcaagacgaggggcttgatacactccccgaatatcaggagatcctggaacgccacattccccctggaaccggcgacccggatgacatctacgatctgagaaaggggcggattacaaatcccaccgttcatatcggactcaaccagctgcgcagagtggtgaatgctcttattcaccggtttggccgccctcagagaatcgtcgtggagctggcccgggacctccaactgtccgaaaaacagaaggatgacgttaacagacgcatcgctaaaaatacccgggaggccgaggggagatctcagaagctgattgaaatgggccaacttgatacaggatataaccgcctcctgctgaagctctgggaggaactgaaccttgacaaacccgaggatcgggtgtgtatctacagcggcaagcctattgggatcgccatgctgttctccggagaagtcgacgtggatcacattctcccctggagcaaaacgctggacgactctcaggctaataagctgctttgcctcaaatccgcgaacagacagaagcgcaatcggaccccgagcgatgttcctgagtggagagaccgctacgatgaggtgctggcccgggctgccagactgccccggaacaagcgctggagatttgccgctgacgccatgcagcaattcgaagcggagggcgggtttctcgctcggcagctgacagatacccagtatctttctcgcatggccctggaatacctctccgccctgtatcctagcgaggaagctgacaaatccggagagctgagacagcggaagagagtccatgtggtccccggccgccttacagagctcctgcggagaaattgggggctgaacaccctcctgcctgatcacaatcttggcgaaatggcccaagagaaaaaccgccgggaccatagacaccatgcgatcgatgctgccgtgatcggaacgacatctcgcagcctgctccagcggatgtccggcgccgctgccagactggacgatgttgctttcgacgatctggtgcgcaccgtcgtgaaggacaatcccccgtggcctgggtttagagaggaacttctggccgcgattggacgggttaccgtgtctcacaaacccgaccacggcacagtcagccgcgccgcttacgcccaggggaagggacagaccgctggcaagctccataacgatacagcctatgggctgacgggcctcgtggacgccaaaggaagccccctggtggttagacggaagcctttcatggctcttgaggtcaaagatatcgcgtccattcgcgacaccgaactgcaatctgccctctacggcgctatcgggtccctgacagagaagaaagccctgcaggaagcccttattagatttcgggatacccacccgcagttcaagggaatcagacgcgtgcgggtgctggagacactcagcgtcattcccatcgtggacagagatggcaaggcttataaagggtacaagggagacgccaattaccgctatgaagtttgggagaccctggatggcaaatggcatacggaggtggtctctatgttcgacgcgcaccagcctgggtggcaatccccctttcacaagcagaaccctgctgcccggagagtgctcaaactgcagcaaaatgatatggttgcctacgaacatcccgctgacggctataccatcgcccgggtggtcaagttcagcaacgacaaacgcatttactttgcgtctcacagagagagcggatcccttaaggctcgggatgccgacaagggcgatcctttcagctattttgccaaagctaataacgggctgcgcgacatcaagtgtagacaggtgcggattgatgccgctggacgcatcttcgaccccggcccgcaggatagagaaacacggcaggccaacaaaggggtttga

SEQ ID NO: 3902 - RNA, 3279 nt, synthetic construct
  misc_feature 1..3279: note = Cas9 variant
  source 1..3279: mol_type = other RNA
atggcctacaccatgggcatcgacgtggggattgctagctgcggatgggccatcgtcgatctggagagacagcggattatcgacattggcgttcgcacattcgaaaaggcggagaaccccaaaaatggggaagctctcgccgtgcctagacgggaggcccgctcctctagacggcgcctgagacggaagaaacaccgcatcgaaagacttaagtatatgtttgtgcggaacggactggctgtcgatatccaacatctcgagcagacgctgcgcagccagaatgagattgacgtgtggcagcttagagttgatggcctggaccggatgctcacccaaaaagaatggctgcgcgtgctgatccacctcgcccagagacgggggttccagtccaacagaaagacagatggatctagcgaggacggccaggtcctggtgaatgttaccgaaaacgatcgccttatggaggagaaggactaccggacagtggctgaaatgatggtcaaagatgagaagttttccgaccataaaagaaataagaacggcaattatcacggggtggtgtctcgcgccagcctgctcgtcgaaattcataccctgttcgagtcccaacggcagcaccacaactttcttgcgagcaaagatttcgaactggagtacatcaatatttggtcttcccagagaccggttgccacaaaggaccagatcgagaagatgattggaacctgtacgtttctccccaaagaaaagcgcgctcctaaagccagctggcatttccaatattttatgctgctgcagaccatcaaccacatccggattacaaatgctcagggcaccagacccctcaacaaggaggaaatcgagcaagtggtgaatatggccctgacaaaatctaaggtctcctaccatgacattcgcaaagtgcttgatctgagcgaagagtatcagttcgttgggctcgactacggaaaggaggatgaaaagaaaaaggtggagtctaaagaaaccatcattaagctggacgattaccacaaacttaacaagatctttaacgaggtcgaactggcgaagggcgagacgtgggaggccgtggactatgatacagttgcttacgccctcaccttctttaaagacgatgaagacatccgggattatctgcagaataagtacaaagactccaagaacagactggtgaaaaatgtcgctaacaaggagtatacaaatgaactcattgagaaggtgagcaccctgtccttccgcaaagtcgggcacctttctctgaaggccctccggaaaatcattcctttcctggagcagggaatgacctacgacaaggcctgccaagctgcgggctttaacttccagggcatcagcaaaaagaagagatccgtggttcttcccgtgattgatcagatcagcaatcctgtcgtgaaccgggccctgacacagacgcgcaaagttatcaatgctctcattaagaaatatgggtctccggaaaccatccatattgagacagccagagaactgtccaagcggtttgacgagagaaagaacatcaccaaggattacaaagaaaatcgcgacaagaacgagcgggccaagaaacacctgagcgagctcggaattatcaatcccacaggcctggatattgtgaagtacaaactttggtgtgaacaacaggggagatgcatgtattctaaccagcctatcagcttcgagcgcctgagagaatccggatacaccgaggtcgaccatatcattccctattctcggagcatgaatgattcctacaacaaccgcgtgctcgtgatgacgagagaaaatcgggaaaagagcaaccagacaccttatgagtacatgggcaatgacacccaacgctgggatgagtttgagcagagagttaccacaaacccccagatcaaaaaggaaaagcggcagaatctgctgcttaaagggttcaccaaccgcagagagctcgaaatgctggagcggaatctgaacgacacacgccacattacgaagtatctctctcattttatctccaccaatctggagttcagcccgtctgataaaaagaaaaaggtcgtgaacacatccggaagaattaccagccaccttcggtccagatggggcctggaaaagaatcgcgagcaaaacgacctccaccatgctatggatgccgtggtcatcgcggtgacatctgacagctttatccagcaggttaccaattactacaaacggaaggaaagacgcgagctgaacggcgacgataaattccctctgccctggaagtttttccgggaggaagtgattgctagactttcccctaatcccaaagagcaaatcgaagccctccccaaccacttttattctgaggacgaactggccgatctgcagcctattttcgtcagccgcatgccgaagcggtccatcacgggggaggctcatcaggcccagttcagacgcgtggttggaaagaccaaagagggcaagaacattacagctaaaaagaccgccctcgtggacatcagctacgataaaaatggggactttaacatgtatggacgggaaacagatcccgcgacctacgaggccatcaaggaaagatatctggagttcggcgggaatgctaaaaaggccttttctacggaccttcacaagcctaaaaaggatggcacaaaaggacccctgattaagtccgtccggatcatggaaaacaaaaccctcgtgcaccctgttaataagggcaagggggtggtctacaacagctctattgtgcgcacagacgtgttccaaagaaaagagaagtattacctgctgcccgtctacgttaccgatgtgaccaaaggaaaacttccgaataaagtgatcgctgccaagaagggctatgacgattggattgaggtcgacgactcctttacattcctctacagcctgtatcctaacgatctgatctttatccggcagaatcccaaaaagaaaatttctctcaagaaacgcatcgaaagccattccattagcgactctaaggaggtgcaggaaatcctgacgtactataagggggttgattccagcaccgcggccattgagttcatcacacacgacggatcctactatgctaaaggcgtgggggtccagaaccttgattgttttgaaaagtaccaagtggacattctgggcaattactctaaagttaagggagagaaaagactcgagctggaaaccagcgataacaatcataagggcaaggacgtgaactccatcaaatctacaagccggtga

SEQ ID NO: 3903 - RNA, 3279 nt, synthetic construct
  misc_feature 1..3279: note = Cas9 variant
  source 1..3279: mol_type = other RNA
atgaagtacagcatcggcctggacattgggatcgcctccgtgggatggtctgtcattaacaaagataaggagagaatcgaagacatgggcgttcggattttccagaaagctgagaatcccaaggatgggagctccctcgcctctagccgcagagaaaaacggggatcccgcagacggaaccgcagaaagaagcaccggctggaccgcatcaaaaatatcctttgcgagtctggcctggtgaagaaaaacgaaattgagaagatctataaaaatgcgtacctcaagagcccttgggagctgagagctaagtcccttgaagccaaaattagcaacaaggagatcgcccaaattctgctccatatcgctaaacggcgcgggtttaagtctttcagaaaaaccgatcggaatgccgacgatacaggaaagctgctgtccggcattcaggaaaacaaaaagatcatggaggagaagggctatctcacgatcggggacatggtggctaaagatccgaagtttaatacccacgtccgcaacaaagccggaagctacctgttctctttttccagaaaacttctggaagacgaggtgcggaaaattcaggcgaagcagaaggaactcggcaatacacatttcaccgatgacgttctggagaaatatatcgaagtgtttaacagccaaagaaatttcgatgaggggccctctaagccttccccctactatagcgagattggacagatcgccaaaatgattggcaactgtacatttgaatcctctgagaagcgcaccgctaaaaatacatggagcggggaacggttcgtctttcttcagaagctgaacaacttcagaatcgtgggactctccggcaagcgccctctgaccgaggaagaacgggacatcgttgagaaagaagtgtacctgaagaaagaggtcagatacgaaaagctccgcaaaattctgtatcttaaggaggaggagcggtttggcgacctgaattacagcaaggatgagaaacaggacaagaaaacggaaaagaccaaattcatctctctcattgggaactatacaatcaagaaactgaatctttccgagaagctcaagagcgaaattgaggaggataaatctaagctggacaaaatcatcgaaattctgaccttcaacaagagcgataaaacaatcgagtccaatctgaagaagctcgaactgtctagagaggacattgaaatccttctgagcgaggagttttccggaaccctcaacctgagccttaaagccattaagaaaatcctgccctacctcgaaaagggcctgtcttataatgaggcttgcgaaaaagccgattacgactataagaacaatgggattaagttcaaacgcggagagctgctccctgtggtggataaggacctgatcgcgaacccggtcgttcttcgggccatctcccaaacgagaaaagtggtgaatgctattatccgcaagtacggcacaccccacaccattcatgtcgaagtggcccgggatctggctaaaagctacgacgacagacagacaatcattaaggagaacaagaaacgggagctcgaaaatgagaagaccaaaaagtttatctctgaagagttcgggatcaaaaacgttaagggaaaactgctgcttaagtatcgcctctaccaggaacaggagggcagatgtgcctattcccggaaggagctgagcctgtccgaagtgattctcgatgagtctatgaccgacatcgatcacattatcccttacagcagatccatggacgattcttatagcaataaagtcctggtgctttccggcgaaaaccgcaagaaaagcaacctgctccccaaggagtactttgaccggcaagggagagattgggacacattcgttctgaatgtgaaagccatgaagattcaccctcgcaagaaatctaacctgcttaaggagaaatttacgagagaagataataaggactggaaatcccgggctctcaacgatacccgctatatcagcagattcgtcgcgaattacctggagaacgccctggaataccgggacgattctcccaagaagcgcgtgtttatgatcccgggacagctcacagctcagctgagagcccggtggcgccttaataaagtcagagagaacggcgacctgcatcacgccctcgacgctgccgtggttgcggtgaccgatcaaaaggctattaataacatctccaatattagccggtataaagaactgaagaactgcaaagacgtcatcccttctattgagtaccatgccgatgaggaaacaggggaggtgtatttcgaagaggttaaggacacccgctttcccatgccttggagcggattcgatctggaacttcagaagagactcgagtccgagaatccccgggaagagttttacaacctgctgagcgacaaaagatatctcggctggttcaattacgaagaggggttcatcgaaaagctgcgccccgtgtttgtctctcggatgcctaacagaggcgtgaaaggacaggcccaccaggagacgatccgctccagcaagaaaatttccaaccaaatcgctgtgtctaagaagccgcttaatagcattaaactgaaggatctcgagaaaatgcagggccgggacacagatagaaagctgtatgaagccctgaaaaaccgccttgaggaatacgacgataagcccgagaaggctttcgccgagcctttttacaagcccaccaattccgggaagcggggacctctcgttagaggcatcaaagtcgaagagaagcagaacgtgggggtgtatgtcaatggaggccaggcgtctaacgggagcatggtgcgcattgacgttttccggaaaaatggcaagttttacaccgtgcccatctatgtccaccaaacactgctgaaagaactcccgaacagagccattaatggaaagccttacaaggattgggacctgatcgacggctccttcgagtttctttattctttctaccccaacgatctgatcgaaattgagtttgggaaaagcaagtccatcaaaaatgacaacaagctcaccaaaacagagattcctgaagtgaatctgagcgaggttctgggatattaccggggcatggatacgtctaccggggctgccacaatcgacacccaggatggaaagattcagatgcgcatcggcatcaagacagtgaaaaacattaagaaataccaggtcgacgtgcttgggaatgtttataaggtgaaaagagaaaagcggcaaaccttctga

SEQ ID NO: 3904 - RNA, 3285 nt, synthetic construct
  misc_feature 1..3285: note = Cas9 variant
  source 1..3285: mol_type = other RNA
atgaaaagcaccctggccatcgcttccatttctagcctcggctgggtgatcgagctgggggaaaacagaattatgcggcttggactggacatcggctccacatctattgggtggtggatctacgagacgaccgatggacagatcacaagcgtcattgacggcggggttcgcatcttctccgatggaagagaccccaaatctaagggcagcctcgccgtggatcggcgcgtggcgagagctcaacggcgcagacgggaccgctatctgagacggaaagccgcccttatgaagcgcatggctgaagtcggcctgatgccttccgatccgaaacaggccaagcagctcgaggctctggacccctacgaactgagagcccgggggctcgatgagaccctggagcttacagaactgggacgcgcgctctttcacctgaatcagagacggggcttcaagagcaacagaaaaaccgacgccggggataatgagtctggaaagattatcgacgctacagcccgccttgattgggctatgcgggaccatagagcccgcacctatggcgaatttctgcacatgcggagacaaaaagcggacacgcctcgcaccacacccgccgtgcggaccagactcacaattgctgcccgcgatggggctgagaaggaggaatccggatacgacttctatcctgatcggcagcatctgagagacgagtttgatgccctgtgggaagcccaggctgagtaccacggcgttctcaccgaagacctgcgcgatgagatcggcacgattatcttccatcagcggccccttaaaacacctaaggtggggaagtgcctgtttaccaacgaggaaagagtcgcgagcgcccacccgctcaatcaacggcgcatcctggtggagacagttaacgctcttagagtggcccagctgggagaagtcgcccgggctctcaccctggaggaaagagacaccattctgcacgccctcgataataaagcgcatacaaagtctctgtccggcatgagcatcaaacttaaggctctggggaaagtgattaagctccgctctggacagtatttcacgctggagaccgccaaccgggacgccatcgcttgtgatcccgtgagagcctcccttagcaaacctgaccgcattggctcctactggtctacactggaccacaatgctcagtgggaggtcgttaacagaatccgggccgtgcaaagcgatgcggaccatcgcgaactcgtggcctggctggtctcccagcacagactggctgccgagcacgctgaaggggccgcgtacgctcccctccctgatggatatagccggctgggcatcaccgccacaaagcgcattcttgccgctctggaggccaatgtgatcccctactctaaggccgttgaatcctgcggctggcatcacagcgacgagagaaccggggaggtgctcgatcggctgccgtattacggagaaattctggaccgccatgtcatccctggcacgtatgatgactctgatgacgatattacaagatttgggcggatcaccaaccccaccgtgcacatcggacttaatcagctccgcagactggttaaccggattatcgaggtgcatggcaaacctgacgaaattgtcgtggagctggctagagatctcaagctgagccaagaccagaaagcggacgtcgagcgcacaatcaagaaaaatacccaggccgctattcggagaggggaaaaacttgaggaaatgggcgtgcccaacacaggaggcaaccgcatggttctgcggctctgggaggatctgaatgacgatgacgtgatgaagagattctgtccctacacggggcagcgcatctccgccggaatgctgtttgatggctcttgcgacgtcgatcacattcttcctttcagccggaccctcgacgatgggtttacaaacaagaccctgtgtctgaaggaagccaatagaaagaagcgcaactatgctccgcacgaggccgcggagaaaggactcctggaccgggatgctatggactccgtggccaagtaccttcccgataataaggcctggagattcgctcctgacgccatcgaacggttcgagggcgaacgcgactttacagcgagagctctgaaagatacccaatacctcagccggctggcccgcacgtatctggacgccctttacgatgggggcgacgataagtctcatgtttgggtggtccccggaagactcaccgagatgctgcggagacactggggcctgaacgggctcgaagctctggccgactccgatgagaaaacagtgaagcgcaaaaatcggaccgaccatagacaccacgctatcgatgccgcggtggttgccgctacagaccgcagccttattcagaagatctctaagattgccgcttccgatgagcaggccggagccgaagacaccctgaaaagcacgcctcccccgtgggactccttccgggatgacatcgctgcgcagctccaaaacattacagtctctcatagagccgatcacggccgcaccgacagcctggctaaggggcggggagaggatacaacctccggcgccctgcatgaagccaccgctcttgggatcatcgacgagacacacgtgacggtgcgcattcctatcgaatctctcaaaagcggccatctgattgagggatccagaaatggctatatcagagatccctacctgcgggaccagctcaccctggccacaaagaacgggagcgataaagactttaccacagtccttcagaagttctttgatcgctctaaaagatatggaggcacccggcgcgtgagaattatcaagacgctgcaggacacagcgcggatctccgttcctcacaatgctcccattaaggcctacaaagggggaagcaaccacgccttcgagatctggagactccctaatggcaagattgaatctcaagtgatcaccacctgggagcatcacaacctgacagaacccaaacgcccgcatcctgctgccaagcggattatcagactgcacaaaaccgatatggtcgcgatcgagcgcgacgggaagacagtgatttgctttgttcagaagacggacccctccaatggcgctttccttgtgccccattttgaggccaacgccgatggacggaaaagaaagaacgaacctgtcgagtggtatcagatgagcgctaattctctgatcaaagccgacctccggcgcgtgggcgttgatgaaatggggagagtgcgggacccgggaccccctcccattcgctga

SEQ ID NO: 3905 - RNA, 3285 nt, synthetic construct
  misc_feature 1..3285: note = Cas9 variant
  source 1..3285: mol_type = other RNA
atgaagtacagagtgggcttcgacctggggaccaacagcctcggatgggccgtcgttcggctgaatgcttccggcgagcccgatcgcatcgaagtggccgggtctagaatttttagcgacggacgggagcctaaatccggcgcgtctcttgctggggcccgcagagatgcccgggctatgcgcagacggcgcgacagattcaagcagcggcaagccgctctgatcaaatatctcacacaggccggatttttcccggcggatgaaagcgagcgcaaggccctgtccgctcttgacccctacgaactgagagcccgggctctcgatgaggccctgcctctggcgcacctcggccgcgccctgtttcatcttaaccagagacggggcttcaaatctaatagaaagacggaccgcgggaagaacgatgacaccggaaaaattcggatcggcgtggctagactgtatgagcagatgcgcgatgccgacgctcggacactcggggaatttctgcacaagagacgcgccgccgctagcgatcccaatgcgattcctcatgtccggaccagaatcgtgacacttgccgctgaggacggaaaagcctccgacgtttacgatttctatcccgaccgccaaaccctggaagaggagtttgaagccatctgggaggctcagacaagccaccatcctgaagccctcaccgaggaacggagagcgcagttctacgagattatctttcaccagcgcccgctgaagcaacccaaaattggcttctgcacgctgctccctcccgagaagcggctgcctaaggctcaccccctttttcagagacggcgcctgctcgaagaggtgaacgccctgagaatcgtccttccggggaaagaaacccgggccctggagaaggctgaaagagatgccctcctgtctaaactgaatcagcgcaagaaagctgcctatgagtccctccggaaggcgctgaaacttgaccctgatgccagattcaacaaggagagcgacaatcgcgaagatatgattggagacgagatcgctgccgaaatggctcataagtctagattcggcaaagtgtggctgggcatgtccgccgaggcgcaggcccaagttattgaacggctccgcgggctggagagcgatgctgacgccgatgactttgaggcttggcttagagacgatcacggactggcccaggaacaggccaaggctgtgacagcggccaacctccccgagggctacgggcggttcggagaaaccgctacacgcaaactgatcgccgccctggagcaagaggtcatcgtgtactctgaagctgtgcagagagccggcctcgggcatcactccgacctgcgggatggacaggtctggaccgacaagaaaggcaatcctgcgcttccctattacggcgctgttctggagcgccacattgtgcccgggacggccgatcctaacgaaacagacgatgccctcagaatcggacggctgaccaatccgacagtgcatattggcctgaaccagcttcgcagagtcgtgaatgctctcatgcggagatatgggcaaccccaggagatcgccattgaactggcgcgcgagctgaagctcagcgacgatcggaagaaagagatcaacaccagaaaccgcgaaaatcggaaggctgccgagaaaagatcccagaagctgcgcaacatcggacaggccgacaaaggcgggaatcgggcccttctgaagctctgggaggaactgaaccctgaaaatgttctggatagacgctgtgtgtacaccggccgggtcatttctatcgacatgctttttagcggagctgctgaggtggatcacattctccccttctccgttagcctggacgactctaacggcaatagaatcctgtgcctccgggaggtgaaccgcattaagagacaacggacaccttgggaagcccgcgatgacctgagagcgcattttgggcccgatgccggatgggaggctatcgccgctcgggccgccagacttccgcgcgaaaaacggtggagattcgagcctgacgctgcgaatcgctttgatgcccagggcgggttcctggctcggcacctcacggacacccagcatctgtccagactggcccgcagctatctttctgccctctaccccgaaacaggagagggcagcgggcacgtctgggtgtcccctggccggctgaccgagatgctgagacgcgcttggtctctcaaccaccatctgcccgatcacaatatcgccggagcggctaaccagcctaagaatagaaaagaccatcggcaccacgccattgatgccatcgtcgtggctcttgccgaccgcgcgatgctgaacagaattgctcgggaaagcggcaaggaggggcatgaagccgccggacgcctcgttgcttccatccccgagccgtgggagggctttagcgatgaagtggggagagccgtccgggctattacagtgtctcacagacctgaccatggaaccgcctccaaagcgggccgcgccaaggataaggacgctacggccgggcggctgcacaatgagacagcttatggcctgaccggagaaaaagacgccagaggccttgatatcgttgtgacccgcaagcccctcagcgccttcaaaaagtctgctgacctggatgcgattcgggacgatgacctgaaacaaaagctcaaagcctgggctgccgggaaggagggaggcgcctttgaacaggctatgagatccttcggggatcccgagcggggacctcgcagccatccgggcctgagacggatccgcgtcacagagcccctttccgtgatccctattagagaccgggatgggcgcccctacaaggcctacaaaggcgactctaactatagatttgatatctgggaactgaagaccggaaaatggaaggacgaggtggttagcatgttcgaagcgcaccggcctaactggacatcccccattcgcgctggcaatcctacggccagaaaagtcctctctgtgcggcagaacgacgtgatcgccattgagagagaaaatgggcccgagctgatgcgcgtcgtgaagttcagcgctggatccctggcccttgcgccgcctcaggaggccggcagcctgaaggctcgggatgccgacaaaaacgatccctttaagtacgtttatgggtctccttccagcctccaaagatggaaagctcgccaggtgcggatcgacgaactgggaagagtcttcgatcccggctttgccgtgcgctctcggagatccagcgagtga

SEQ ID NO: 3906 - RNA, 3291 nt, synthetic construct
  misc_feature 1..3291: note = Cas9 variant
  source 1..3291: mol_type = other RNA
atgaagaacatcttcagctttgacattggcaccaattccatcgggtgggccgtgctggctctcgatggaaacggcgaccccgtcagaattgccgatgcgggggttcggatcttctctgacggacgcgatcctaaaagcaaggcttccctggccgaggccagacggatggctcgcgccatgtctagacggcgcgacagaacacttcggcgcaaaagagctacgctgcggaccctcgccgaaattggcctgatgccggatacaagctccgcgcgccaggcccaacttagagagacctctgaccccaagagcgggtccggacagctgacacggaatccttacgctctccgcgccctggctctggaagagaaactccccctgtttcacatcggcagagccctttatcatctgggccagcggagagggttccagagcaaccgcaagaccgatcggaaggacaatgataaaggaaagatcgcgctcggcattgaagaactgcacgccgctatgagacaagacggggcccagacatacggacagtggcttgctcgccggcatgccctgggccaggccgtgagactccgctctggggctctggatctggagggagaaggctatgcgttttaccctgagcggaaactcctggaagacgagttccacagaatctgggaggcccaagctcgccattatcccgacattcttacccctgaacggagagatcacctgtttacggtgatgttctttcagcgcccgctcaagaaacccaaggtcggcaagtgctccttcaacaatcaggaggaacggctgagcaaagcccaccctctttttcaggagttcagactgtacaaggaagtgaacgagctcgagatcgttgaacccgacctgacccataaaaagctgacactcgatcaacggaatgccctggtgaaaaagctgcaggtctctcgcgaggcttcctttgccgcgctgagaaaagtgctcaagctgcggcctgaccagagacttaacaaggaaagcgagtctcgcaccaaactgaaggggaatgaagtttatgctgtgctctccgataaaacacggttcggacccagatggggcaccttcagccaagccgagcagtgggccattatcgagcgcctgaaggaagaggaagacccggggagactgtttgcttggctccggtccgccttcggaattgagggcgaacaggctgccgatatcgcgaacgtccatctgcctgaggggcacggacgccttggcaaaacggccctggaggctatgctcgaggagctgaaggccgaagtgatcacagaggctgaggccgcgaagagatgtggctacgaccacgcccggcttgggggaggctctgatgaaggggagcccgaacttcctccctaccaggagattctccaacaccgcattccccctggaaccaataacccggacgatccctatgacattgaaaaaggcagatttacaaatcctaccgtgcatatcgctctgaaccagctgcggcacgtcatgaacaccctcattcgcagatacgggaagcccgcccagatcgctgttgagctggcccgggaccttaaactgagcgagcgccagaaggaagaggtgaatagaacaatcgcccggaacacgagagatgctgaacgccggggcaaaaccctcgaggaaaatagaatccctaacacaggatataatcgcaccctgctgcggctttgggaggagctcaaccccggcaaggtggaagacagatgctgtatctacacagggaagccgatttccatcagcatgctgttctctggagaggtcgatattgaccatatcctgccttggtcccgcaccctcgatgacagccacggcaataaactgctttgcctgcgggaagcgaacagagtgaagcgcaatcgggcccccgctgatgttacggagtggagagacaactatgatgaaatcctctctcgggccgcccgcctgcctcaaaataaaagagaccggtttgctcccgatgccatggagcgcttcgagaaggctgggggatttctggcgagacagcttacagacacccagtacctcagccggatggccctggaatatctggcctgtctcttccctgctgaggaaatggatggctttggggagctgagacgccatcggtacattaacgtgtgccccggcagacttaccgagatgctgcgccggaattggggactcaactccatcctgtctgacagccagctgggcgaaacagcccaagagaaaaatagaaaggaccaccgccaccatgcgattgatgctatcgtcattggggtgaccggacggtcccttctcaacagaatcagctacgccgccggccgcctggaagctcagcagctggagacactcgttaaggaagccgctgccacgaacaaaccgtgggacgggttcagagaggatgtggcgaaggtcgtgggaggcattatcgtctctcacaaacctgaccatgggaccgccggccggaaggctaaagatcccgcccgccagcaaacagctggaagactgcacaatgacaccgcctatggccttacaggggagaccgatgcccggggaaacacgatcgtggttcgcagaaagccctttctgtccctcaccagcaaagacattccttctatccgggatgaagctctgagagcggtgctggagcagcaccttcgcggcattccggacgggaaggccttccaggctgccctggatgcctttcggaagcaaaaaggattccatcactaccatggcatcagacacgtccgcctcacagaacccctgtccgtgattgggatcaaggaccgggatggcaaagtttataagggatacaaaggcgacgctaatcagagatatgacgtgtgggagaccctcgatgggaagtggcatgccgaagtcgtgagcatgttcgacgcgcaccagcctggatggcagtcccggtttcacgctgagaaccccacagcccgcagagtgctgcggcttcaacaggatgacatggttgccctgaatgctcctgatggcgggcgcctcctggtcagagtggtgaagttccggcagaacggacagatcacctttgccggccataatgagtctggcaacctgaaagcgcgcgacgctgccagcaatgaacaagatcccttcaagtacatttccagaatggcctctagccttaaagactgtgggtgccggcaggtccgcatcgatgctacgggacaggtgtttgaccctggcccccaggatagagcctcccggctgcaaaagcagagcaaaagatga

SEQ ID NO: 3907 - RNA, 3294 nt, synthetic construct
  misc_feature 1..3294: note = Cas9 variant
  source 1..3294: mol_type = other RNA
atgaagaaacagccccaaagatacatcctgggcctcgacctggggattgccagcgtgggatgggctcttatcctggtcgatggcgccgagaaccctgttgggctcctggactgcggagtgcggaccttcgaacgcgcggaggtgccgaagacaggcgattcccttgctctggccagacggcaggcccgctctgtcagacggctcattcgcagacgggctcaccgcctgctgagactccggcgcctgcttaaaagagaagggatcctgagcgccgctgactttaattccgatggactccccaacctgcctattgacgcctggcagcttcgggtggcgggcctggagcgcaagctcacgaatcaggaatgggccgctgttctgctgcatctcgtgaaacacagaggctatctgtctcaacggaaaagcgagacccagacagagaacaaggaacttgggagactgctcgccggagtcgctgaaaattccaaactgctttctgaaagctccgagcagtaccgcacccccgccgagctggcggtgaagctgttcgccgaacagagcggccatctgcggaacaaagggggagagtatacacacacctttaatagactggatctccaaaaggaactgcatcttctgttcgagcgccagtacgctctcggcaacccttttgcctctgctgaactgcagtccaaagttgacgagcttctgatgacacagcggagcgccctccaaggggaggccgtgctgaagatgctgggaaagtgtaccttcgaaccctctgagtataaagctgcgaagaatacgtactccgccgaaagatttatctggctcaccaaactgaacaatcttcgcatcctgtataacggcgaggaacgggctctcgatgagggcgacagaaagaaactgctggatgagccttacaagaaagccaaacttacatacaagcaggtccgcagcattctcaatctgccggaatctgccgtgttcaaagggctgcggtatggaaaggactccgatggcctcaaagctgagaacgggaccctgatggaaatgaaggcctaccacaaaatcagaacaattcttgacaaggcgggactgaagggcgagtgggaaaatcgcatccggaaccccgagattctcgacaaaatcgggaccgcttttagcctgtataagacggatgaggacattcaggccgccctggctgatcttagactccctgaaaacgtgctggacgccctgctcgctggactgaatttcgataaatttatccaactttccctgaaggccctccggaacatcctgcccctgatggagcgcggcattagatacgacgaagcgtgcaaagaggtctatggcgatcaccgggcccttgctgagtctaagaatcaggttctcctgcctcccatcccggccgacgaaattagaaaccctgtggtgctgcgcacactcacccaggctcggaaggtcatcaatgccattatcagacgctacgggagcccccagagagtgcatatcgagacagcgcgggaactgggaaaatccaagcaagagcgcgataaaattgacagaaagaacaaagaaaatcagaacgatcggaatcgccttgccagcgacatcagaaagcacttcaactttgagcctacccccaaggacattctgaaactccggctgtatgagcagcagcatggcaagtgtctgtactctgatcttcgcgaagagaaaggggaatgcctctacaccggaaatgttatcgagctgcacagactgttcgaagacggctatgtggagattgatcacgctctccccctgtcccggacatgggacaacagccttaataacaaggtcctggtgctcaaatctagcaatcaaaacaaggggaacaaaacgccttacgagtggctggatggcgccaataactcccgcagatggcgggagttccaggctagagttcagggatgtcattttccgtatgtgaagaagcagcgcatccaaaccgccaaactggactctaaggccgagcagggcttccttgaacggaatctgaacgatacaagatacatcagcaaatttatgtgccagttcattaccgctaatctccgcctggcggagacatccaacgccctcatggaagaggtcgctggggagaatccctattggaaggaacggaaaagacagcgcgtgtttgcccctagcggatctatcattgccctgcttcggggcctgtgggggctcaagaaggtcagagaggacaacgatcgccaccatgctctggacgccatcgtggttgcgtgttccaccgtgagcatgcaacagaaaattacgaaggctatgcagcggagagaaacactggagaccgtcgattctgagaccggagaagtgaaaacacggatcccccaaccttgggacttctttcgccaggaggttatgattagagtgttctccgatagcccccgggaggaacttgccgaaaagctcaattcccgcccggaggccctccacgactttgtctctcctctgttcgtgagcagagctcccaaccggaaaatgaccggccaggggcatctcgagacagtgaagtccgccaagagactgtctgaaaatatcagcgttgtccgcaaacctcttacggcgctgaagctcaaagacatcgagaacattgtgggctaccccgatcgggaacctgctctgtatcaggccctgagagagcgccttctggcccacaaggacgatcccgtgaaggcttttgccgacaagccgttctacaagcctgctaaagatggaggccaagggtccctcgtcaaggccgtgcggatcattgaaaataccaaacacggactgaagatcagaaacggcattacagacaccaatggggatatggttcgcacagacgtgtaccagaaaaccgataagaaaggaaagcggcagtattttatcgtccccgtgtacgcgtggcaggttgagaagaacgagctccccacggtggactgcaaaggctatgaaatcgatgacaactacgagttctgtttcagcctgtataagtacgatcttattgaaatccaaaatcctaacgacattaatcaggagctgagagcctattacatcaactgcgactcttccgatgggcgcttttggctggcttaccatgacaaaagcgccaaggaacagcagttcagaatttctacccaaaatcagccgatcatcaaaaagtatcaggtcgatacactcggcaaggagattcggctgtgtaaagctgagaagcgcaccgcccttaacggaaagaagaaaaagtga

SEQ ID NO: 3908 - RNA, 3294 nt, synthetic construct
  misc_feature 1..3294: note = Cas9 variant
  source 1..3294: mol_type = other RNA
atgggcaagggggacatcctgttcagctttgatattggaaccaactccatcggctggtgcgtgttcgccctctctgacaatggggatccctgtagaatcctggacgctaacgcccggatctttgcggatggacgcgagcctaaaagcggcaattcccttgctgaagggagacgggccgcccgcgctatggccagacggcgcgacagatacaagcggcgcagaaaagctgtcctgcggacactcacggagtatggactgatgccggccgatcccaaggcgcgccaggcccttgttgctaaaaccggcgacagaggccctaagtctgaagaggccctggctgatgtgtacagcctccgggcccgcgcgctgatggaaaagctgcccctccaccatattgggagagccctgttccaccttaaccaacggagaggatttaaatccaatcgcaagacagaccggaaatctaacgagaagggcgctatcgagaccggggtgaatagactgctcgaagagatgcgcgatacaggagcccctaccctgggcgcttatcttgccaaacggagaagcgacgggcgccccgtccgggtgagagccggagcttccgaacaggaggcggaggatggcaagcctgccaagacagcttacgacttctatccggttcgccggctgctcgaagaggaatttgacgccatctgggagaaacagtacagctatcatcccgaagtgctgaccgaggagagacgcggccacctgttccgggtcatgtttcatcagagacctctcaagcccgccattgtggggcggtgctctttcaactccgctgaaacgcgcctggccaaagcgcaccctctttttcaagagttcagactgtacaaggaagttaatgagctcgaagtggtcatgcccgatcagagccaccggaaactgacccttccggagagagaccgcctggtgctcaagctgcggggacagagaaaagctacatacgccgccctgcgcaaggagctcagactgcgggatcttcgctttaacaaggaaaccgagaatagaacagacatgatgggcgatgaagtgaccgctgccctggctgacaaagccgtcttcgggaaccggtggtctggattctccacggatgagaagtggcgcatcgttgaaagactccgggaggaggaagacccttttgcgctgcatgagtggcttgtgagcgaacacggcctgtctgatgccgaggctgagcaggccgctaaagtgcatctccccgacgggtatggacgcctgggccctacagccgtctccaccatgctggaagaactcaaggcggatgtgattacagaagccgacgctgccagactggctggctacgaccacagccttgcccgggccgatgaggacgggctggatcgcctccccaaatatcaagaagttctggagagacggattccccctggaaccaatgacccggatgacccctacgatattgctaagggcagaatcaccaaccctacagtgcacattgcgctgaatcagttccgccatgtcgtgaacgcccttgctcggagatttgggaagcccgaccagatcgccatcgagctcgcccgcgaactgaaactgaacgatcggcagaaggacgaggttaatagagtgattggacgcaacacgcgggctgccgcgctcagatcccaaaaactgcgcgatatcggccagaaggacaatgggtataaccgggcccttctgaaactctgggaggagctgaatcctgataagcccgaagacagagtctgtgtgtacaccggccggccgatttgcatctctatgctgttcagcggagaggtcgacgtggatcacattcttccttggtcccgcacaatggacgatagccaggctaacagaatcctctgtgttgtggaggccaatcgggtcaaggctaaccgcgcccccgcggaagtggctgagtggggcgggagatatgacgaaatcctggagcgggccgccagactgcctcgcaataaacggtggagatttgctcgcgatgccatggaaaagtacaaagagaacgagggattcctcgctcggcaactgaccgacacacagtacctttctagactggcccgcgaatatgcggaggccctctaccccaccgaggaacctgatcggctgggcgagctgagacgcagaaatcatgttcgggtgattcccgggcgccttacggaaatgctcagacggggatggggcctgaacgctctgctcccggaccacaattttggggccggccaggctaagaaccgcaaagatcatagacaccacgccatcgacgccgctgtcgtgggagtgacaacccggggcctgcttcagagaatttccaccgaggcggggctgcgcgaaaagctcgccctggaggaaacaatcgctgatattcctatgccctggcccggattccgggaggagctgaaggccgccatcgacagagctgttgtcagccataaacctgatcacggcacccttccgaagcccggggaacatggacgcacagccggccaactccacaatgacacggcgtatgggatcaccggcgagacagacgctcggggaaaccctattgtggtgagacggaaaccctttctgtctctgaccgataaggacatccctagcattcgcgatacagaactcagaggccgggtctactccgccacctctgggctgagcggacgcgagctttccgccgctctggactatttcagaaaaacggataagcagtttcggggcatccgccacgtgagagttaccgaaagcctctctgtgattcccatccgggaccgcgatgggaacatttacaaaggatataagggcgacgccaatttcagatacgatgtctgggagctgcctgacgggaagtggaaagcggatgtggttacaatgtttgacgctcatcggcccgacagagccgccgaggaacgccggccgcaccctgctgccagaaaggtgctgtcccttaaacagaacgatatggtcgcttgcgagcatcccaaggacggctacaccatcggacgcgtggttaaattcaatacagccggccagatctatttcgcggcccacaacgaagggggaagcctgaaggctcgggatgccgacagagctgatccttttaagtacttctctaaatccgccagcggcctcaaggagattgccgctcgccaagtgcggatcgacgcgaccgggcaggtcctggatcccggaccgcaggacagagaatcccgcctcgcccggaataaaagactggagcgcgagcgggcttga

SEQ ID NO: 3909 - RNA, 3303 nt, synthetic construct
  misc_feature 1..3303: note = Cas9 variant
  source 1..3303: mol_type = other RNA
atgaagtacaccatcggcctggacattgggacaagctccgtgggatggggcgtcatcgatacggagagaaaccggattcaggacctcggggttcgcctgttcgaatctgccgagaatcaaaaagatggagaaagccttgctaagcccagacgggacgcccgctccatgagacggcgcctggcgagacggggctctcgcctcgagagagtgaaaagcatctttgaaaaggctaaattcctgacccgggggcagatgggaattacacacgcccgccctaacgatccgtatagacttcgggccgagggcctggaccgcctcctgtccaatgaggatctgtttatcgctgtgtaccatctcgccaagagacggggctataagtctaacagaaagaatgtcctggaaggggacggagaggatgtgcgcgaaggcaaggctgttcttgacggggtggcccagaacaaaaagctgatggcgttccggggatacagaaccgtcggcgagatgtttttcaaagatagcgtgtttacagaggccaagcgcaataaggctgggtcctataaacactgcgttctccgggaaatgctggaggacgaacttggaaagatcctgcatgcccagagaagcctcggcaacaccctggtgacagattctttcatttccaaactgctcgagaagaaaaccggcgtctttgtgtaccaacgccccttcgctagcgggaatcagatcctgaaacttgtgggaccttgtacgtttgaacccgaggagattcgggccgcgaaagccacctattctttccagtactttaacgtcctgcagagactcaataacctgacaatcaagaataccgacacaggcaccgaacgcaaacttacgtccgaggaacgggctaagatgattgccttcatcttcagccacaaggacgttcaatacgctcagattagactggagctcaaactgtctgatgtggaccgctttaacatggtgaattatttcgtccagcggaaggaactggagacaaaaaccgccgaggaactcagacgggagatcgaaaagaagacaaaatttccttccctgagcgattactataccatccgcaagaccgtgtccgagattgactctgccttctggatccagattgaaaaacaacatgatgttatcgacgctattggggagatctttacactttacaagacggatgaggacatcattgcgcagctgaacaccagaatccccagcattcctcggccggtggtctccgccctcctgggacttagcttcacaaaatttggccacctgtctctcaaggctctgagaaagatcattccccacctggaaaacggggatacctatgacgtggcctgcgccaaagctgatcctaagtacacagaccgcgccaaaacccgggcgagaaagctccgccccctggacaaagaggatcattccatcacgaatcctgttgctagacgggccatcgcccagacaattaaggtggtcaacgctatcattgacaagtatgatagcccctctgaagtgcacatcgagcttggacgcgacctggccaaaaatttcaaggagagaatgaaaattcaaaaggaacagaaacagaaccaggagggcaatgaacgggctatcgccaagattcatgagctctacaaactggaaaacccgcgcggccaagatatcatcaagtttagactgtggaatgagcagaacgggcagtgtatgtacagcggagagcggattgacgaaatccgccttttcgataatggctataccgagattgaccacatcattcctttttccagatctttcaacgatagctactccaataaggtcctcgtgctgaaaatgcggaaccaggaaaagatgaataaaaccccctatgagtacatgggaggagacgcggatacatggcaacgctttgaaaacctggttaatagcatgcacaacatcggccctagaaagaaacagaacctcctgcttaagaagtatgtggccgacgatctgaccctccggacactgaatgacacgagattcatcgctcgctacatgaaaaactatattgagaataccctgcttttcacagaggggccccagaagcagcgggtctacaccgtgaacggccaagccacagcttacctcagaaaacgctgggttctgcataaggaccggaccgaaaataacagacaccatgcccaggatgcggtggtcgtggccgtggctacgccctctctggttcagggaatcatgcgccacgccaaaatgggcgagattgtcgactatctccattcccagaagtttgctcctaatgtgaccgatatcgaaacagggaagccgttcgagagcgccgacattcaatctgccaaagaacggatcatcgctaagcacgagcacagactgcgcattcccgagccttgggaaggattttccgatgagcttgacgcgcggatgggcgatgacgtggtcgaaaaactgagcctcagaaagtccaacatccatgggtacaaaaccacatctgatttcagccagattcaccccatctttgtgtcccggatgcctaagcgcaagaccacggggagagcccatcaggagacactgcggtctccccgcagattcaaagagtttcaagaaagcgttgtgcggaccccgctgtccagcattaatcttaagaaactcgaggaaatgtctggcaagaactccgacaaactgctgtatgatatcctcagaaagcgcctgcttgctcacggggacgatcctaaaaaggccttcacagagcccgtccacaagcctcggaaagacggcacccagggacccctggtgagaagcatcaagatggtttctgaaggccagcgctccgggattctcgtgaataacgagcaggccctggtcgaccaagatagcatgatccggattgacatcttttctaaacctaataagaaaggaaaggatgagtactatattatccccgtgtacgcttatcatttcgcccagaaggaactgccgaacaaagttattaccgcgaaggctgaggccgactggagaacaatcgatgacacgtttgccttcgaatttagcctttaccctaatgatctcgtgaaactgaccaagggcgacgatatccgcttcgggtactattccggatgcaaccgggctctggccgcgattcacatcctcccccatgaccagaacatgcccctggtcaataacggcattaaaacacttgataagatcgacaagtacgtggtggacattctgggggagtatcacaaagtcggcaaggaaaccagacagcaaatccagtga

SEQ ID NO: 3910 - RNA, 3303 nt, synthetic construct
  misc_feature 1..3303: note = Cas9 variant
  source 1..3303: mol_type = other RNA
atgggcgccaccatcgtgacagacattagcagatccgctttcgcctttgatatcgggacgaagtctattggaagcgcggtcctgcggctcgacgatcgcggcgagcccatcgggattatcaacgctgccgttagaatctacgccgacggacgggaacctaaatccggcacctctctggctgaggggcgcagacttgcccggggaatgagccgcagacgggatcgctataagagacggcgcagaacactgctcaataccctgacagagttcggccttatgccgcccaccgacgaggctcggaaagccctgctcgcggaaacaaacgatcgcagatttggcgccgtggctgggaatgtgtacgccctgcgggctagagccctggacgagaagctccctctgcaccatcttggacgcgcgctgttccacctcaaccagcggagaggctttaaatccaatcgcaagaccgataagcgggacaacgatcaagggaaaattgcctctggaatcagcagactgggccagaaacttgacgaggctggggcccgcacgctgggagagttcctccatcggcagcactccgctggcaaatgggtcagagtgcgccccagccgggttccttctaaggatgacaaagaggaagacggctatgggttttaccccgagagatccttcctggagcgcgaatttgccgccatttggaaggctcaggcggccttctatcctgagctgctcaccgaagaacggggagatcatctgcacagagtgatgtttttccaacggccgcttaagcgccccaaagtcggcaagtgcagcttttaccctgacgaagatagactgcccaaagctcaccctctcttccaggagttccggctggtgaaggagcttaatgaactggaggttgtgcatagaggggaccgccgggaaaaactcacactggagcagagagataccctgtttaaccagctccgcacacaaagatcttccgccttcaccgccctgcggaagacgcttaaagctcccacaggaacccgctttaataaggaaagcgacgccagagataagctgaaaggcgacgaggtcgcggctgagatgtctcacaaggatcggttcgggcaggcctggatcggaatgccgctcgccgaacgctgggctgtgattgagatgctgcttgacacagaagatcctctggaggtgaaagcctggctcgaagaacattatggctttgctgccgacagaatcgacgcgattgccgctgccaagctgccccctggctacgggcggctgggagagaccgctctccgcgatatgctggacgaacttaaaaacggcaccgtcaaggatgactccgggagagatgttgtgctgacagagcggcaggccatggacaatatctggaaggataaccccgcgctccagcgcgtggtcgccgacgctagagaactgcccccttaccaagaggtgctgggacggagaatcccgcccggcacggggaaacctgaggatccctatgacgttcagaagggccgccttaccaatcctacagtgcacattggactcaaccagctgaaacgggtcgtgaatgccctggttagacgccacggccggcccgatcaaatcgctctcgaactggccagagagcttaagctgaacgaggaacagaaagccgaaaaggaccgcgagattgctcggaacaccaaggcggcccaggctagaagcgagaaactccgccagctggatatcgacgacaatgggtacaaccgggtgctgcttaagctctgggaagatctgaatctgagacaaccggagaaccgggaatgtatttattgcggaaaagccatcggcatcgggacactcttctccaatcaggtcgacattgatcatatcctgccttggtctaagacccttgacgatagccaggccaaccgcattgtgtgtcacgtcgagtgcaatagacagaaaggaaaccatgctcccgccgaagtgcctcaatggcacgaccggtacgatgacatcctggcgcgcgctgagagactcccccggaataaggcctggagatttggccgcgaggccatgaagaaattcaaggatgacgaatcctttctggctcggcagctgacggatacacagtatcttagcagaatggcccatgagtacgttgcggctctctatcctgacgaggaacccgatgaatggggcgtgttcacccgccggaaccacgtcagagtgattccggggcgcatgaccgagatgctgcggagacagtggggactgaatgccatcatctctgaccacgaccaaaagaaccgcaatgatcatagacaccatgccattgacgctatcgttgtgggcgtcacaacccggcgcctcctgcagagaattgccacagctgccgggggacgggaggcgcttgccctggaagagacgatcggcaagattgaacctccctggcccgggttttacgatgacgtgaaagaggctatcgatcgcattgtggtttcccacaagcctgaccacggaagcctcccgaaacccggcgagcctgccagaaccgctgggcagctgcataacgatacagcctacggcttcaccggagaggaacggaagggcgtccccatcatggtgcacagagtgccttttgccacactgaccgaaaaggacatcccctctattcgcgatcggcagcttgctgaggcgctctatggggccatcgctggaattagcggcaaagccgaactggccgctgccctggcgagattctccgcttctgggccttacaagggaatccgccatgtccgggtggttgagcccgtgagcgtcattgccatcaaagacagagatggcacgccgtataaggggtacaaaggcgacgccaattatcggtacgacgtgtgggagctccctaacggaaagtggacccacgaagttgtgtccatgttcgatgctcatcgccccgactggcaaagcgagatcagaaacaagaatcctgccgcgcggaaagtcctgtctcttcaccagaacgatatggtggcttatgaacacccccaggacggctacacaattgggcgcgttgtgaagtttggatccggcgggcaaatggccctggccggaaatagagagggcggcgctctcaaaagccgggatgccgacccggaagatcgcttcagatacttttataagtctgggggagctatgcgggacgcccgcctgagacaggtccgggtggatgagaccggcagagtgttcgaccctgggccccaggatcgcgagtcccggaacgcgagaaaacagagcgccgctggatga

SEQ ID NO: 3911 - RNA, 3306 nt, synthetic construct
  misc_feature 1..3306: note = Cas9 variant
  source 1..3306: mol_type = other RNA
atgaagaccctgggcctcgacctggggacaaacagccttggatgggccatcgtggagacgagagatgaacccaccaaatactccgagggctctattgtcgctagcggggttcggatcttctcccagtctgaaatggccggacgcgaccctcaaagcaaggcgtccctggctgtggccagacggcaggcccgcggctctagacggcgcagagatcggtatctcaaacgcagacagcggctggtggaccttctggtcgatctcgggctgatgccggctgacaaggccgctcgcgccgagctggtgaaaaatcacggagatggcaagacaggcgacctcagctccagcgtttacgcgctgagagcccgggctcttgatgaagccctgtctccctatgagattgggcgcgctatctttcatctcaaccagagacggggattcaagtccaatagaaaagccgacagcaacgatcctgagcaaggcgtgatttctgaagggatgcgcgcgctggacgagaagatggccgaagctggagcccggaccatcggcgagtggcttcacatgagacgcctgcaggggctccccgtccgggctagaatcgcccctgatggagagggctacgccttttatccctcccgcggcgctctggaacgggagttcgacagaattatggcgcgccagacactgtttcataccgacctcctgacagataccgccatccgggaacttagagaggtggttttccaccagcgccctctgcggccggtgaaacccgggaagtgcagctacaatcctctcgaagagagactggctaaagcccatcccctttttcaaaagttccggctgctcaaggagctgaacgaactggagattgtcggagaagaccagaaacacatcaagctcacgcctgagcagcgcaatgccctggctctccagctgagaacctctctcacaaaacaaggcaaggtgcccttttccaaactgcggagcacccttaagctggggagagaagtgcgcttcaacaaagagacagataatcggtccgacctcgagggagatgtcatttattttagaatgtctcgcccggaatgtttcggcaacagatgggccgacctgcctgttgagatgcaggcggctatcaccgaacggctgcgcacggagcccgattacaagacactcatgaattggctgaaggccgaaaccgggcttgacgaggtgcacgccagagctgtggccgatacacctgtccccgacggatttggccggctgggccagagcgctctcaccgccctgattgatgcgctggagaacgaagtgggggagggaggcttcgttatcaccgaagccgaggctgccaaacgcgtgtacgggagaacaaattccgaggctgaccccgaccggaagggagtcgatgaacttcctaaatatcaagaggtgctcgcccgccatatcccgcccggcacgggggaacctgacgatccctacgacgatttcatgggcagaattaccaaccctacagttcacatcgcgctgaatcagctgcggcgcgtggtcaacgccctcattagaacctatggaaagcccgaccggatcgctattgaggtgggcagagatctgaaaatgaacgaccgcgaacgggatgaggtcaatagacgcatcgggcggaacacaaaggccgctatcgagagaggagtgaaacttaccgaaacgtttcgccagctggacacaggctacaatcggctcagactggagctgtgggaagatcttaaccagaaaccggagaatcgcgtttgcatttattgtgggaaggccatcgccggacatatgcttttcaacggcgaaaccgacattgatcacatcctgccttacagcaaaaccctggacgactctaaggctaatcggattctctgctgtacatcctgcaacagagagaaaaagaatcggccccctagccgcgtgccccaatggagatctcggtatggggagatcctggcgcgcgccaccacacttcctaagaacaaacagtggagatttgctgaagatgccatgacgcggttcggcgaggaagagggatttctggccagacagctcaccgacatgcagtacatcagccgcctggctctgacataccttgcccacctctatgattacgaagaggtcgacctggatggcatttataagcggcatgcgagagtgcgcgctctgcccgggcggatgaccgagatgctcagacgccaatggggactgaatgaacttctgcacgaccataacctcatcggcggggatgttgccaaaccgaagaatcggctggaccacagacatcacgccattgatgctatcgtgattgcctgtacatcccgcgcgctgatccagagacttgctaccgcctctgccgctgccgaggaacggggagctgagcgcgtcgtggagagaattgaccctccctggagcggcttccgggaagatgtgcgcgccgcggttggggccatcgtcgtgtcccacaaacccgaccatggcacggtgggaagagagggctacgctaaggggcggggacagaccgccggcaagctccacaacgatacagcttatgggcataccggagaaaaagacgccagcggcaatgacatcgtcgtgagacgcattgccgttacagatatccggtctcctgctgacattagaaagatccgcaccaacgcgcacgggcactccgagctgcgggatagactgtacgaagccacgcggggcctcgagggaaaggcttttgagcaggccgtgctggacttcgtcaagggcgatgccaaatttcgcgggattagacatgtgcggatcacagaagttgctaacccggtgtggatcacccacggagacggccgccataagaaagggtatcttcccggaggcaatgatagattcgacgtctgggagctggccgatggccggtgggacgcggaagtggttacaacctttgatgctcaccgccctgggttcgtgcccagaatgcggctcgagaaccataatgcccgcaagattatgagcctgaagaaaggagacatgatcgcctacaacgaccctgtctctggccaaagaattatcgctattgtgcggaagtttgatcagagaaataaacagctgtaccttgacccccacaacgaagccgggaatctggatcgccgggagaaggagaaaacctataagcctctcagacccatgccgaaccctctgaagaaataccgccccagacaggtgcggatcgacgaaatcggacaagtcttcgatcctggcccctggtgggagcgccaggacgggtga

SEQ ID NO: 3912 - RNA, 3306 nt, synthetic construct
  misc_feature 1..3306: note = Cas9 variant
  source 1..3306: mol_type = other RNA
atggagcagaccagcctggacctctcccaagccatgaagaaagtggctcagccccagaagccttacagactgggcgtcgatgttggggtggcctctatcggagcggctgccgtgacagacacggaaattcttggcatccacgtccggaccttcgagaaaggggaaattaacggaaagagcggccgcaaaccgctgaatgccgattatagacggcagaaggggcaacgcaagagactccggcgcaaaaagaacagactgctttccctgcggcgcctctttagacgggtgggaatgatcgagtctgctgccattgaggctttccccatcagctccacatctccttggcagctgcgcaccgaaggcctggacagacggctcacaaatgaggaatgggcccaggttctgtaccatatcgcgaaacaccgcggctttcagagcaacagacgggtggatatggacgaggccaccaaactttccgatgctgccggggacagccccgaaacaaccacgaataccgagtctgattccgacacaaagaagatgctggctggagtcgccgataacaagagactcctggcggagaaaggctatcgcaccattggggaagccgtggctcgggaccctaagttcagccatagaatccgcaataaagaggaatcttactcccacacaattggacgggatgagatcaacgccgaacttaattgcctgtttcaagctcagaaccattatggcaatccccacgccaccgaggagctcagcgaacagattatcgacctgattaactggagacgcaagacggttacaggggacgatatcaaacggatggtgggaagatgtaccctggagcctaaggaataccgcgccgctatccactctgtctccgcggaggagttccggtggctcagcacactgtccagacttcgcattgtgacccagggcgaatctcggccgctgaccaaatgcgagtgggacaaggtggtcgatctcccctggagacaagaagccatcacatatacgagcattcggaatgctatcggcctgcgccatgacattagatcccggtttaacatcagatacgagaccgggggaaagaaaacaaagaccgataccaaaaatgaaaccacgaagggccagagcgccgacgccgttacatctgaggtgaaaaccgctgaaaaggagaccgccttcaaggcgaaagggtaccacatccttcgcaaggcttataaagcctttggatacgatgagcagtgggaccgggatagattcaacacagaactgctcgacaccctggccacagctgtgacgttttataaggatgactccgagattcaagcccatctggaaaccaacgacacacctgagtacgctatccagattgccctccgcctgcccacccttacaaaattcagcaagctgtctaataaggcgatcctcaaaattctgcctcacatgagagagcggcagagctattccaacgcctgtcttctggctggctacaagaatcaccataaacagtatgatgacacaccccaaaacgggaagatcccgcgctctgccatcgaacacattaaaaatacggtcgtgtacagaagcctcaaccaggctcggcgcgttatcaatgccatggtgaaggagtacggagcgcctcaggaagtccatattgagctggccagagatatggaaaagtccgctaaaaagaaagacgagatcgatctgtggatgaagaaacggaagaaaaagaacgacgagctccgcgaaagatttggcaagaatctgagccgggatgagcttctgaaatataagctctacgaggaacagaacggccaatgcgcctattctctgcagcccattcagctggggcgccttctcgaacctaattacgtggaggttgaccacgctctgcccagatcccggagcatggataactcttataataacaaagtgctggtcctcaccaagcagaatagagacaaaggagatcgcacacccttcgagtacttcggcgaagaccaagagtccgtggattggaagcggtttaccaactgggtcgaaagcaaccctcagatgccgcaggccaagagacgcaaactgcttacaaagtccctgcagaaagggatcctcgacaatttctctgcccggaacctgagcgacaccagatatattgctcgcgagctgaagacgcttatcgaacattacatcctcaatacacccgagcgggagaaaaccaagtacgaaagatgtgtggttatttccggaaagctgacagcgcaaatgcgccagctgtggggcatctctaaagcccgggatgtgagcgacagacaccacgggtccgatgctgccgtcattgcctgcatcacccctagcatggtgcggcgcattaccagatatctccagctgcaagagcggcgcgctatgccctctgcccctggcaagggagacgaacatcccgcggttgtggctagagccatcccgcacgcccctgtcccctggcctacatttgagcatgatcttgaggctgccctggaaaaagtgctcgtgtcccggccccagagcagaaagtggtctggccctatccacgcggacacgatttacggggagcacaaagatcaggaaaccaacacagttgctcccacccagcgcatcaagctgacacaactgaccaagtccaattataaaaacattgtcggatacgacgaggaacggaataaggatttcatcgaccagattgaggagagacttgaatgtcataactttaatggcaaacaggccttcgggacgagccagtctccgatctatcgcatcaagaaaaacggagagctcggccctgaagtgaagaaagtgacaattaagctgcccatcaagaatagcgtctttcggattagacgcgggtacgtgaaaaacgccaaaaattccaccatctatattaacatctaccaaaataccaagacaggcaagttcgagatgcaccccgtttacgctaaagatctgaccagctctgccaacgcttccaagagctttgaatattcccctgacctccagctggtggatacaatccggagaggagactacattgagatcacgcgcagaaacggcgaggtcatttctgggtattacgccacccataatatcagcacatccgtgcttgaactgcagccgcacgacaccacagattctcggaacaatcgcacccccgcgattaagacgagcctcaacatcgagagattccatattgacatcctgggacggaaacgcagagttgtgcggagagccaagaatggcctggctgatgaccgcgataaatga

SEQ ID NO: 3913 - RNA, 3309 nt, synthetic construct
  misc_feature 1..3309: note = Cas9 variant
  source 1..3309: mol_type = other RNA
atgggctacagaatcgggctggacattggaatcaccagcgtgggctatgccattctcaagacagatgagaaagggtccccctacaagatcgaacacctgacgtctgtcattttccctatcgctgagaacccgaaagacggaaagagccttgccatgccccggcgcgaacagagaggcgcgcggcgcagaaatcggcgcaccaaatttagaaagcatcggacaaagatgctgttcgttcgctccgagctcctgaccatcaaacaaattgaagctatctattctgagaagcagaaacttagctccatttacgagctgagaacaaaggccctcaacgaacggctgaccaatgaggaactgtttcgcatcctctatttcttttctgggcacagaggattcaaaagcaaccggaagtccgagctgacagagaaggatatgggccctgtgcttaccgccattaaagacatcgaagagaagctggctgatggcacgtaccgcaccctcggggaatatatggagctggacgaaaaataccaggagcataagagaaataaagatggaattgaccggtaccttggcacagccaagagaagcctgatcgaggatgaaatcaaacagattatcattgctcaacagcagtttgggaacaccaagctcacatctggattccaggtggcctttatcggcgacgaggaacaaaccgggattttcaatgatcagcgcgagtttgaagacggacccggcaagcagtccccttatgcgggcaaccagatcgagaaaatgatcggggcctgcacgttcgaggaaaatgagaagcgggctcccaaagccagctacacatttcaatatttcgatttcctgtgtaagctgaacaatctcaaatacagagaaaccattggaggcgagtatcgctttctgtctcttgaacagaagaacgtcctgaaggagaaagtgctcacaacccagaagatcaccttctccggggttaaaaagctgcttgacctgcctgagcacgctcaatttaatctcgtgaactacggaacaaaaagcacggtcaaggaaaccgagacaaagtctgtgttctatgccatgatttcctaccataaactgaagaaagcgatcccggcccccatttttagcaatctgtccaccgctgaactcgacgagatcggccggatcctgacactttactctagcgataaggggcgcaaaaacgagttctattccagactggccattcctgaagaggttgtggaagctctcctgcccatcaactttagcaagttcggaaatctttctctgaaggccatgcggaaaattatcccttacctcgagatgggcctggtctattccgaagccgctacccaggcgggctacgactttagacacaagaaaattgatcaggcctatatccacgagaacgtgacgaatcccgtggtcaagcgcgctgccagccagacaattaaaatcgttaacaatatcattcggaagtacggggagccggacggaatcaacattgaactggccagagagctctctaaaaatttcagcgaacgcaagaagaccgtgaaatatcaagaggaaaaccgggctagaaatgagcggatcgccgataagctgcgcgagtgcgaacttcctgtgaacggcgcgaatattaccagactgaaactctttgaggaacagggggagttcgacccctacacaggactgaagatcccttttgatcgggctttctccgaagagtacgaggtcgaccatatcattccctattctaaaaccctggatgacagctacggcaacaagatccttgtgtccgccaaggccaatcaggaaaaagggaaccgcattcccatggagtatctccagggcaagcctgaaagaatcaaaaagctggagagcattacagctacgatcaaaaatccgaagaagcgggagaaactgctcaagcaacagctgaccaaagaagatgttgacggatggaagacaagaaaccttaacgacacccgctacatctcttccctgctccacgattatttcaatcagaacattagctttgccaaactggagtctgaaaagaagaaaagagtgatcgctgtcaatggcgccattacatccaagctgcgggcgcgctgggggttcaacaaaatcagagagaatggagacgaacatcacgcccttgatgctctcattgtggcctgtgttaccgacaagtacatcaaagagatcacgagcttttccaagcggaaagaggtgcgcttcaacgaaaatctgtggaagagagagaagacaccccaggaaattgagcaagaagtcgtgcactttaaaaaggattatgaccggatcttcaaccaggcttttcctctgccctggaccaatttccgcgaggaggtctcttgcagaatgagcgaaaaccctgccgagctcatgaaaaatcatacctgggaaacatacaccgatgacgagattgcggccctgcggcccatctttattgtgcgcatgccgaacatgaagacgtccggccctgctcaccaggaaacaatcagatctgggaaacttgaggagaagggactgaatattagccgggtttccatcgaaaagctcaaactggataaggagggcaccatcaaaagcgggaacgcccagttctacaaggactctggcaatggatggcaactgcttcatgataaactcaaggtggctctggaaaagcacgacggcgatgggtccaaagcctttcccgacggagtcttcaagtatcagtacctggacaaagagcatacagtgagaaaggttcgcctcgtggccaaaagcaccctgcagacctctcttaacgagaagaagtccgtcgctgataacggcagcatgattcggatcgacgtgtttagaaatgaacaagggaaatatcagttcgtgcctatttacgcgaaggatcgcgttgccaaaaagctgcccaaccaggctgtcgccgtgggaaaaatcgccaaggagtggcctctcattgaagagtctgacttcaagtttagcctgtattccaatgatctgatccgggtgaaacacaagaaaggcgtcaagcacgtgagcaaagacgggaacaaggaagagaaatctaagacagatttctttggctactatacgggagctgacatcgccaccgcgtccattagcggcatctcccccaataacttctttgagttcagatctatggggcttgctacactcattagcatcgaaaagtacaaagttgattactttggaaattatcatcaggtgaacgagaaggtccgccaaaaattcccgaagaatcggatgtga

SEQ ID NO: 3914 - RNA, 3312 nt, synthetic construct
  misc_feature 1..3312: note = Cas9 variant
  source 1..3312: mol_type = other RNA
atgaagtacgacatcggcattgatatcggggtggccagcgtcggagaggctgttattgaccaggaaggcaacatcctggaggcctgctccaatctcttcgatgaagcggacgctgcctctaacgtggatagacggaattttcgcgaggggagacggaacaaacgcagagaacggacccgcgtgaatgacttcaagaaactgtggacaaagtttggattcgagattcccaaaaacgtcatgaatgatacgatccttctgagaaacaagggcatcaagtgtgagctcgacctgaccgaactttatagcgtgctgctctacatgctgaaacaccgggggatttcctatctggaggatgccatcgacgaagctaagggatctaattacgccaaaggcattgctctcaaccaaaaggagctgaaagagaagctcccttgcgaaatccagctggagcgcctcaagatttatggcagctacagaggggattgtatcgttaaaaaggaagacgaggatgaatatcattccaatgtgtttacaatttctgcctacaaaaaggagctggagatccttttccggaaccagaaactgccggaagagtttatccagggatacatgaagattttcgaacgcaaaagagagtattacatcggccccgggaatgaaaagagccggaccgactatggagtctacacaaccaacaaggacgaggagggccactatattacagataaaaatatctttgaaaagctcattgggaaatgctccgtgtacaaggacgagttccgcgcggccggagctagctataccgcccaagaatttaacgttctgaacgatctgaataacctcacggtgaataacagaaaactgaccgagaatgaaaagaagaaaatcgtcgagaagatcaaatcttccaacgctgtgaatatgcggagcattatcaagaaagtgcttggcgaggacattgaacagttcggcggggccagaaaggataaggcggacaaagagatctaccatacatttgaagtctaccgcaagatgaaaaaggagttcgagaaaaacggaattgatatcgccgacttctctcgggaaaagctggatgagatcggcaatattctcaccctgaacacagaaaccgaggggatcaagggagcccttcacgaagctaaaaattcctttacgtatagcgagattgagacactgatcgacattagaaagaaaaactcttccctcttcagcaagtggcagtccctgtctctgaaaatcatgaatgaactcattcctcagatgtacgctcaacccaaggagcagatgcagctgcttaccgaaatgggcgtttttaaattcaagagcgtgaagtttaaaaactccaagtatatccctgtggaggaaatcattaaagatatctacaatcccgtcgtggttcgcagcgtgcggacaaccattaagatgatcaacgagaccattagaaaatatgggtaccctgacaacatcatcattgagatgccgcgcgacaaaaattctacagaagagaaggaacggatcaagaaggagcagtccaaaaacgaaaaggagtatgagggcattctgaaaagaatcaaggatgaatacgacattgagatcaatcgcgatgactaccggaagcaagaaaaactcgccctgaaacttaagctgtggaacgagcaggagggaagatgtccctatagcggcaagatgatctctatttacgggctcctggaagatcctcagctgttcgagatcgaccatattatccccaaaagcatttcctttgatgactctcgcaataacaaggtcctcgtgtatcggagcgaaaatcaaaagaaaggaaacaatacgccttacatgtatctgtccaagggcgataaaaactggaattacgaccagtataagagctacgttcttgggctgaaaaacaagggaaatatctctgataaaaaggtgaacaatatgcttttcatggaggacatcaacaagattgatgtcctgaaaggctttatcaccagaaacctgaatgacacacggtacgcctcccgcgtggtccttaacatgctccagagcttctttaatgaaaaggacgggtgccccaccaaagtgaaggttattagaggctctttcacacaccagatgcgggtgaacctgagaatcaataaagatcgcgacgagtcctatagccaccatgctgtcgatgcgatgctgattgtgtactcccaacggggatatgaggcctacagaaagatccaggaggcttgtgttgactttgaaaccggcgaaattatcgatgaggaacgctggcagcagtgcatctgggggaaggactatgatcaagtgatgtacgaggccaaatggtctaagattagagagaaaatcattgaagccgagaagaacgtcaaatatcaccatcgggtggacaagaaggtgaatcgcggactctgtaaccagacgatctacggcacaagaattaaagatgggaagatctacaaaatcagctcctataatatttacgacaacaaggaatgcgcttctctgcttaaaatgatcaagggaggcaaggagagcaaaattctgatgtataattacgattccaagacctatcgggacatgatcaaaattatcgatgaatacagcgacgagaagaacccgttcgttgcctatatgaaagagaccggggactacttccgcaagtacgcgaagaaacacaatggccctaagatcgaaaaagtcaagtattacaaagaggaagctggatcttgtattgatatctcccacaagtatggctacgagaaagggagcaagaaggtgattctcggatctctgaacccctatagaacagacgtgtttttcaatgagcggctgaaaaagtactatcttatcggcattaaatacaaccatatcaagtgcgaagggaacaattacgtcattgatgaggacgcctataacggactcctgcgcgatgccggcgtgatctcccacgaaaataccatcaacgacctggagaaagttggggtgaagtacctctttagcctgtataagaatgatattatcaaatacgaaaagaacggcgagatgttcgtcgagagatttctttctcggacaatggaatatgctaataactacattgagacgaaacctatccataagcccttctttcagaaaaaggacaagaaaggaaatattaagaacagccagaatctggtgggcctctccaaaaccaagtatatcgggaaactggttacagatgccctgggaaacacctacatggtggaaaaggagaagttcagccttatcgtcgacatttga

SEQ ID NO: 3915 - RNA, 3315 nt, synthetic construct
  misc_feature 1..3315: note = Cas9 variant
  source 1..3315: mol_type = other RNA
atgaagctgatcctcgccctggacattggcatcgctagcgtggggtgggccgtccttgataaaaagtccgagaccgttctggaagcgggatctaacattttccccgaggctagcgccgccggcaatcaggtgagacgggaaatgcgccaagctagacggatcaaacgcagacagcggacacgcctcgacgattttaacaagctgtggagaaagaataacctttccattcctcagtacaagtctacggagatcgtgaatctgaaggtcaaagccctccgggaagagatcagcctggacgagctgtatctcattctgtactcctatcttaagcaccgcgggatctcttacctggaagatgctcaggacgatagcctctccagctctaacgcctataccaatggactgagagagaacgcgaaagcccttgaaaagcattacccgtgcgagattcaacgggaccgcctgcagacaatcggcaaatatagagggcagacccagattacagatgacaataacgagaagatcgatctctccaatgtgttcaccattggagcttaccggaaggaaatcaaaaaggttctggagacacaaaaactgtaccacaacgaactcaccgacgagctgtgtgatgactatatccttatttttaatcgcaagagaaaatactatgaaggccccggcaacgaaaagagccggacggactacgggagattcaccacacgcctggatcagaatggaaactatatcgacgaggaaaacatttttgagaaactcatcggcaagtgctctgtgtaccctgatgaactgagaggggccgctgcctcctataccgcgcaggagttcaatcttctgaacgacctcaataacctgacaattaatggaagaaagctggaagagagcgagaaacatgccatcgtccagcgcatcaagacctctaacacggtgaatatgcggaaaattatcgctgattgtatgggcgaaacaattgagaacttttccggggccagaatcgacaagagcggaaaagaacaattccacaagtttgagacctacaataagatgcgcaaatccctctctgaaattggcacagatatcgacgagttcagccgggatgagctggacaagatcggctacattatgaccatcaacaccgataaagaagctcttatggaggcctttaatgaatccgggctgaacctcgacgacagcgttaaggagtgcctgatttctttcagaaaagccaattccagctcttttagcaagtggcagtccttctctcttaagatcatgaacgagctgattcccgaaatgtatatccagcctaaagagcaaatgacactcctgacggaaatgggagtggctaagggcagctccggggatttcgcgggactgaattacattcccgtcgacgtgatcagcgatgagatctataaccctgtggtccgccggtctgttagaatttcctttaaaatcctcaacgccgtgctgaagaaatacaaggtgcttgacaccattgtcatcgaaatgccgcgcgatcggaatagcgacgaggagagaaagcggattacagattctcagaaactgaacgaaaaggagatggagttcatcgagggcaaactcgctcagatctataatattaagctgtccagctccgacttttctagccagaaacaactgtcccttaagctcaaactgtggaacgaacaggatgggatctgtctgtactctggacgcaccattgaccccgaggatatcattaagaatcctgacctcttcgagatcgatcatatcattcccagaagcatctcctttgacgacagccggtctaacaaggtgctggtttatagatccgaaaatcagaaaaagggcaaccagacaccttacttctacattacccacagcgatggcgcctggacgtatgagcaatttaaagccaatgtgatgaacctttctaagaaaaaggaatacgctatctcccgcaagaaagtccagaatctgctctatagcgaggacattacaaagcgggatgtgctgaaagggttcatcaacagaaatatcaacgacaccggatacgcctctcgcgttgtgctgaataccgtccagaactttttcaaggcgaaagaagctgatacaaaggtgaaggtcattaaaggcagctatacccaccagatgagatccaacatgaaacttgacaaaaatcgggatgagagctactctcatcacgccgtggacgccatgctcatggggttttccgagatgggatatgaagcctaccgcagactgcaaggcgagttcatcgattttgaaacaggggagattctgaagaacgacatgtggaatgagaaaatgagcgatgacgtttacgtggattatctctacggccggaagtggtccgctatccgcaacgaaattgtcaaggctgagaaagacgtgaagttctggcatttcatcgttagaaaatctaatcagggactgtgcaaccagacgattcggggcacccgcgaatatgacgggaagaaatacaagatcaataaatttgatatcagaacaaaggagggagtgaaacttttcaagaagctggcctttagcgaaaaagagtccgaccgggagaagctcctggtctatctgaacgatcgccagaccttcaataaccttgtgaaaatttttgaagactacaaggatgcgcccaatccgttcgtgcaatatgagaaggaaacaggcgacgttgtcagaaaatactctaagcggcacaacgggcctagaatcgataaactcaagtacaaagacggagaggtgggcgcctgtattgatatcagccacaagtatgggctggaaaaggactcccgcaaagtgattctggagtctctcgtcccctaccggatggatgtgtattacaaggagagcgacaaaatgtattacctggttggcgtgaagcagtccgacatcaaaagccagaatggagctaacgtcatcgatgaagacctttatacccggattctgatcaatgagaagatgattgaacctggccaatctcgcgatgacctcgagcagctggggtacgaatttcggttctccttttacaagaacgatatcattgagtatgagaaagaaggaaaggtgttcgttgagagatttgtgagccgcacgatgcccaaagtccggaactacatcgaaaccaagcccatcaataaagccaacttcgagaagcagaatcctgtgggcctggggaagacaaaatctattaagaaatatagaaccgacatccttggaaaccgctacctctgcgagaaggaaaaatttacaaagttctgttga

SEQ ID NO: 3916 - RNA, 3315 nt, synthetic construct
  misc_feature 1..3315: note = Cas9 variant
  source 1..3315: mol_type = other RNA
atgaaccactacgtgctgggcctcgacatcgggattaccagcgtcggatatggcgttatcgatctggacaattaccagttcgtggattatggggtgagactttttaaggagggaacagccgaagacaacgtcaatcggcgcacgaaaagaggctcccggcgcctgaagagacggcgccaaaccagactcgatgacatgaaagagctgcttcagaaggaaaagattatgtctgagacataccatagctcctatgatccctacgacatgcggatcaaggggctgtctcagaagctcagcaacgatgaactgacctgcgctattctgcacatcacaaaatgtcgcggaaccacactcgaggccctggactccgcggatgaggactctgaaggcaccaagagcatcctttccaaaaatgatcaggacctgaagaaatatcattacgtgtgcctcgttcaaaaggagagactgaagcagagcggcaaaattcgggggacggaaaacaatttcaagaccgacgattacatcaaagagcttgacgagattctgtctcaccaggatctctccgaagacctgtgtgagaagatccgcacaattgtgagcagacggcgccagtattacgaaggacctggctctgagaaatccccgaccccctatgggagatggatcgctcaaggagtcgcccctattgatctgatcgaaaagatgcggggcaaatgcagcgtgtttcccgaccagctcagagccgctaagaactcttacacagccgagctgttcaatcttctgaacgatctcaataacctggagtgtgaaggggagaaacttaccacgtcccagaaacaggacgttatcgattttgtgaatgaaaagggaggcattacacctaaacaactggctaagctcctgaacgtcgacctgaatcagatcaaaggcttccgcattgataagaacgacaagcccctcctgaccgagtttaaagggtataaggccttcaaaaagatctttgacacaaacaattgcgatctttacaaaaaggacctgagcattctcgatggactggcggaaatcgtgaccggcaagaaagggatcgaggagcggaagcaggccattcaacaggcttatcctgaaatcgacgaggccattgtggaacagtgtgctgtcatgaaaggaatgacccagtaccattccctttctctgaaggccatgcacctcatcaaccaagagatgctgcagagcccgagaaatcagatgcaggttctgcacgaatcccatgtgttcgataaaaaccgcgtgagccacaagggccaaaagtacattgaggcggacgatgaggccatcctctctcccgtcgtgaaacgggctcagagagaaacatttaaggttgtgaatgccctgcgcgagaaatatggggagttcgaatccatcgtcgtggagacgacccgggacagaaacagccaggaacagaagaaacgccttaatgattctcaaaagtactatgagcaggaaaaccggaaagttgacgagctgctcagccatgaaggatacgatccttccaagattaatggcaagacaaaactgaaggtgagactgtatcttcagcaggagggcaaaaccgcttacacaaacgcccccatcgacctcaatctgctgattaaggatgccaccgcttatgaggtcgaccacatcattcctctctctatcagcctggacgattccattaacaataaagcgcttatcaaccgcacggaaaatcaaaacaagagcaacatgacacccatctacgccattctgcgggggaagctcaatatctctctggacacctacaaaaccgtggtcaagaacaatagaaactatacaggcaaaaagcggtcctacctgctttatgataaagacattaccaagtttagcaatatgcaggagttcatcgctcgcaacctcgtggatacatcttacgcctgcagagttgtgatgtccacgctgagcgactatttcaaggataatgaaatttccacccacgtccatacagtgcggggaagagttaccaacatgtttcgcaatcggatcaacatgcagaaagagagagaaaaggactacctgcaccatgccgtggatgctctcatcgtcgcctctattaaaaagctgaatcttctgaacacatatctcctgaaatacaatttcaacgacctgtacaatgaggagaccggggaagtgtttgcggtgggagatgaccaacaggttcttgatccgaagtatatccgcttcattacgcagctcaagaccatctacgacgagagcaacatgtattacaacggcctgattgaaagaaatgtcatgcagtttcctcccatcaaaatctcccacaagattgacacaaaacctaaccggcaaatctctgatgagaccatttatagcacacgcaccgtggggaatgaagagtacgtggtcaagaaatattccgacatctacgatcccaagttcacgcagctgacagacgatattatcaacgacagacccctcgatcggtggctgatgtaccgcaatgacaaccagacctttaaaatcattcagagcatcattcttgatcatttccacatctttaaggacgatgagaagcactattcttgtaccaaaaagaaaggccaaattcagtacgctctgaagggcaaaaatcctctctatctgtacaagcaggaacatggaaaggtgagaaaatatgccaagaaagggaacggaccggagatcacaatgatgaagtacttcgacggcaaactggggaataacattgacatctccaatcactatcatgttcacaacaagaaggtggtccttctccagatcagcccctaccggaccgatttttacgtgtctcctgaaggaaaatataagatgctgacagttcgctacgccaatgtgttctataaagagtccaagaaaaagtacgtcattgacgagaagtggtatgctagcgagaaaaagcggaaaaacatcacggatgacgatatttttgtgtgctctctgcaccatgacgaactcatcggcattcaaaagaaagatggggccaagtacgtttatgacctgagcaccgaagatggcggaaagcccagactttaccacggcgagatggaaatcctgaaattcacagctaccaataacgactccaagaacatcattgaggtgaaacctatctacacatattgtaagaaacagctcatgattagcatcgggcccattaccaagctggccaaatacgcgacggatgtcctgggaaatgtgtatgaggtgaagaagaacatcatcgaccatctttctcacctgtga

SEQ ID NO: 3917 - RNA, 3318 nt, synthetic construct
  misc_feature 1..3318: note = Cas9 variant
  source 1..3318: mol_type = other RNA
atgggcatcagaattgggctggacatcggaattgccagcgtgggctgggctgtcgttgatgacgattacaacatcattgagtccggggccaatatcttcaacgaagcgaaggctgcctctaatgtggaccggcgcacctttagacagacaaaacggctcctgcgcagacaaaagacgcggcttcgcgatttcgacatcctgtggattaacgccggactcgatatccccaaagagaaggtgaataaacagctgcagtttagagtccagggcatgaccatggaacttagcgagaacgaactgtatgctgccctcaagaatatgctgaagcaccgggggatttcctacctggaggacgctctcgatgaggaacaatctggaaaaagcacatatgagaagggcctccaggtgaaccagaaagcccttaagtgcgacaaaatgccttgtgaaatccagtacgagcgcctgatgaagtatggctcctacagagggcatattgaggttaaggatgaatctggagaggaaatgatcctcagcaatattttcaccctggacgcgtattgcaaagaggccaagaaaatccttgaatgtcaaaagcagtaccactcctttatcacagaggctttcgaggatgactacctggccctcctgcggcgcaaaagaaagtattacgaaggcccggggaacgagcagagccggaccgactatggaaaatacacaaccaagctgaatcccgaaacgggcgagtatgtgaccgaagagaacatttttgagaagctcatcgggaaatgctctgtctaccctaaggaaatgcgcgcttccgccgcgagctatacagcccagatttacaatatgctgaacgatcttaataacctgaccatcaacggaagaaaactcgagtacgaagagaagaaatctattgtggaagaggttcaaaaggcttccagcgtgaatatgctgaagatcatcaaaaaggtcattaacgaggacatcacaaccattgaaggcgcccggaaagataagaatgacaaagagatcttccataagatggaaacgtataacaagatgagacactactttgagaaaaatggccttgagttcaagaaaatttctacagatgacctggatgaaatcgggaacatcctcaccctgaatacagagaaggaagctattctggaggcctttaacaaatcccagctcgaactgagccaggaggagaaggaagccttcatcgagattcgcaagaaaaatggatccctttttaacaagtggcattctttcagcctgaaaatcatgaaggaactcattcccgagctgtatcttcaatccaaaaatcagatgcagctgctcaccgacatgggcgtgttcaagaaaaagaccgaaatctttcagaactacgataagattcctacagacgtgatcatcgaggatatttataatcccgtcgttaaacggagcatcagaattacggtgaagatcgtgaacgctctgattaaaaagtacgggtatcctcgcgaggtcgtgatcgaaatgccgcgggacagaaattctgacgaggagaaaaagcgcatccaagatgaacagaagaaaaacgacaccgaactgaagaaaattatcgagaaggttgagtccgaatacggaattaaaatcacagatacccacttccggaaccacaagaatctcagaatgaagctgcgcctttggcatgagcaggacggccggtgtctgtacagcgggaaagtgattgatatctctgaactcctgaacgactgcagcaagtttgagatcgatcacgtcattcccaaatccatctctttcgacgatagcagatccaataaggtgctggtttatagcacagagaaccagaaaaagaccaatcaaacgccttaccagtatcttgaaggaaacggcaaggagtggtcttttgacgaatacatgaatcaggtgattgagctcaaagatcgcaagctgatctccaaagcgaagatgaacaaactgctgttccgggaagacattacaaagatcgaggtcctgaaaggctttatcgccagaaatattaacgatacccggtatgctagccgcgtggtccttaattctttccagaagtactttgagtccaagcaaagcgacaccaaagtgaaggttatcagagggtccttcacacatcagatgcggaaaaagctgcagctctctaaaaacagagacgaaagctatgcccaccacgccgtggatgctatgctgatttgttactcccagatgggatacgaggcctatcgccaactgcaggaagaccttatcgatcccgactctgagaagattcgggatctcggcctgtggaaggaaaccatcacagaggcgaaatacgacgaggtcctgtatacggctaagtggctcgaaaatagagggaaaattcaggaggccgaaaagaaagtgaagttttggcataaggttgatagcaaagccaaccgcgctctgtgcaatcaaaccatcagaggaacacgggtgatcgacggctccattcagaagatcaacaaaattaacatctacagcgtcgatgggtataagaccttcaaaaatatgattcagaagggcaaggagaaagactttcttatgtaccgcaacgatagacggtcttgggacgatctgatgaaggtgtatcgcgaatactccgacgccaaaaatgctttcgccgcgtaccaggaggagacaggagactatgtgagaaagtacgccaaaaagcacaacggcagcaagatcaccaatctcaaatattgtgctaaggaactggggtcttgcatcgatatttcccataaatacggactggagaaggacagccggaaagttatccttgaatctctcagcccttatcgctccgatgtctactataacgccggcctgaagcaatactacattgtggggatcaaaaatagcgacctgtgtttcctcaagggagagtattttattgattctaagagatacctgcagatccttcgggaggaaggcgtgctgacggagcagcacaccctcaacgacctggctgccatcgggacagagttccagttttccctgtatgaaaatgattaccttgaatatgagaaaaacggcgagattaagaccgaacgcttcctcagcagaacaaaacccaagcagaaaaattacatcgagaccaagtccattgacgcgccgaagatcaaaaacaagaaacaaaatctggtcggactggccaagtctaaaagcattaagaagatccgggtggatattctcggcaacagatattacgcttccaaagaaaagttttctctgatggttgacaaattctga

SEQ ID NO: 3918 - RNA, 3318 nt, synthetic construct
  misc_feature 1..3318: note = Cas9 variant
  source 1..3318: mol_type = other RNA
atggacatggcctggagactgggcctcgatctggggaccaacagccttggatgggctgccctgtccctcgacgcggctggcgcccccgatgccatcctggctgccgggtctcggattttcggagacggccgcgatcctcagagcgggacatcccttgctgtggacagacgggccgcgcgcgccgctagacggcgcagagatcggtttaagcaacgccagagagccctgctcaaacacctggaggctgacggactgttcccggccgatcccgaagtccagcaggcgctcgccgctctggacccttacgcccttcgggctcgcgccctggatgaggccctctctctgcatgaaatcggcagagctctttttcacctgaatcaacggcgcggcttccagagcaacagaaaggcggaccgggggaaagatgaggacgccggaaagattgctatcggcgttgacagactcaaagatgccattgccgctgccggggcgcgcacgtttggagagttcctgcggcagagacgcgctggcgccaccggggagaatcagatcccctccgtgcggacaagactgcgcgccgagaccggagaaggcgctaagggctctgggtatgacttttaccctagccgggccctcctgaaggatgagttcgacgctatctggcatgcccaagcggaacaccatcccaaagtgcttacagatgaggcctatcacagactgcacgagattgtctttcgccagcggcctctcagagctccgaaggtgggagcctgcaccctggttcccggcgaagctcgccttcctaaagcccatcccctgttccagcggagacggctcctggaggaactgaacgcgctcatgatcgtgcgcgccggggctgtcgccgagagactgacacctgaacagcgggaccttctgctcctgaaacttaaggataagggaaaggtgacctttaaatccctgagagagaaggttctcaaactggacggcgatgctcgcttcaataaggagagcgaacaccggacggagctgaaaggggacgaagtggccgccgagatgggaggcaagaccagatttggctctctctggccccatctgtccacagaacaacagtggaccgtcattgagcgccagcaagctcttgagagcgatgcggacgaagccgctttcagaacatggctggtggagacccacaaactcacggccgaacaggcccgggctgtggccggggcgcgcctgccggctggacacggcagattcgggctgacagccaccgccgcccttctcgctgcgctgcgggacggacgcacacctgagggcagagggcccaacgctcctgccaccgaagccggccgggtcgttgtgtactctgaggctgccgctatcgccggatatcatcactccgatcatcgcagcggcgaggtgtttaccgacgcgaaggggagacccgccctgccctactatggagtccctctcgatcggcacattgtgccgggcacagctgaccccgatgaacctgacgaggccgctcgcatcgggagactgacgaatcccaccgttcatattgcccttaaccagctgcggagagtggtcaatcgcctcatccgggtgtacggacctcccgccgaagttgctctggagctggcgagagagcttaagctctctgaagatgagaaaaaggaacgcaaccgggaaaattccagaaaccgcctggacgccgaaaaacggagctccaagctggctgagctcggccagagagataatgggggcaaccgcgccctgcttaaactgtgggaggaactcaatccggagaacatcctggaccggagatgtatttactctggacggcaaatcagcattggcatgatcttctccggggccgctgaagtggatcacattctgccttttgacgccacacttgatgacagcaacgcgaataagatcctctgcctgcgcgaggctaacagagacaagcggaaacgctctcccttcgaagcctggggaggcacccctcagtgggaggagatcgccgaaagagcttcccggctgcccagaaataagcgctggcggtttgagcctgatgccatggaaagattcgcggaggaagggggatttctcgctcgccacctggtcgacacacagtatcttggccggattgcccatgattacctgagatgtctctatcccgacaaaggggatggcagctctcacgtgtgggtcagcccgggacgcctgaccgagatggtgcggagaaagctgggccttaacgggctcctgggagaccataatctgggcgccgagcagcctaaaaaccgcaaggatcacagacaccatgctatcgacgccgttgtgacggctattctcgatcggtccatgctgcaacgcatccagagagcctctggggaaggagcgagcgacgccgagcttctgcggattatcgtccccgaaccctggacaggcttccgcgatgacctccagagagctgtggatcggatcgttgtggcccacagagctgaccatgggaccgtcgccaaggccgctacccgcggccgggaccagacagcggccagactgcacaatgataccgcttacggatttacaggcgaggccgacgccaaagggacgcctattgtggtgcatcgcgctccgctgggagcccttaagaaacccgagcacatcgatcaagttcgggaccctctgctcagagcggctctgcacgatttcaccgccggcctctccgggaagccctttgaagaccggattgccgctttccctcgcctgggaccccttgattatagaggcatccggcgcgtcagagtggtggagcctctgcaggtcattcccatccgggacgccgcgggccgcgcctacaaagggtataagggagatagcaactacagatacgacgtgtgggaactcccggatggcaagtgggagcagcgggttctgcagatgtattacgctcatcaatctggggaacctccccgccctcaccccgccgctagaaaagtgctgtcccttcatcgggacgacgtcctggccattgagagaggagagggcgggcgcgaactcgtgcgggttgtgaagtttagcacaaatgagttcaccctggctccgctcaacgaaggaggcgccctgaaatctagacacgcggataagggcgaccctttccgctatctttacccctcccctagcacactgaaagcctggcgggctagagaggtccgcgtggatgaactcgggcgggttctggaccccggatttcccgccagaaagcgccggagagtgacccgccctggccgggctgatgccgactga

SEQ ID NO: 3919 - RNA, 3321 nt, synthetic construct
  misc_feature 1..3321: note = Cas9 variant
  source 1..3321: mol_type = other RNA
atgcagtacatcgtggccattgacatcggcgtcgctagcgttgggtatgccgtgattgataagacctccgagacagtgatcgaagcgggatctaacattttccccgaggctagcgccacggacaatcaagaaagacggggcatgcgccaggccagacggctgaaacgcagagagcggacccgcctcgatgactttacaaagctgtgggaataccacgggcttgctatccctcaggtcaaaaagaacgatatcgtgggactgaaagttaaggccctctatgagtccatttctctggacgaggtgtaccttatcctgtatagctacctcaagcatagaggcatttcctatctggaagatgtcgaggactctagcgtgtccgggagcaccgcttacgccaatggactgaaactcaacgcgaaggaactggagaaaaatttcccgtgcgagatccagaagtaccggcttgaaaacattggcaaatatcgcggccaaatccagattgaggatgaccagggggaaaagctggatctctctaatgtttttacaatcggagcctacaccaaggagatccagcaaattctggacacacagaaaaagtatcacgctgaaatcgaggatgagttctgtgaaaaataccttaagatttttaccagaaaacggaagtattacgagggccccgggaacgaaaaatcccgcacggactatggaaagtacaccacaagactgaaggagaatggcgaatacatcaccgagaaaaacattttcgagaagctcatcgggaaatgcagcgtgtataaggacgaactgcgggccgcttctgcctcctacacagcgcaggagtttaatctgctcaacgatctgaataaccttaccgtcaatggacgcaaactggaagagaacgaaaagcatctcatcgtggacaaggtgaaaacgagcaacacaattaatatgagaaagatcattgccgatgctatgggcgagaaaatcgaggagttctatggcgcccggattgacaagtctgaaaaagaaatctttcacaagttcgaggtctacaacaagatgagaaaagctctggccgccatccatgttaatattgaggaattttcccgcgatgaccttgatgagatcgggtatattctgaccatcaacacagacaaggaagctatgatggaggcgttcgataatagccggctcgaactgcctggagagattaaaaactgtctgatctccctcagaaagaccaatggcaccctgtactctaaatggcacagcttttcccttaagattatgaacgagctgatccccgaaatgtatcgccagcctaaggagcaaatgacactcctgacggaaatgggggtgatgaaaggacagaccgacgagttcgaaaagaataaatacatccccgtggatgtcgccagcgaggacattttcaaccctgtggttcggagatctgtgcgcatctcctttaagattcttaatgctctgatgaaaaagtacggcacactcgacgaggtcgtgatcgaaatgccgcgggatagaaacagcgacgagcagaaaaagtgggaaaaggagacccaaaagaagaatgaaaaagagcaggagtatattgaaaacaagctggccacagtttacgatatccgcctgtctagcgccgacttctcctctcagaaacagctcaatctgaagctgaagctgtggaacgagcaagatgggaaatgcctctatagcggaaagatcattgaacccgaggacctgatcaaacactccgagctgtttgaaattgatcatatcattcctcggagcatctctttcgacgattccagaagcaacaaggtgcttgtctaccgcaccgagaatcagaacaaaggcaatcagacgccctattactatctcacacacaccaactctaagtggtcctttgaacagtacaaggctctggtgatggacctgagcaaaaagaaagagtacggcctctccaagaaaaaggtccggaatctgctttattctgaagatatcaccaaggccgacgtgctgagagggttcattaaccggaatatcaacgatacaagctacgcggctcgcgttgtgctcaataccgtccaaggatattttagagccaaagagatgggcacaaaggtgaaagttattcgggggtcctacacgcatcagatgagagtgaacatgaagctggacaaagaccgcgagaagtcttatgcccaccacgctgtcgatgccatgctgatcgctttcagccagcttggatacgaagcctatcggaaactccagggcgagtttattgacttcgaaaccggggagatccttaattccgaaaagtggaaggatcaaatgagcgacgaggtgtacaaacagtacctgtatagaaagaaatggtctaacatccgcaatgagattacaagagcggaaaagaacgtgaaatactggtattacgttgatcataagtccaatcggggcctctgtaaccagaagatccgcggaaccagagtctatgacggcaaaatttacaagatcaacaaactggatattcggaagaaagagggggccgctctttttaagaagctggccttcagcgaaaaagagtctgaccgcgaaaagctcctggtgtataaaaatgataagaaaacatacgaggacctggtgagaatcatgcaggattactccgacagcaagaacccttttgtccaatatgagaaggaaaccggagattacgtgcggaaatatgctaagaaacacaatggcccccgcattgacaaacttaaatacatcgacggggaggttggatcttgcatcgatattagccataagtatggctacgaaaaggggtccagaaaagtggtcctcgagagcctggtgccgtatcggatggacgtttactacaagaaagaggaacagacgtattacctggtgggcatcaagcagtctgatgtcaaatgtcaaaagggagagtatgtgattgacgaagatgcctacgcgatcaacctcgttaaagagaagatgattcagcagggccagaagcgctccgacctggaaagccttgggttcgagttccaactgtccttttataaaaatgatatcatcgagtacgaaaaggacggaaaaattgtgagagagcggttcctctctagaaccatgcctaaggtcaaaaactatatcgaaacaaagcccattgatcgcgccaagtacgagtggcacgaccggaaactggtgggcctggggaagaccaaaagaatccgcaagtaccggatggatattcttggaaattattacctctgcaacaaagaagagtttagcaagtattgttga

SEQ ID NO: 3920 - RNA, 3324 nt, synthetic construct
  misc_feature 1..3324: note = Cas9 variant
  source 1..3324: mol_type = other RNA
atgggctacaccgtggggctggacatcggagtcgccagcgttggcgtggctgtgctcgatgagaacgacaatattgtcgaagccgtgtccaacatcttcgatgaggcggacacatctaataacaaggttagacggacgctgcgcgaagggagacggaccaaacgcagacagaagacacggattgaggattttaaacaactttgggaaaccagcggatatatcattccccacaagctgcatctcaatatcatcgagctgcgcaacaaaggccttacagagctgctctccctggacgaactgtactgcgtgctcctgtctatgcttaagcacagagggattagctatctggaggatgctgacgatggagaaaagggcaatgcctacaaaaagggcctcgccttcaacgagaaacagctgaaggagaaaatgccttgtgaaatccagcttgagcggatgaagaagtatgggaaataccatggagaatttattatcgagattaatgacgaaaaggagtatcagtccaacgtcttcaccacaaaggcttacaagaaagagctggaaaagatctttgagacccaacgctgcaatggcaacaaaattaatacgaagttcatcaagaaatacatggaaatctatgagagaaagcgggaatactatattgggccgggaaacgagaaatctcgcaccgattacggcatctatacaaccagaacagacgaggaagggaattttattgatgagaagaacatcttcggaaaactcattggcaagtgtagcgtgtaccccgaagagtatcgggcctccagcgcttcttacaccgcccaggaatttaacctgctgaatgacctcaacaatctgaagatcaacaatgagaaacttacggagttccagaagaaagaaatcgttgagattatcaaggacgcgtccagcgtgaacatgcgcaaaattatcaagaaggtcattgatgaagacatcgagcagtactctggcgccagaatcgataaaaaggggaaagagatttatcacacatttgaaatctaccggaagctgaaaaaggagctcaagaccattaatgtggacatcgattccttcacaagagaagaactggacaaaaccatggatattcttaccctgaacacagaacgcgagagcatcgtgaaggcttttgacgagcaaaaattcgtctatgaagagaatctcattaagaaactgatcgagttccggaagaacaatcagagactgttttctggatggcattccttcagctacaaagccatgctccagctgatccctgttatgtataaggagcccaaggaacagatgcaacttctgacggagatgaacgtgtttaaatccaagaaagagaagtacgtgaattataaatacattcctgaaaacgaggtcgtgaaggaaatctacaatcccgttgtggtcaagtctattcgcaccacagtgaaaatcctcaacgctctgattaagaaatatggctaccctgagagcgttgtgatcgaaatgccgcgggataagaactccgacgatgagaaagagaagatcgacatgaatcagaagaaaaaccaggaagagtatgaaaagattcttaataaaatctacgacgagaaggggattgagatcaccaacaaagattataagaagcaaaagaaactggtcctcaaactgaaactgtggaatgaacaggagggactctgcctgtacagcggcaaaaagattgccatcgaagaccttctgaaccaccccgagttctttgaaatcgatcacattatccctaaatctatttccctcgacgatagcagatctaataaggtgctggtctataagacagagaacagcatcaaagagaatgacaccccctaccattacctgacgcgcattaacgggaagtggggattcgatgaatataaagcgaatgtgcttgagctccggagacgcggcaagatcgacgataaaaaggttaacaatctgctgtgtatggaagacatcacaaagattgatgtggtcaaaggctttatcaaccggaatctcaacgacaccagatacgcctcccgcgtggttctgaacgagatgcagtctttctttgaaagccggaagtattgcaataccaaagtgaaggtcattagagggtcccttacataccagatgcggcaagatctgcacctcaaaaagaaccgcgaggagagctattctcatcacgctgtggacgccatgctgatcgctttctcccagaagggatacgaagcctatagaaaaattcagaaggactgttacgattttgagaccggcgaaatcctggacaaagagaagtggaataaatacattgatgacgatgagttcgacgatatcctttataaggaacggatgaacgagatcagaaagaaaattatcgaagccgaggaaaaggtgaaatacaattataagattgacaaaaagtgcaaccgcgggctctgtaatcagacaatctacggaacgcgggagaaggatggcaaaattcacaagatcagctcttataacatctacgacgataaagagtgcaattccctgaagaaaatgattaacagcgggaagggctccgacctgctcatgtataataacgatcctaaaacctacagagacatgctgaagatccttgaaacatactctagcgagaagaatccctttgttgcttataacaaagaaaccggagactacttccgcaagtattccaaaaatcataacggcccgaaggtcgagaaagtgaagtactattctgggcaaattaacagctgtatcgatatttcccacaagtacggacatgcgaaaaatagcaagaaagtggtcctggtgtctctcaacccttatagaacagacgtttactacgataatgacaccggcaagtattacctggtgggggtcaaatataaccacatcaagtgcgtgggaaataagtacgttatcgattccgaaacgtataacgagctgcttcggaaagagggcgtgctcaatagcgacgaaaacctggaggatctcaattctaagaacattacctacaaattctccctgtataagaatgacatcattcagtacgaaaaagggggcgagtactatacagaacgctttctgagcagaatcaaggagcagaagaaccttattgagaccaaacccatcaataagcctaacttccagcggaaaaataagaaaggagaatgggagaacacacgcaatcaaattgccctggctaagaccaaatacgtcggcaagctcgtgacggatgttctggggaactgctatatcgtgaacatggaaaagttttctctggtcgtggacaaatga

SEQ ID NO: 3921 - RNA, 3324 nt, synthetic construct
  misc_feature 1..3324: note = Cas9 variant
  source 1..3324: mol_type = other RNA
atgggctacaccctggggctcgacatcggaattgccagcgtgggcttcgggctgatcgataacgtcgacggaaagattcttgagtccggcgttagactgttttctagcgctgatcccgacaataaccagacacggcgctcctctagacaagcccggcgcctcaatagacggaaagtgcaccgcctggaaagagtggcgcatcttctggaggaagctgggttcgagaagggagaagtcctcgcccctacgccgtatcacctgagagtgaaaggcctgaccgagaagctcagcaaacccgaggtttacgccgctctgtataaccttatgaagcatcgcggcatctcctacctggaagatgtggagctcgacgaagccgattctagctccgtcagccagaatgtggagctgcttaaggagtattacccttgcgaaattcagctggagagatatgaagagtacgggcagatccggggaatcattgaaacatacaacaaagacggcgagaaggagtctctcgttaatatctttcccaccggggcttataaaaaggaagccgaggcgattatcctgaaacaaggacagttctaccctgaactggataaggtgtttctcgagaagttcacagaaattctgaccgtcaaacgcccctattacgtgggccctgggaacaagaaatccagaacagactatggaatctaccgggagaatggcgagacccttgaaaacctgtttgatattctcatcggcaagtgtacgatctatccgcaggaggcccgcgctgccaaattcagctacaccgctcagctgtttgacttccttaatgatatgaacaatatttctatcgccggggaaaagctgacagaggtgcagaaaagagaaatttaccaccaaatcatgtccagcaagaccgtcaacatgatgaagattatcacaaaagttaccggatgcctcaaggaggaggtgacgggctatcgggtggactctaaatacaaggcggaatttcattccttcgccagctatagacagtttcgcaataaaatgctggactacgggttcgatgtccagacactgaacgtggagatgttcgacaagctcgctgccaagctgacccttaacacagaatatcaccaaatcattacccagctggagtccctcaatctgggactttctaaagagctgatcgaaaagattgctgattttcggaaaaagaacagaagcctcttctccaaatggcacagcctgtctctgaaggccatgaatgaggttgtggacgaactctggtccaccagcaagaaccagatgcaaatcttttctgagctgggcgggttcaaaagcaatattgaagtctttaagggacttaaatacatccccctggatgccatggtggacgagatctataaccctgttgtgcgctgttccattcgggagtctatcaagattatcaatgctctcctgaaaaagtacggcgcgctggataaggtcgtgattgaaatgcccagagacagcaacgagaaagaagagaaggatcgcatcacaaaacttaataaggaaaacgacaataaaaagaaacaggccattgagaaggctcggaacgagtacggcttcggggaagaggcctatagacagcagaatgatctcaacacgaagctgcgcctgtggtacgaacaaaaacagcggtgcctctattccggagagatcatcaagatttttgacctgatcaaaaatcctcatcttttcgacattgatcacatcattcccaagagcatctcttacgacgattccctgagcaacaaagtcctctgttatgccaccgaaaacagagagaagggcaatctgacaccgtaccgctattttaagcggaaggcttctctgacctggaactacgaggcctacaaatcctatgtgatcgaactttacaaagacgggaagggagatctcagcagaacaaaactggagctgctcctgttcgaagaggacattaataagtatgaggttcggcagcgctttatcaacagaaatcttgtggatacccggtacgcgtccaaggtcgtgctgaacacgctccaggacttcatgaaagaaaattatcctacaaccaccgttgaggtggtcagaggcaagtttacagctcaactgcgccggcattgggggattcggaaaaaccgcgatgaaaatcacgcccaccatgccatcgacgctctgattatcgcctgcgtgccccacctttctctctggaaggagcagaaaaaggtgttcagcaccgatgagttcagagttgacgaaacaacgggcgagatcattgaacagtcctacaaccagctgacctatcaagagcctttttctcagttcttttaccagctggaaaaggtcagcatcgattgtcggtactcctataaagtggaccgcaagttcaatagacaggtggctgacgccacaatttacagcacccggcaaggaatcgtcaaacagacatctggcgataagtcctttaccctcgacagcaactctaaagagcattatgtgattgcgaagatcaaaaatatctacgaagatgttgacgccaagcgcttcatggatagatataagaaagacaagacgcagtttctgatgtaccaccatgatccccaaaccttctccattcttgaggacgtgatgaaaacatatcccgataagaaaaacccttttcaggcttaccggctggagtacgggccgatccgcaagtatagcaagaaaggaaatggcccccagattcagtctatcaagtactatgacagcaaactcgggcaacacattgaactgaagcaggccaaccagtccaccaaaaaggtcgtgctgcagagccttaacccttggagatgcgatatctactataataagaaagacaagcggtacattgctgccggactcaaatatgcggatctgtcttaccaaaagggcacagggctgtacggcatctccctccagcgctatcagcagatcctgaacagcgagaaaattgaactttccatcgagcaaattgaactgctcctggagggaagactgaatgagtctaacttcgaattttgtttcagcctttacaagaatgactttatccagtggaacgacgagaataaccagaccttccaatatcggttcctggccagaaatctctcctctcccaaccgcattgaagttaagcctatcaataaaagcaagtacgataaacaggctgagggcctgaagacgctcaaaaaggggctgaaccggttttataagatctccgtggacgtccttggataccagcacttcattaaaaaggagaaactgaagctcacatttaaatga

SEQ ID NO: 3922 - RNA, 3330 nt, synthetic construct
  misc_feature 1..3330: note = Cas9 variant
  source 1..3330: mol_type = other RNA
atgagccactacgtgctgggcctcgacatcgggattacctccgtcggatatggcatcattgatctggacacaaacgatttcatcgactacggggttagactttttaaggaaggaacggccgctaataacgaagatcggcgcaattctagaagccggcgcagactgctctcccggaaacatacccgcctgatggacatgcagaaggtgcttaaagaggccggcattatgacagaatcttatagccccctgtccaacgtgtacgagatcagaaagaaagggctcaccaaggaactgacaaatgatgagctgaccgcggctatcctccacattacaaagcatcggggatctgtcatcgagaccgtggaagacgatgaggccgccgctaaagaaacgggcgagcttaagagcacccttcacgagaacgccctgctcctggctaataacaaattcgtttgcgaaattcaacttgagcgcctgaatacagaaaacaagatcagaaatcataaaaacaattttaagaccaaggactatgtggccgagctcaaagaaattctgaaccaccagaatctgtccgaggaggtcaagaacaaaatcattcagatcgtggaacggcgcagagcgtactatgagggccctgggagcttcaactctccgacaccctacggacggtttatcgaagttaatggccaggtgcaagagattgatctcatcgaaaagatgcgcgggaaatgttccgtctaccctgacgagttcagagcccccaagatgagcatttctgctgatctgtttaacatccttaatgacttcaacaatctgctcgtgcagggagagaaactgcaggaagaggacaagaagaaccttctgaaaattatcaatgataagggctccatcaccctccggcagattagcaaaaagctggaagtgaacgaggacgaaatcaaagggtatagaattgataagaagggaaaagccctgtttacggagttcaagggctacaaaatcctcaagaaactgtttcttaattgcggccaatctatttccctggaggactatgaaatgctcgatgagatcatcgaaattgtcacaaagaagaaagggatcgacgagcgcaaggatgctctgaaagagcttaagtgggacctgagcgatgacattatcaactccctctctgaagttaccggaattgtgggctaccacagcctgtccctgaaagccatccgggagctcgatagcgaactgtataagacatctcttaatcagatgcagctgctccatgagctgaagatgttcgacaaaaacagaccttcctacaaggggaaaaagaatattgtggcggaccccgaagccatcctgagccctgtcgctaaacgcgcccagaacgagacctttaaggtgatcaatgctctgcggaaaaagtatggagagttcgattctattgttgtggaaatgaccagagacaagaacagccaagagcagaaaaagcgcatcaacgattcccagaaagccctcgaatctctgaataaggaggtcgaccaactgctccagcagaaaggctacgatccgcagaaggtgaaggggaaaacaaagcaaaaagttcggctgtacatgatgcaggaaggaaagagcgcctatacgcttcaggagctggacctccacagagtgattaaagatgacaagtacaccgagatcgatcatattatccccatctccattagcctggacgattctcagtccaacaaggtcctggcgcttcacagcgaaaatcaacagaaaggcaacctcacacctttcatggcttttcacaccggccgcttcgccgacatggggtgtacatggaataagtttaaagagaacgtgctgtctaataagaactataaacataagaagaaaaataacctgctcgatgaacgggacatcaataagttctccgtcattcaggagtttatcaacagaaatctggtggacaccagctacgctaaccgcgttgtgcttaatacgctgacagattatttcaaagacaacgaaattgataccaaggtccacaccgtgaacggaaaactcacagacctgtttcggaagagaatcaatctgaaaaaggatcggaacgaggactaccttcatcacgccatcgatgccctcattgttgcttccatcaagaaactgcgcctgctcgacggctatctggccaagtacgggttcgagaccctttacgatgaaatgacaggagagattaaagaaatccccgaggacaaggcgtttttcgatgacaaatatattagatacatcctgaatctcaagacgatctatgagtctagcaacatgtactatcggggcattctggaaagagaggaactgatctaccagcctattaagatctcccataaaattgataccaagcccaatcgcaaagtgtctgacgagacaatctatagcacccggattatcgacaacgaagatcaccttatcgagaagtactccgacatttacgatccgaaatttaagaatctcacagaggacatcctgaacggggaaaagaataaatatctgatggagaagaacgatcctcaaaccttcaatattctcaaacagatcatttttaaccactacaatacgtataaggacagcaaagaatactataagatcgagaagaaaaaggaaaaagagatcattaagctggtcggcatcaaccccctttctctgtacaaagaggaaaatggacctattaagaagtattccaaaaagggcaacgggcccgtgatcatgagcatgaaatacgattctgagaagctcggaaaccatattgacatcacccccgattccgctaaaaataagaaagtgatcctgaagcagattagcccttacagaacagacttctataagtgctctgatgaaaaattccgctttgttaccgtcagatacaaggacgtgcactatcagaaaagcatcgacaagtactgtattgataaagagtggtatcaaaacgaaaagaagaataaaaagatcgacgagaaagccgagttcctgttttccatgcatcacgatgaacttattggcatcacacggaaggagagcgaacagttcatttacgacgagtctaaagagaaccacggggatccgcgctatcatgacggagtgaagcccgaaatcctgaagtttaccgccacgaataacgatacaaaaggcatcattgaggtcaagcctctctacacctactccgcttatagactgaaacccacagtgctcaatgttaagaacatcaaaaagtacgccaccgacgtgctggggaatctttatgaagtcaagcagaacgagctgaaactcgagttctga

SEQ ID NO: 3923 - RNA, 3333 nt, synthetic construct
  misc_feature 1..3333: note = Cas9 variant
  source 1..3333: mol_type = other RNA
atggccgagggcaagaaaagaatctggcggctgggggctgacctcggagccaacagcctgggctgggcggctattgaactttccgcccccgtgaatgggaagcctatcgccattctggctgccggatctcgcatcttcagcgatggcagagacccgaaatccggggcttctctcgccgtcgatcggcgcgacgcgagagccatgcggcgcagacgggatcgctttaagcagagacaaaaagctctgattaagtaccttatcgccgacggactgttccccgctgatgaggccgcgcggaacgccatggctgccatcgacccttatgctgttcgcgccagagccctcgatgaagctctgagcctgcccgagctcggccgggcgctgtttcaccttaatcagcgcagaggcttcaagtccaaccggaaagccgacagaaaggctgatgacgatgccgggaaaattgccatcggaattgaccgcacccgggacgctatcgccgaagatgaggcggacgctggcgccgagcctgggtcttggacatttggaaagtggctgcatgaaagacgcctcaaaggccagagcgtgcggacgagactgcgccccgagtccggggaagatgccaagggagacggctacgatttctatcctgaccgggctcttatggaggaggaatttgatgccatttgggctgcccaggcgccgcaccatcccgacgtgctgaccaatgatgtccacgacagactccatgagatcattttctaccaacgccctctgaaggctccccaggtgggcatgtgcagcctgatccctggggatcggagactccccaaagctcacccgctgtttcagcgccggagacttctggaggaactcaacgccctgatgatcgttcggcctggagaagtggctcagcgccttacaagagaggagcgggacattctgctcctgaagctgaaagacaagaataaagtctctttcgccaccctcagaaaggcgctgaaacttgatcccgacgcccgctttaacaaggaatccgaggatcggacagacctgaagggcgatgaagtggctgccgttatggggagcaaaaccagattcggaaatctctgggtgcacctgtctatcgaggctcaatgggacgtccttgcccgcctggatgccgtggaatccgacgctgaggatgcggccttttgtgcttggctcgtggagacatatgccctgacccctgaacaggccagagctgtcgccaacgcgcccctgccccctggctacgggcggttcggagagacggctacccgcaagctcattgaagccctgagagacggcaaaaaggatgaccgggttcttgtgtatagcgaggccgtgacagaagctggcctggggcatcactctgatcgcagaaccggagaggtcttcgaggacgccaaaggccggccgcagctcccctactacggggtggcgctggaacgccatatcatgcctggaacaggcgacccctccgatcctgaggaaatgagagttgggcggctgaccaatcccacggtgcacattggccttaaccagctccgcagaatcctgaatgtcctgatccgggcttatggaccgcctgccgagattgccatcgagctcgctagagaactgaaacttacagacgaggataagaaacgcattaaccgggaaaataacgacaacagaatcgccgctgagcgccggagcgaaaagctgctcgccattggccaagcggattccggggccaatagagctctgctgaaactttgggaggagctcaaccccgccaatgtgctggaccgccggtgcatctactctggaagacagatcagcattgatatgctgttttccgctgccgttgaagtggaccacatcctccctttcgccgctaccctggatgacagcaacggcaataagattgtctgtcttcgcgaggcgaaccgggaaaagagaaagcggtctccccatgatgcctgggggcactccgctcgctgggacgagatcgccgccagagctgcccagctgcctcggaataagcgctggagatttgaacccgatgcgatggacaaattccgggacgagggaggctttcaagctagacatctcgtggatacacagtatctggcccgcctgagccgggagtaccttgccaccctctatccggaaaagggggagggctctggacacatttgggtcagccctggcagactgaccgaaatggtgcgccggaaactggggctcaacgacctgcttcccgatcataatttcggaggcggggctgaccaggccaagaacagactggatcaccgccaccatgcgatcgacgctgttgtggtcgccattgtggatcggggaatgctcaatgccatcgctagagcctccggccaggagggggctgaaggccgcgagagaatcattatccccgagccttgggacggatttcgggatgccctgcgcgaaacagttaacagaattacggtgtctcaccggaccgaccatggcacagcgagcaaagccgggctgccgaagggaaaggatgctaccgccggccgccttcacaatgacacagcttacgggttcaccggagacacggatgccaaaggcaactccatcgtcgtgagacgggtgcccctcagctcttttaagaaactggccgacctggatcgcattagagacgctgatctcaaggcggccctgtatcaacaccttaatgggctggagggcaaagccttcgaaaaggccctcgccgagtttcataaactggagtggcacaacttcggaggcgttcggagagtccgcgtgacagaacctctgaccgtgatccccatcaaggaccggaacgggagaatttacaagggatacaaaggcgattccaattatcggtacgacgtctgggagcttcctgatgggaagtgggtgaccaactggaaaaatgaagctggagaggccatgagctctgttatctccatgtttgacgcgcatcagagctccgaaccccctcgcccccacccggctgccagaaagattctgtctctccatcagaacgatctgctcgccatcgagcgggagggcgaagaccgcaaactgatgagagtggtcaagttcggccagagcgggcaaattacacttgctgagcaccagcaggccggagatctgaagaaacgggacgcggtgtccaatgacgatgaccctttcaagtattttgcccccacctctggcgggctcaaaaaggttaaagctcgccaggtgagaatcgatgaaatcggacgggtcctggaccctggcttccccgcccgcacagctagacggaagacgagagggtga

SEQ ID NO: 3924 - RNA, 3333 nt, synthetic construct
  misc_feature 1..3333: note = Cas9 variant
  source 1..3333: mol_type = other RNA
atgaccgcccggacacacaagatctggcggctgggcgctgacctcggggccaacagcctgggatgggcggctattgagctttccgcccccgtggatggcaaacctatcgccattctgcatgctgggtctcgcatcttcagcgacggaagagatccgaagtccggcgcctctctcgctgtcgaccggcgcgatgccagagcgatgcggcgcagacgggaccgcctgcagcaaagacagcgggcccttattaaatacctgatcgctgatgggctctttcccgccgacgaaaatgagcgcaaggctatggccacgatcgatccttatgcggttagagcccgggctctggacgaagccctgaccctccccgaggtgggacgcgctctgttccaccttaaccagagacggggctttaaaagcaatagaaaggccgatcgcaaggccgacgaagatgctggcaaaattgcgatcgggattgaccggacaagagacgccatccgccaggctgaggaggaagccggagccgagcctggctcctggacctacgggaagtggctgtatgaacggagagcttctgccacagatgcgaacgctattcccagcgtgcgcacccggctcagacctgagacagacgagcatgccaaaggagatggctacgacttctatccggggcgcgccctgatggaagctgagtttgccgctatctgggaagcccaagcggcccaccatcccgatgctcttaccaatgaggtccacgaccggctgcacgaaattatcttctaccagagacctctcaaggctccccagatcggagtgtgcacgctgattcgcggcgatcagcggctgcctaaagctcatcccctctttcaaaagagacggctgcttgaggagctgaacgccctcaccatcgttcgcccgggcgaaatggcgcagagactgacacgggaggaaagagacacccttttcctgaagctcaaagataaggccaaagtgtcctttgtcagcctgcgcaagacactgaaactcgaccctgatgctcggttcaataaggagtctgaaaacagatccgacctgaaaggggacgaggtggccgctgccatgggagccaagacccgctttggcaatagatgggttcaccttagcattgaggaacagtgggatgtgatcgctcggctggaggaagtcgagtctgacgcggaagatgccgcttgtcgcgcctggctcgccgctacgttcgacctgacacccgagcagattagagccgtgaccaacgcgcctcttcctcccgggtattcccggtttggaaaggtggctacacaacgcctgatcgatgccctcagagacggcgagaaagatgggcgggtcctggtttacagcgaagccgtggctgccgcgggactgggccatcactctgacctccgcaccggcgagatcttcgaagatgctcaggggagaccccagctgccgtactatggagtggcccttgagcggcacattatgcccggcaccgggaatcctgaccattccgatgagatgcgcatcggaagactgacaaaccccacggtccacattggcctcaatcaactgcggagaatcgtgaacaccctgattcgcgcctacgggcctcccgctgaaatcgccatcgagcttgctcgggaactcaagctgacagacgatgacaaaaagagaattaataaagagaacaacgaaaatcgcctggccgcggagaagcggagcgagaagctcctgaccatcggcagaccggacacaggagccaaccgcgcccttctgaaactctgggaggaactgaatcctgccaacgttctggatcggagatgcatttataccggcacgcagatctccgtggacatgcttttctctgctgccgtcgaagtggatcatattctcccctttacagccaccctggacgatagcaatgggaacaagatcgtttgtatgcgcgaggctaatcggaccaaaagaaagcagtccccttacgaagcgtggggacacacagaccggtgggaggagattgccgctcgcgccgcccagctgcccagaaacaaacggtggcgcttcgaacctgatgctatggagaagtttaaggacgaaagcggcttccaagccagacatctcgtggatacccagtatctggcgcggctttctagagagtacctggaaacactctatcccgggtccggagagggcagctctcacatctgggtcagcccggggcgcctgacggagatggtgcggagaaaactgggccttaatgacctcctgcctgatcacaactttggaggcggggctgaccaggccaagaatcgcctggatcatcggcaccatgccatcgacgctgtcgtggttgccattgtggacagatccatgctcaccgaaatctctcgcgtcagcggactggagggcgcggaagggcgggagagaattatcattccccctccctgggatgagttccgcaacgaccttagaacagctgtgaatgccatcaccgtttcccaccggacagatcacggaaccatcagcaaagccggcctgccgaaggggaaagacgctacggccggccgcctccataacgataccgcttacggatttacaggcgaaaccgacgccaagggaaattctattgtggtcagacgggtgcccctggcgtccttcaagaaactggccgatcttgaccgcatcagagatacagacctcaaggctgccctgtaccagcacctggaggggctcgaaggcaaggcttttgagaaagccgtgatggatttccctaacctggaatggcatccctttgggaacgttcggagagtccgcgtgaccgaggtgcttagcgtcattcctatctctgaccaaaatggacggatttataaaggctacaagggggactccaactatagatacgatgtgtgggagctgcccggcggaaaatgggaagccgaggttgtgagcacgttcgacgctcaccagcctgattgggtctccaagatccgctctcggagccccacagcgagaaaggtgctctccctgcagcagaatgacctgatcgccgttgaacgggctcatgagacccgcgaacttatgagagtggtcaaatttcggcaaaacggcgagattacattcgccccgcctcaggaggccgggtctctgaagcgcagagatgctacccccaatgaagacgatcctttcaaatattttgccgtggcggctagctccctccagaaggccaaagcccggcaggttcgcatcgacgagctgggaagagtgctcgatcccggcttcccggctcggaccgcccgcagaaagacaagaaagagcacgtga

SEQ ID NO: 3925 - RNA, 3333 nt, synthetic construct
  misc_feature 1..3333: note = Cas9 variant
  source 1..3333: mol_type = other RNA
atgagaatcctgggcttcgacattgggatcaccagcattggatgggcctacgtggagggcgaagaactcaaggattgcggggtccggatctttacaaaagctgaaaacccccagaatggagactccctggccgcgcctcgcagagaggctcggggcgttcgcagacggcttgcccgcagaaaggtgcggctgaacgtgattaaacgcctcctgtgtaaggagttcgggcttaatctgtctgattattttgccaacgacggagagctcccgaaagcctacgagacgaccaaggatacaaagagcccctatgaactgagatccctggccctcgagcaaaaactggaacctaaggagcttgctcgggtcatcctgcacatcgccaaacatcgcggctacggcaataagcacgcgaaaagagacctcgaggccgaagagaaggctaagaaagccgctgaaaaggctccccaggagaaagaatctaccacaaccaacggggatagcaagaaagagcaggagaaggtgctgaaagcgctttatcagaatgaaacactgctcaagaagtaccaaaccaactatcagacgaataacaaaaccaatgacgagacaaacaataagaccattttcctggttggaaaatacctgtacaaggaatttcaggataaaggccagcggatccgcaacacaaccaataactatcaacatacgatgagacaggagtggctcaaggacgaactggagttcatttttaagaaacagaaggatttcggggccacattttccgagaacttcgaatctcagatccttgagaccgctttttaccaacgggacctgaaatccttcgaagataaggtgggaaaatgcgtcttttatgagaatgaaaacagagcccctaaggacagcctcagcgctatggagttcgtggccctgacacgcattatcaatacccttaagaacctggagaaaaagtctaaaaatctcggcattggggaaacctacggaaaggacaaaatccaggagatcctgaagattgttctggataagggcgaaatgtcctataaagagctccggaagatcctgaaacttaacgagagcattctgttcgccaaggactctaaactcgattacacaaagggcatgcaggaagctgagaaagcgaagtttatcgaactgaagaatcttaaagccttcaagaaagctatgggaggggacttttccaagttccccagagaggaactggataaaattgccacggacatcgtgctcatcaagagcaaggagaacctggccaaaaagctgcaaaattattctgctctctccaaagagcaggtcgaagccctgagcaaccttaattttgcgaagcacattgatctgtccctcaaagctctggacaagatcctgcctttcatgcgcgagggcctttcttacgatgaagtggtgaagaaagtcgggctccaggagcatcggaagtacaaacagaagggagaatttctgattccgctgaaagagtatgagccctacctcgccaaccctgttgtggccagagctctgagcgaatatcgcaaggtgcttaatgccctgctccggaagtacggcaacgtccacaaaatccacctggagttcaccagagaagctgggaagaattatgacgagcgcaaaaagattgaaaaagagcaacgggagcattttgaagccaaccagaaggcgatcaaacagagagagatcctgggacttcccattaacggcgccaatatcctcaagatgaagctgtggattgaacagggcgagtgttgcgtgtactccggggagaaaatcacaagcaagcacttctttgattctaacgctctgcaagttgaccatatttatccttactcccgcagcttcgacgattcttacatgaataaagtgctcgtctttgccaaggaaaaccagaataaactgaacaagacccccttcgaggctttcggaagcgacaaggaaaaatgggatcggatcctttccctgtctgccaagctcccgaaacagaagcagagacggattagcaataaagactttaaggataaggagctgggcttcatcgcgcgcaacatcaatgacacagggtatattgccagactggcttcccaatggaccaacaattgtcttaaatttgaagatctccgggagaacgaggtgacgatcgccggagaaaagggcagcaaaaatcacctggaggttatttctgggcagctgacatccatgctcagacactactggggcctgggagacaaggatcgcaacaatcatcttcaccatgctgtggacgccgtcatcattgcctataccaacgctaaaaccatcaaggcgttcgccgattttaagaaaaaccaggaacagaatcgggctaagttctacgccaaacaaatcagcgagcaggaatataagagacagcgcaacccttttgagccctgcgccaatttcagacaacgggtggaggagaaaattaacaagatctttgtctctaagcctccccgcaaaagagctcggggcgccctgcacaaggaaacattcgggtccatttgtctcgacggaaataacaattgggtggcgcgctttaaaatcaagagcaaaaaggaacaggaggatattaccaaagaaaaggctacaaaggccaaatacaaggacgagttcaaaggcgaggaaaacatcagaaaggccctgaaactggggaagatccggcgcattaataacacgcagaaggacatcgctattggagataaaatcgttaagaatgagaccatggtgagagtcgacatttttaaagataagaaaggcaagttctatgccgtgcccatctacacaatggacttcgcgcttgggatcctccctaacaaggctgttgccaccggcgaagatgaggacggagtgattaaagattggatcgagatggacaagacaaaatacgaattttgcttctccctgtttaaggatgacctgattaaagtccggaagaagaaaatgaaggaggccgaactctgttatttcgtgggctttgataccgacgggtctcgcatcattgtggctaaacataataacgattaccagacgatgaccgagaatgaatgcaagctgttcacacttaaagagaagaaaaagaagcagaaaaccctgaacgacgaggaagacaaccaagagagaatcgaaacagagtataagattatcggaggccggaccgggatccagaatctcgaaacgtttgagaaacaccaggttagcccgctgggagaggtccaaaaggccgagttcgaagatagacaggaaattaaactgaagtcctctcccaagggcaaagactga

SEQ ID NO: 3926 - RNA, 3333 nt, synthetic construct
  misc_feature 1..3333: note = Cas9 variant
  source 1..3333: mol_type = other RNA
atgagcgagaagtacagactgggcctcgacgtggggaccaactccctgggatgggccgtcatcggccttaaagaagatgttccctctagcgtgctggctacaggggtgcggattttctccgagggacgcgacgccaagacgaaatctaccctcaaggcgagcagaacagaaaaacggtccgctcgcagacggcgcgatagatttctgcagcggcaaaccttccttatctctgagatggtcaagagcggcctgtttcctaaggacattgtggaacagaaaaatctcgagctgctggatccgtatgagatccgcttcaaggccctcacagaacaggttcccctgcaccatcttgggagagccctgtttcacattaaccagcggcgcggattcaaatccagcagaaaggacaaatctgaggaaaccacatccggcgtggtcagcaagtctgtgcgggctctctacgaggagatgcaactgatcaatcctgcccccgttatcgatgaccctaaggctctttccaaagaagaacgcagagaaattcgggtgcaggaggccagctctagagaagaggcgctggtcaccctcgccgagcagaagggcgtgacgtttggggctttcctgtatcgccggctgcagtccggaaaaagcgtgagagcccgcaaggatgctgactcccaactctacgatgtctatcccacccgggaactgcttaaagacgagtactctaagctgatgcagcatcaggcccagtattaccctaacgttatcaatgaagcgctcattagcagactgcacgatgtgatctttttccaacgcaaacttaaggagcaggaacggggcttttgcacatactatccgtccgagagacgcaccttccggtgtatgcccagctttcagcaatacagaatggtgcaggagctgaacgccctcgaatgggtcgacgctgccgggaagcattgcctgcgcgactatcctgagtctcgggatctgattctctccgaactggagaatatcagcacaaaagctggagagttcaccttcggcaacatgaagaaaattcttaagaaaatgggggtgatcgacggagaggtttcttttaatttcgagggccccaagagaaagggctttcaggggaacgtgacgagccgggaaatgcgccacgaggattgtttcggaacaagatgggacgaactgtccctcgatgagaaagacgatatcattgacaagatcaatgatgaccacctggatgacgaggacatggaacggtaccttattgatacctatggcctgtctagcttttccgtcgggaacgccatcaatgccagactcctggagggaacagctaacgtgagccgcaaagcggcccggaccctgtacgaaaccatgctctctgctaattgcctgcagtccgacgccgttattgccgtgagcgagcaagatgacacattcgtcaacccttattctagaacgggccgcggggaacttctgtccgagctcccctactacggagaggcttttcaggatggcagacatatcatcccgggcaagcgggaacctaaagtgagccacgaccagctgaagttctatgggggagtctccaaccccaccgtgcatattgccctgaatcagatccgccttgttgtgaacgagattatcaagagatacggcctcccttctagcatttccatcgaactggcgcggaatctgcccgaggggcaagatggacgcagaaaaatcgaaaagatgcagtctgagaaccagaaaaataacgagcggtatgaccagattctcacagaaaatggccaaagccccaaccgcgataatagactgcggcttgctctgtgggaggaactcggggagggccctaccgaccgcctgtgtgtctttacaggaaagctgatcgaacttgccgatctcttcaacggctccgtggagattgagcacctgatcccgtttagcgtttctctggacgattccaaagccaataagaccgtgtgctggaaggaagctaacagattcaaagggaataagacgccctacgaggcctttgctaacaatagcggagactattcttgggaagagattatggagcgggtcagagccctccctaactccaaacagtggcgcttccaggaagacgcgctgaagatctggaacagcgatcactctgacttcagcggccggcatcttaatgatacaagatacatttcccgcctggcccgggagtatctcgaaaacatctgtccctttaataaaatcgacgtggtgaccgggagactgaccgctctgcttcgcggacactggggcctcaacaatattctgcgggggcataacgagcctgaaacagccacccccaagaaaatgagagatgaccaccgccatcacgctatcgatgccgttgtcattgcgatgacaagcctgacgatcctccagaaggtgtcttccgccgctggcaaggccgaggagctggacgtgggaaaacttttcgctaaggatgaaagcggccggtccgtcattgacccgtgggatgggtttagagacgaggtggccgaaaaagttcggaatatcatcgtgtctcacaagaccaaacgcaagacaattggaaacagcggcaagtccaccgatagagccctgcataatgagacagcttacgggctcatcgacggacctgacgaaaaaggcctgtactctgtcgtgaccacgaagcccattagctatttcgataaccgggacaaaatcgagaagattcgcgatgagaaactgagagacgattttcttaccgcgtgggacggggaaggcgataataaggcctcccaactcgctgttctggacaaggcctctggactgaacgtgaaaaagtgccggtacgtcgagcgcaaaaaggtgatccctatcaatggccccgatgggcagccttataaagcctacgacggaaacagcaattggggcatggaaatttatgagttccccaacgggcacccgaaggaaaagaaatggaacggagttgtgatctccacatacgatgctaataagagcgagtttaaacctggcgagaccttcagaccccatcccgccgcgaagctcgtcatgcggctgcacattaacgacatcgtggaagtgcagaatgacggggagcctattctttatagagtccaactgatctctgctggcacactcaccgtttccccgctgcacgaagccaacgtggatagccgcaatcgggacaaacatgatgagtttaagtacaaatctctgtccgtgacgcccatgcagaagatgggagccaagaaagtcaacatcagccctacaggccttaagaattactctagatga

SEQ ID NO: 3927 - RNA, 3345 nt, synthetic construct
  misc_feature 1..3345: note = Cas9 variant
  source 1..3345: mol_type = other RNA
atgggcatcattatcgggctggacattggaatcgccagcgtgggcattgctgtcgttgataaggacaccctcgatatcaaatgcgtggtgtccgacctgttcgattctgccgacgcgagcaagaacatcgagagacggaataaccgccaggctagacggcttaatcgcagacggaaaacacgcattggggattttaacacgctgtgggtctccatgttcggagaactccccgaggaagtggactctaatgttctgcttctgagaaacgccggcctcgatgagcaactgaccctggacgaaatctactgtgtgctcaagtatatgctgaaacaccgggggattagctaccttgaggatgccctgaatgaggaaaacgtcacaggatcctatcagaagggcatcgctattaatcagcgcgagtctgaatacatgctcccttgcgagatccagctggagagatttcggaagtatggccaataccgcggggaatgtgaggccgaaaacgagaatggagaaaagattacccttagcaacgtgttcatgacaaattcctatagaaaggagatcgacaaatttctgaacacccagggcaagtacgggatcctcaatcagaaattcattgatgagtacctgaagatctttaaccggaagcgcaaatattacgaaggaccgggcaacgaaaagagcagaacagactatgggaaatacaccacgggaaaggacctggatggcaaatatattaccgaaaagaatatcttcgagaaactcattggcaagtgctctgtttacaaggaggagctgcgggctgccggggcgtcctatacagcccaggagtttaacatccttaatgacctgaacaatatcaccgtgaacaataaaaagctcacaacccaacagaaaaaggatgtcattgaaatcgtgcagaacagcgacagaattaatatggagaaaatcatttcttcctgtatcggagaaaagatcgagaagattgaaggcgctcgcatcgataaaaacgagaagaatatttaccatacgttcgagcagtacaacaaaatgcggaagatctttgccgagaaaaattatgacattaaggaactgacaatcgaacaacttgatgagattgggagaatcctgaccatcaacacagagcgcgaaggaattaaggacgctatcatggagagcgaactcctgcacctgaataacgagcagattaacctcctgatcgaacttcggtacaaaaattcttccctgttcaccaagtggcagagcctctccattaaagccatgagagagatcatccccgatctgtatgaccgcaacgtgaatcaaatgaacattcttgcggagcggggcgtctttaaggataaaatcaatctgttcgaaaactctgtttacctccctaaggagcccgtgctggaagagatttataatcctgtggtcagacgcagcatctccatgaccattgacgccctgaacgctctcatcaagaaatacgggtatcccgaagacatcgtgattgagatgcctcgggatagaaatgacgccgagcagaaggatcgcatcaaaaagttccagaaaacacgggaaaacgagctgaagaatattaaaaagaagatcaaagaagagtacggaattgaaatcacggacgagtactttagaaagcataaaggccttgagctggaactcaagctgtgggttgagcagaacgaaaaatgcccgtatagcggcaagtacatcaatgtgcaagatattctgtatcaccatgagcttttcgagatcgaccacattatccccctctctatttcctacgatgacagccggaacaataaggtcctggtgtataaagaagagaaccaggataaggggaaccgcacccctctgatgtacctctctacagttaatagacagtatgaccagcacgaatttatgaactacgtgctgagcaccaaaacacttccccggaagaaaagagagctgctcctgaattacgaagatatcaccaagattgacgtcctgaagggattcatcaaccgcaatcttaacgatacgcggtatgcttccagatctgtgctcaatgccatccaactgtttttcggcgggaaagagtgtgacacaaaggtccgcgtgattagaggagccgttaccaaccagctgcggatcaaactcaatctgcctaaggaccgcgagaaaagctactcccatcacgctattgatgcggccatcatgtgctatagccagatgggccttatgaactttagaaatattcagaacaagttcatcgactttgaaaatgagacctacctgtctgatgaacgggactcctgtttcgataacaagtattacgacgaggctctctttgggcaagtgctgaaaatgcgcaagaatctgcttaaagccgaaggcaagccccagagaagcgtccagtctaaaggagtgttcgatgaggaggaaaagaacaacggcatcgttcggtatcatcacaaagtggacaagaagccgaatcgcgggctctccaacgccagcatttacggaacaagaaaaatcgatgacaagatttacaaaatcgtcggctatgatattcggaataacaaggacgctgaggccatcatcaatattatcaaaaaggggaagtccgataactttctgatggcgaaacacgaccctgaaaccttcaagaatctgatggagatttacgaacagtataaagaggagaagaaccccttcctcgcttacgaacaagagacaggagactatatccgcaaatacgccaagaatcataacggccctattatcaagaaaattaagtatgtggattctgaagtggggagctgcatcgacatctccgccaattacggctacaaaaacggagataagagagttattatggacacgctgaccccctatcgggctgatgtctactataattacaaagacggcacatatagaatcattggggtgaagtacgccgattttaagtattctaacgctaaatacgtgcttgacgaggaggcctacgcgctgatcctcattaaggaaggactgctgaaaatcggcgatagccttgagaatatctccagctctgggtatgaataccgcctctccttctataagaacgacattatcgagtacaccaaaaatgatattgtctataaggaacggtttctgagcagaacaatgcccaaggtgaaaaactacatcgagaccaagcctatttctgccgctctgtatgagaaacgcaacccgatcggactcacgaatgccaccaacatctgtaagatttacacagacgttctgggcaatgaaaccaaaatctacaaggagaaattcaaactttccgtggactga

SEQ ID NO: 3928 - RNA, 3345 nt, synthetic construct
  misc_feature 1..3345: note = Cas9 variant
  source 1..3345: mol_type = other RNA
atgaactacaccgagaaggaaaaactgttcatgaagtatatcctcgccctggacattggcatcgctagcgtggggtgggccattcttgataaagagtccgaaacagtcatcgaggcgggatctaatatttttcccgaagctagcgccgccgacaaccagctgagacgggatatgcgcggcgctaagagaaataaccggcgcctcaaaacgagaatcaatgacttcatcaagctgtgggagaacaataacctttccattcctcaatttaagtctaccgagatcgttgggctgaaagtgcgggccattacagaagagatcaccctcgatgaactgtacctgattctctatagctacctgaagcaccgcggaatctcctatcttgaggacgctctggatgacacagtgtctggcagctccgcctacgcgaatgggctcaaactgaacgccaaggagcttgaaacccattatccgtgcgagattcagcaggaaagactgaatacaatcggaaaataccggggccagagccaaatcattaacgagaatggcgaagtcctcgatctgtctaacgtgttcaccatcggggcttaccgcaaggagattcagagagtttttgagatccagaagaaatatcaccccgaactgacggacgagttctgtgatggatacatgctcatttttaatcggaagcgcaaatattacgaaggccctgggaacgagaagtccagaaccgactatggacggttcacaaccaaactggatgccaacggcaattacatcacagaagacaacatctttgagaaacttattgggaagtgcagcgtgtatcccgacgagctgcgcgctgccgcggcctcttacaccgctcaggaatacaatgtcctcaacgatctgaataaccttacgatcaatggaagaaagctggaggaaaacgagaagcatgaaattgtggagcggatcaaatccagcaatacaattaacatgagaaagatcatctctgactgtatgggcgagaatattgatgacttcgccggcgctcgcatcgataaatccgggaaggaaatttttcacaaattcgaggtttataacaagatgcggaaggccctcctggaaatcggaattgacatcagcaattactccagagaggagctggatgaaattggctatatcatgaccatcaacacagacaaagaggccatgatggaggcttttcaaaagtcttggattgatctcagcgacgatgtgaaacagtgcctgatcaatatgcgcaagaccaacggggcgcttttcaacaaatggcagtccttcagcctgaagattatgaatgagctcatccctgaaatgtacgcccagcccaaggagcaaatgaccctgcttacagagatgggagtcacgaaaggcacccaggaagagtttgctgggctgaagtatattcctgtggacgtggtctctgaagacatcttcaacccggttgtgcggagatccgtgcgcatcagctttaaaattctcaatgccgtcctgaagaaatacaaggccctggatacaatcgtgattgagatgccccgggacagaaactctgaagaacagaagaaacgcatcaatgatagccaaaagctcaacgagaaagaaatggagtatattgaaaagaaactggctgttacctacggaatcaaactttccccttctgacttcagctcccagaagcagctgagcctcaagctgaagctgtggaatgagcaggatggcatctgtctttactctggcaaaacaattgaccccaacgatatcattaataaccctcaactctttgaaatcgaccatattatcccccggtccatcagcttcgatgacgccagatctaataaggtgctggtctatcgctccgagaaccagaaaaaggggaatcagaccccgtactattacctgacgcacagccactccgagtggtcttttgaacagtataaagcgacagtgatgaacctcagcaagaagaaagagtacgctatttcccggaagaaaatccaaaatctgctttattctgaagatattaccaagatggacgttctgaaaggattcatcaacagaaacattaatgataccagctacgcctcccggctcgtgctgaacacaatccagaactttttcatggccaatgaggctgacaccaaggtcaaggtgattaaaggcagctacacacatcagatgcgctgcaatctgaaacttgacaagaacagagatgagtcttattcccaccatgccgtcgacgctatgctcatcgggtacagcgaactgggatatgaggcctaccacaagctgcagggcgaatttatcgatttcgagacgggggaaattctccggaaagacatgtgggatgagaatatgtctgacgaggtgtatgcggattacctgtatggcaagaagtgggccaacatcagaaatgaagttgtgaaagctgagaagaacgtcaaatactggcactacgtgatgcgcaagtccaatcggggactttgtaaccaaaccattagaggcacacgcgaatatgacgggaaacagtacaagatcaataaactggatattagaaccaaggagggaatcaaggtttttgccaaactcgctttcagcaagaaagactctgatcgggaacgcctgctggtgtatcttaacgacagacggacattcgatgacctctgcaagatctacgaggactatagcgatgccgcgaatccttttgtccagtacgagaaagaaaccggcgacattatccgcaagtattccaagaaacataacgggcccagaattgataagctgaaatacaaggacggagaggtgggcgcctgtatcgatattagccacaaatacgggttcgaaaagggctctaagaaagtgatcctggagtccctcgttccttatcggatggacgtctactataaggaagagaaccatagctactatctggtgggagtgaaacagtccgatatcaagtttgagaaaggccgcaatgtcattgacgaagaggcttacgccagaatccttgtgaacgaaaagatgattcaacccgggcagtctcgggctgatctggagaatctcggattcaagtttaaactgagcttctataagaacgacatcattgagtacgaaaaagatggcaagatctacacggagcgcctggtttccagaaccatgcccaaacagcggaattatattgaaacaaagcctatcgacaaggccaaatttgagaagcaaaaccttgtggggctcggaaaaaccaagttcatcaaaaagtacagatatgacattctgggcaataaatactcttgcagcgaagagaagtttacatccttctgttga

SEQ ID NO: 3929 - RNA, 3348 nt, synthetic construct
  misc_feature 1..3348: note = Cas9 variant
  source 1..3348: mol_type = other RNA
atgagcgccacctacacaatcggcctggacattgggatcgcttccgtgggatggtgcgccttcggcgagacgcacattctcgatctgggggtcagagcgtttgacaaggctgaaaccgccaaagagggagaatctcttaacctggcccggcgcaatgctagactcatgcggcgcagactgttccggcgcacatggagacttaagaaactggcccggcagctcaagagcgagggcctgatcgctgataccaaactgtttaagcccgaactccctttctccaagtctctgtggcaacttcgcgttgacgggctggatagacggctcaacgacgaggagtgggcccgcgtgatttatcatctgtgtaaacacagaggatttcattggatcagccgggcggaagccaagcaggctgagggcgattccaaatctgaaggcgggaaggtgaaacagggacttgccggcacagctaagctgatggacgagaaggggtaccgcagcgccgcggagatggtcctcgccgagttcccgcaggctcaaagaaataaacagggagagtatcagaaggccctgtcccgggaactgctcgctaaagagctggcccttctgtttgcccagcaaagagaatacggcaacctccacacccccggggctctggagacagcgatccttggaaatggcgataagaaaagcggcctgttctggcagcagaagcctgccctcgctgggaccgacctgctgaaaatgctcggaacgtgcacctttgagaagggcgaatatcgcgcccccaaggcctctttcacagctgagcggcatgtgtggctgaccagacttaacaatctgcgcattgttacagatggggtgacccggcagctcacggaacaagagagacagctgtgtcttcctctgccctaccgccaggccggagacctcacatataaacaactgggctccgcgctggctaaggccgggctcctggaagccggaggctttaaattcaccggccttgcttaccctacagaggcccagaaggctgaggggaaagccaaggatccggaaagcgcgaccctggtcaagatccccgcctggcacgagctccggcagaccctgacaaaaggaggcctgaacgacgaatgggagaaacttgctggggacgccctctgcggacagcctgaaatttttgataagatcgcttgggtgctgtctgtttacaaggacgatgacgaggtgagagccgagctggcgaaactcgccctgcccaatcctcaagctcttacggaagccctgctcaacattcgcttcgataagttccactccctgagcctgaaggcccttcgggccatcgtcccccatatggagcagggcctcagatatgacgaagcctgtgtgcaggctgggtaccaccattctcagctgctgaaagtgggcgagggagagcacaagtatctcccgcctctgtacgatggccgcgacggggatggacggatgatttttgcggaagacgccgatatccccagaaatcctgtcgttcttcggtccctgaaccaagctcgcaaagtggtgaatgccatcattagacggtatggcagcccctccgccgtccacatcgagatggctagagacctctctcgccccttcgacgaacggaacaagattaaaaaggatcaggacgagtaccaggccagaaatcagcgcgatagagaacaatttagcgagctgttcgggcatcctccgaagggactggagtttgaaaaatggcggctttatcgcgagcagaacggccagtgcgcgtactcccagagacccctcaccgctagcgggaacgtggccgaaatcttcctggacggctctacagagattgatcacgccctgccttactcccggagctttgacgattctaagaataacaaagttctcgtgctgacccgcgaaaatagagacaagggaaaccggacaccctatgagtaccttggcggggctgagaatagcgaatcctggcaacgcttcgtctcttttgtggagagcaacaaagcctatagactggcgaagcggacccgcctcctgagaaaagatttcggagctaaggaatccgaggaatttcgggagagaaatctgaacgacacgcgctacgtttgtcggttctttaagaattatgtggagcagcatcttaaactcgccgaaggcagcgagacaaagagatgcgtcgtggtctctgggcagctgaccaacttcctgcgcgcccggtggggactcctgaaagtgagatccgatagcgaccgccaccatgctcttgatgccgctgttgtggccgcgtgttctcactccatggtccaacggctgagcaattactccagaacccgcgaactcgaacaggtgcgggacggcttcgttgacatcgagacaggggaaatcgtgaaccctgccatgcaccagcagctgagagagcattttcccgatccgtggccttatttccggcacgaactggaggctcgccttaagattgactctcccgaactgctcagagaggagatggcccggctgggcagctactccgaagaggaactcaaagtcctgaagcctctttttgtgtctcgcgctccccaaagacggaatggaggcgccgcccataaggataccatctacgggcagcctgagaaactgaagaaaaacggaagcgtgacacagaaggttgctctcacgtccctgaccctgaaagacattgatcttctggcggacccccacagaaatgccaagctctatggcgctatccgcgaacggctggaggcccacgggggaaagggcgataaagccttcccggctacaaaccctctcagaaagcccgacaaagaggggaaccccaccggccctattgtccgcacagtgaccaaggtgatcgataaactgagcggaatcccggtccggggcgggattgccaagaatgacacgatgcttagagtggatgtttttaccaagggaggcaaattccatctggtgcccgtctacgtgcaccatcgcgttacagggctccctaaccgggcgatcattgcttttaaggacgaagatgagtggaccctgatcgacgactctttcgattggtgcttttccctgtatcccaatgaccttctgagaattaaactcaagaaagaaagccactctggatactattccagctgtaaccgctctacaggcgccgtgaatctgtgggcccatgatagaaacgtcaatgtgggcaaggacgggttcatcgagagcattggagttaaaatggctgtgtccatcgaaaagctccacgtcgataccctgggcaacatctaccctgctccccctgagaagcggcgcgggcttgcgtga

SEQ ID NO: 3930 - RNA, 3351 nt, synthetic construct
  misc_feature 1..3351: note = Cas9 variant
  source 1..3351: mol_type = other RNA
atgagccagaaccagaatcccaacacccagtcccacctgaatcctacaacgcagtctagcacccagtccaacccgcaacccacaacccaggagtctctcaagatcctgggcttcgacattggggtggccagcatcggatgggcttttgtcgaaggcggggagcttaaagattgcggagttagaattttcacaaaggccgaaaatcctaaagacggctcctctctggcgctcccccggcgcgaggctagaggggtgcggcgcagactggcccggcgcaagggaagacttaacgccctgaaagtgctcatctgtaaggaatttggcctgaatcggagcgattacctggctaccgccggcgagctccctaaggcttatgccacatccaaagagaccaagagcccctaccagctgcgcgcggaatctcttgagagaaaactgtccgccgacgagttcgctcgggtcattctccatatcgccaagcaccgcgggtatggaaacaaacatgctaaggaaagctctgatgacgattccggcaaggtgaaaaaggccatcagcgagaatcagaaagttatgtctgaaaaggggtacacgaccgcgggacaatatctgtacggcgagttttatcagaaagccagaaacttctccgaagctgagcctaagagcccgaaaaatgcccgggggacacaggaatttaagaacgtgcgcaataagtccgagaactacgctagatgccttgcccagtctgagctgcaaaaagaactcgagattatcttcgccaagcagcgggaatttggattccagtttagcgacaaaaagcacaaaaccattaatgctaacggcaagctgaaggagctggatttcgcggacgccgtcctcgaaatcgcttttctgcaaagaccccttaaatccttcgccgataaggtgggcaaatgtacattctacgaggacaagcctcgcgcccccaaagatagcctgtctgctattgagtttgttgccctcacccggatcattaacacgctggcgaatatcacaaagagatccggggaagtgtatagcgctgacaaggtccgcgagatcctttctattgtgctggacaaaggagaaatcacctacaagaacctccggaaagtgattgccctggatgagagactgcagttccctaaggacagcaaactcgattatgccaaggaagacgctgagaaggccaaagctatcgagttttccaagctgaaagccttccgcaaggcgcttggcgggtcttttgaaggattcattcgggccgagctggatagcatcgctacagacatcgccctcattaaatccaaggatgaactgaaagctaaacttgccaattaccagagcctgaacgacgagcagagagagaagctctctgaactgtcctttgataagttcatcgacctgagctttaaggcgctcgaggccattctgccccttatgcgcggcgataaagacgacaagatctatcggtacgatgaggcttggagagaagccgggctggtcgaagttgctaaaaagacccaaaagggagactctctcccgcctctgattgagtatgagaaagatctggccaatcccgtggtggcccgcgctcttgcggaataccggaaggtcctcaacgccctgctgaaaaagcatggcaaagtgcacaagatccacctcgagttcaccagacaggctggcgtttccagcaaggaacggggagagatcattgccgaacagaataaacgcctgaaggccaacgaggaggctagaaaacggtgcgaagagtacggacttatcccttccggcaagaatattctgaaactcaagctgtggcaggaacaaggggagttttgtgtgtattctggaaagaaaatcacacagagcgacctgagagatgaatccacgcttcagattgaccatatctacccctattctcgcagctacgatgactcccagaacaataaggtcctcgtgttcaccgatgccaaccaaaataaactgaaccagacaccctatgaggcgtttggcaaggacattagcaaatggaatcagatcctggggcggatcgagaagctccctaaagctaagaagaacagaattaccaacaaaaatttcgccaacaaggaagccggcttcatcgctcgcaatattgttgatacatcttacatcgccagactgtccgcgagctataccgacgcttttattgagttctgcccgcttgccgaaaacgaggatacgacactgggacggggcgagaaagggtctaagaaacacatctccgtggtcaatggaagcctcaccgccaccatgcgccattactggggcctgaacacactgcttgacggggaaaattctgagagcaaggacagatccaaccacctccaccatgctctggatgccatcattatcgcttacgtgaatgacagcgtcattaaggccttttctgatttcaaaaagacccaggaacaaaacaaagcgcggctgatcgccaaggagattgaatccgctgagtataaaatcagccgcagatttttctccccctctggatttgagaataacgaagccttccggcaggctatcaagcgcaagattctcggccagagcctggagtccagagaaaatgacatgacaatcaactctgaggcccttggggaaaaagtgggcggaatttttgttagcaagcctccccggaaacgcgccagaggcgctctgcacaaggagacgttctcctctatcgatgacaaagatctcctgaagacctacgggggaaaggagggcgtgaatcgggcgattaaactggggaaggtcagacaaatcggaagcaaaatcgccgacaacggcacaatggtgcgcgttgatatttttcggcataaggtgtccgggaaattctatggcgtccctatctacaccatggactttgctcttgggattctccccaacaaggccgtggtgggcgggaaggataaaagcggagttatcaaggactggctgccgatggattctaattatgagttctgtttctccctgtttaaagacgacctcattctggtccagaagaaagaaatgagcaaggccgaactttgctacttcgctggctttgatacatctgggggacagatcaaagtggagaagcacgacaaccatttcgccaccctgacggataatcagagactcctgtttaacattgcgacccctaaggaagtggctggcaaatccatcgggatccaaaatctgaaggtcttcgagaaatggcaagtgagcccccttggcgaggtttctaaggccgaatttaaagagcgcgaacctattgccctgaagtccacacccaagcggttcctccagggatga

SEQ ID NO: 3931 - RNA, 3354 nt, synthetic construct
  misc_feature 1..3354: note = Cas9 variant
  source 1..3354: mol_type = other RNA
atgaagcacatcctgggcctcgacctggggagcaactccattggatgggccttcgtgcagcaagattttgagaataaacagggcaagatcattgctaccgggtctagaatcattcccatggaccagggaatccttggcgatttcgaacgggggaacacagtcagccagacggccgagcgcaccacatacagatccatgcggcgcctgagagaacggcatctcctgcgcagagagcggcttcaccgcgttctgcatctcctgggatttctgcctccgcactatgacgcgcaaatcgatttcaccaaaagatacggcaagtttattgacaatgctgaacccaaaatcgcctataacaatggcaacttcatttttatgaatagcttcaacgagatggtggaggattttaagaagcatcagcctcaactcttctacaaaaagagcaatggggaagagtcccggatcccctatgactggacaatttactatctgcgcaaaaaggccctttctcagaaaatcacccagcaggaactggcttggctcattctgcactttaaccagaagagaggatactaccagcttcggggcgaggaggaaacagagaatcctaacaaggaagtggccttccacagcctgaaagtcgtggatgttgaggctgaagcccccaataagaaaggggagatctggtataccatccgcctcgagaacggatggatttacagacggacgtccaagaatcctctggacgattggaaaggcaagaccagagactttatcgtgacaaccgatctgaacgacgacgggacaattaaactcgataaggaaggaaaggagaaacgcagcttccgggcgccggacgaaaacgattggaatctgcttaagaaaaagaccgagcatgacatcgatttctctggcaaacccgtcggcacgtatatttacgaccatctgctccaaaaccctaatcagaagatcaaggggaaactggtgagaacaatcgaacgcaagtattacaaagatgagcttaaggccattctggctaaacagatcgccctccaacccgagctgtttaccgaaacactgctcgctgactgcattcgggagctgtatagaaagaacgaaacccagcagcagaatcttctgtccaaggatttcctccacctgtttgttgaggacatcattttctaccaacgccctctttgtagcaaaaagtctaccatcgccaactgcacactggaaaaacggtcctacatcgataaggagacgaatgagagaaaagacgcgcccattaaggtgtgtgccaagagcaacccgtattaccaggaatttcgcgtcctccagtggctgcagaatctgcggatctatgagattgaaaccgacagagaggtgacagctgagttcatcgaaacccctcaagattacgaggccctctttaacttcctgatgtctcagaaagaaattgacaatgagggacttctgaagtattttctcttcgctaaaaacccccagatcaaggataaagccgccaagtccgaactgaaaaagtggctgacaacctaccgctggaattatgtgtacgacgctgcggataacagctccaagaaataccctatgaatgagacgggctatgagcttcagcggtacctccaaaaggtcgaagggctgcccgccaactttctgacattcgacattacctatcagctctggcatctgctttactctgttaaagataaggtggagtttgaaaaagctctgaagaagttcgccaaaaagaaacagctcgacaagaccagcttcgtggattcctttaaaaacttcaagccctatcctaatgagtacggatctttttctgaaaaggccatcaaaaagctgctgccgcttatgagattcggcaaccactgggactttaatcggatcgatgtctccacacagaaacgcattgacgatctcatcaacggggtggctaatgaggacattagaaccatcattcgggagaaggccgaaaaatatcaactgaacagcgagacatgcttccaggacctgcccctctggctggcgcagtacgttgtgtacaatagacacgctgaagccacggatatcgagaagtggacctctgtcagcgaccttgaagcctatctggaggattttaagcaacactccctccgcaaccctatcgtggagcaggttgtgacagaaaccctgcgggtcgtgagagacatttggcagcagtactctggaggccaagctaatttctttgatgagatccatattgaactgggccgcgagcttaaaaagacagccgaggaaagaaaacagctcagcgacaagaaccaggagaatgaaaacaccaatctgcggatcaaaaagctgctcgctgagctgaaagaagatgcctccattcagaacgtccgcccctatagccttgtgcaacaggagctgctcaagatctacgaggaaggggttttctcttccacggacgagatcgaagaggatattcagaagatcagaaagaaggtggaacctacacccccggagattcagcggtataaactgtggctggagcaaaagtacaaaagcccttataccggagaagtcatctctcttaccaagctctttacagaggaatacgagattgaacacatcatcccccagtcccgctactatgacgatagcctgtccaataaggtgatttgtgagtctgcggttaacaaactgaagaccaaccagctcggcctggagttcatccaaaatcatcacggggaaaaagtgagaattacggccaacaaggaggtcacaatctttaccgaggaacagtacaaagagttcgtgaagaagcactatgctaataacagcgccaaacagcagaaacttctgctcaatgaaattcctgagaaaatggtggctcggcaactgaacgacacacgctacatctccaagtgcatttctgaaatcctgagcaaaatcgttagatccgatgagaaggacgaaggagtcaatagcaagaacattatcccctgtaccggcaaaattaccacagcccttaagcaggactgggggctgaatgatgtgtggaacgagctcatcctgcctcggttcgagcgcatgaatcagctcacgcagacccaactgtttacatcttataacgacagacttcagaaaaatctgcccaccgtgccgattgaatactcccagggcttccagaagaaacggatcgatcatagacaccatgcgatggacgccctcgtcatcgcttgcgccacacgcgagcacattaactatatgaataaccaacacgctctggataagagcaaggacaaaaaggaaaaacagcagtctcggatcgatctgcatcctctttga

SEQ ID NO: 3932 - RNA, 3354 nt, synthetic construct
  misc_feature 1..3354: note = Cas9 variant
  source 1..3354: mol_type = other RNA
atgcagaccaagaacctgctctacacactgggccttgacatcgggattgccagcgtgggatggtgcgtcctgggcgagaatagaatcattgatctcggggttcggtgtttcgacaaagctgaaacgcccgatcgcggagagtccctgaacaaggtgagacgggacgcccgccttatgagacggcgcctgagacggcgcgcgtggagactcaccaaactggctcggctgctcaagcacgccggcctgatcgattctacacgcattgtgagagaccggcatgatggggccgtcagcccttggcaacttcgcgtggaaggactggacagaaaactcgctccggaggaatgggcccgggttatctatcacatcgtgaagcatagaggctttcactggatttcccgcgctgaggagcggaaggccgaatctgataaaggcgaagggggaaaggtcaaacagggcctgagcgcgaccaagcagcttatggtggaaaagaattacagatccgccgctgagatggttctgacagagttccccggggcccagcgcaacaagcggggagaatataccaaggctctctctagaatcctgctggccgcggagctcacaaccctgtttgaacgccaacaggagcttggcaatcctcatgccgggcccgacctgcagacgaaaattctcggaaacggcgatagaaagagcggcctgctttggatgcagaaacctcccctgtccgggagcgctctcctgaagatgctgggaaaatgcaccttcgaacgggaggagtaccgcgcccctaaggcttcttttacagccgaacggcacgtgtggctcaccaaactgaataaccttagagtcctggtggacggcgtgacacgcccgctctccgatcccgagcggagactggcccttagcctgccttatcaacaggcttctgacttcacctacaagcagctccgggcggccctgtgtaagaatgggctgctccccgactcctttcagttcagcggactggcttatcctacgggcgcccaacagcccgatgggaaagccaagaacccggaaaatgaccgccttgtcaaactgcctgcttggcaggagtttagaaagacactccgggatgccggactggaaaccgagtgggagtctatcgcgggcatggctgccggcgggcaacccgacctgcttgatcagattggatgggttctctccgtgttcaaagacggcgatgaagtgctgagagagctgcgcaagatccctctccccgggggagaaaagatggtccaggccctgagcggcgtgtcctttgacacattccacaacctttctctgaaagctctccggaagattgttccccatatggaggccgggctgagatacgatgaggcttgcctggccgcgggctaccaccatagcgaccttcgcaaagataccgacgagagatccctctatctgcctccgctgtacagcggacggaccacagacggccgcatggtgtttagagatgacatcgatgtcccccggaatcctgtggttctccgcgccatcaaccaggctagaacggtggtcaattctgtggtccggcgctatgggtcccccagctctatgcacattgagatggccagagacctgagccggccttgggatgaacgcaacaaggtgaaaagagctcaagaggaataccgggacagaaacgagaaacttaagatcgatttcgccgcggagtatggaattgaacccaaatcccgcgagttcgaaaagtttctgctctaccgggagcagggcgggaaatgtgcctattctctgaagccgctggaccttgatagagttctccgcgacctgggatacgctgaagtggatcacgccctgccttacagccggtccttcgacgatagcaaaaataacaaggtcctcgtgctggctgaggagaatagaaacaagggcaatcgcaccccctatgaataccttgacgggacatctgagtcccctcggtggagagaatttaaagccttcgttgagaccaacaaggcctatcgcctggctaaacgggcgagactcctgcggaaggactttagcggcaaaggatctgaagagttccgcgatagaaatctgaacgacacacggtacatctcccgctttttcaagaattatgtggagagatttcttaaactcgccgaagagagcgaggaacggacctgcgtcgtgctgtccggccagctgacggctttcctcagagcccgctgggggctggccaaggtgcggggagattctgacagacatcacgctcttgatgccgcggttattgctgcctgtagccgctccatggtcaagcggctgtctgactacgccagacgccatgaactcgagaaagtgcggacaggctttgtggatttcgagaccggggaaatcgtcgacgctggaaagtatagacagatcgagcgcgattttcccagcccttggccctacttcagagacgaactgctgacccggcttaacacagatgacccggccgagctgcgcgagagaatgcaatccctcggcagctaccctcccgaagcgctggagaccctccggcccatgttcgtgtctcgcgctcctcagagacggaatgggggcgccgcccacaaagatacaatttatagacagacggaacgcctgaagaaagttggatccgtgacccagaaggtcccgcttgctgccctgaacctccgggacctggagaatctggtggacccccatagaaacgaaaaactttacgctgccatccgcgcgcggctggaggcccacggcgggaagggagagaaggcttttcctcccaataaccctctcagaaaacccgatcgggacggcaaccctacagggcccattgttcgcaccgtgacactggtcatcgataagatgagcggcattccggtgagaggaggggttgccaaaaatgacaccatgctccgggtggatatcttccgctctaagaaggacggcaaatttcacctggtccctctttatgtgcatcacgctgtggccaagcaactgcccacgagagccgtcatcgcttacaaagatgaaggagagtggacccctattaacaatcatgacttcgattttctcttcgcgctgtatcccaacgacctggttcggatcacacttaagaaagaacgccactttggctactatgccgggtgcaatagagctaccggagccgtgtccatttgggcccacgatcggaaccagcgcatcggcaaggacgggttcattgacggaatcggcgtgaagacagctctgagcgtcgagaaatttcatgtggataccctcggcaatgtttacccggcccctcccgaaacgagacgggggctggcgtga

SEQ ID NO: 3933 - RNA, 3357 nt, synthetic construct
  misc_feature 1..3357: note = Cas9 variant
  source 1..3357: mol_type = other RNA
atgggcaccagatacagcttcgacatcgggacaaactccattggatgggccgtgtggcggacgggccgcgatcccaaggggatctttggagagaaagacgctcctctggaactcctgggcgccggggtcagacttttcaaggatggacggaatccgaaagacggccagtctctggcgaccatgcgccggattcccagacaagctcgcaagagacgggatcgctttgttctcagacgggaggccctggtggccgctcttatcgaagccggcctgatgcctgctagcgagaaagaacgcaaggccctcgcggacctggatccctatcagctgagagccgctgggctcgacaaggccctggctcctcacgagcttggacgggccattttccatctgcaccagcgcagaggctttaaatccaaccggaagacagatagaaaatctgacgatcgcgacaaggggaaaatcgcgaccgccagcgctgccctcgctaagaagttcgaggatgaaaatgcccggacatttggagagttcctgtggagacgccatcgggaccccgacatgaaaagacaggccgtgcttaaggctcacgatcctgcgaaaggcaagccggacctgcgcgccgctaaactccggcaacccaccagaatccgcctggaagggcagggagccacagccctgtacgagttttatcctacccgggagatgctctgccatgagttcgatgctctgtgggaagcccaggcgagacaccaccccatgcttctgacgcgcgaagctggcgacaagattcggtccatcctctttagacagcgggagctgaaacctccccttattggcctgtgtaccttcgaatacgccgccggggagaaggagtctcgcctcccgaaggctctgcctagcgtccaagccagagaaatctatgagcggctgggacatattagactctccacaggcagcgggaccgatcgccccctgaaatcttccgaacgggacgatcttgctacagccctgctccactgcggactgaccaagatcaaagtgagcaagacgaaaggccttgcgtttaagacagagttcagaaaggccctgcgcctcgggggagaagttagaattaacttcgaggagatgggcgaagagggcctggtggacctgcggaccaatcgcctcctggtccaggatgaccattacgggcctagatggcgggctctttcttggtccggaaaagatgcctttgtgaagaaactgctcgaagctacagacgacgataagctggttgcccgcctgatgaccgaggacggccttagcgcggtgcaggccagaaacgctgcctctatccccctccccgatgggtattcccggctgggacctaccgctaatgccgccatcctgcaggctctcattgacagccgcgatgaaaacggcttcgtcgtgacatacgacaaagcggtgagacgggccggggagcgcctgggcaaggattggcaccactccgacgagagagatggagaaatccttgacgctctgccgtactatggcaaggtcctccaacggcatattctgcccgggatgatggatcctgccgacagaaaagatgaggccaagttttacggacgcatcatgaatccctctgttcacattggcctgaaccagcttcggagactcgtgaatgctctgatcgaacgcttcgggcctcccgaccagatcgtggtcgagctggcccgggacctcaaaatgagcgcgagagagaaggaacaagagcagcgccggaacagagataatcgcgaagctaacgagaaacggacgaagaagctggtggaacttggacaggacaataacggcgagaacagagcccggctgaaactctatgatgagcagcaacgcgccgggaatggcgttgctcattgtccgtttaccctggaccctattggaatcacacagctgttctcccccgaaattgagatcgaacacgtgcttcctagaagccggaccctcgatgactctgccgcgaacaaggtcctgtgctttcgcacaattaatagaatcaaacggggcaagaccccctgggaggctttccatgccgatcctaaatggcccgacatcgccgctaacgccgaaaagctgccgcctaataaaagatggcgctttcgggaggatgctatggacgtgttcgaggccagaacgtccgggaagatggataagacaaccctcgaacagatgggactgaccacaggctttcaggcgcgccaccttaacgagaccaaacacatgagccggctggccaaggcttacctcgggaaaatttgtgaccccgatgccgtttatgtgacacccggagctctgacgtctctgcttagaggcaagtgggggctcaatagcatcctgtccgacgacaacctgaaagatcgcaccgaccatcggcaccatgccattgatgccatcacaattggcgctatgaccagatctctcctgcttgaactgaatacactcgcgggaaaggccgagcaaagcgactacgatgacgtcgtgggcaaggtcccttggccgttcgataactttcgcgacgctgtgagatccgttgtggatcgggtcgtggttagcaataaacccgaacacgggaagcagggagccctgcacgaggacaccgcctatggcatcgtgggggatgaggctgaagccgaggaaattggaaacctggtccgcagaaaacttctggtggacctcacgcctggcgaggtggaccggatccgcgatgcggggctgagaaaggctatgcaggccgccgttgctccctctcgggacgccagaggcaaagtctccgatgcgaagggattcgctgccgccctcgacaccttcgctaaggcccagggcatgcgccggatcagagtggggaaagaggatatgagcgctgtgacaattcatgaccgccaaaccgataaggcctacaaagcggtcgcccctggagaaaatcaccatgtggacgttgtgcagatgcgggatggcgcttggaaggggtttgccgtcacagtgttcgaggctaaccagaaagactttagaccccagtgggaacgggagaagctgggaggcaaacttgttatgcgcctgcacaagggcgatgccgtggaactcgagtcttccggggtcagactggtgaagttcgttcaacagatctggatgaaaagcaatctggtgcttctgaccgagcataacgaaggaggcgacctccagaagcggcaccaagatgccgacgacccttttcgctgggatttcgctaacattgggaaactgaaggagagaggatgcgtcgcggtgaaagtggacgaactcggccgggtcacgaagcgcatctccaatacatga

SEQ ID NO: 3934 - RNA, 3360 nt, synthetic construct
  misc_feature 1..3360: note = Cas9 variant
  source 1..3360: mol_type = other RNA
atgggctacagaatcgggctggacgtgggaattaccagcacaggctatgccgtcctcaagacggataaaaacgggctgccctacaagatccttaccctggactccgttatttatcctcgggctgagaatccgcagacaggagcctctctcgcggaaccccgcagaatcaaacggggcctgcgcagacggacccgcagaacaaagttccggaaacaacgcacccagcagctttttattcacagcgggctgctctccaagcctgagatcgaacagatcctggctacaccccaagccaagtactctgtgtatgagctgagagtggccggactcgatcggcgcctgaccaacagcgaacttttcagagtcctgtactttttcattggccatcggggctttaaatccaatcgcaaggctgagctcaaccctgagaatgaagccgacaaaaagcagatggggcagctgcttaactctatcgaggaaattagaaaagctatcgccgagaagggatatcggacggtgggcgagctgtacctcaaggatcccaaatacaatgaccacaagagaaacaaagggtatattgatggatacctgagcacccctaatcgccagatgctggttgacgaaatcaagcaaattctcgataaacagcgggagctgggcaacgaaaaacttacagacgagttctatgcgacctacctgctcggggatgaaaatagagccggaatctttcaggctcagcgcgacttcgatgagggcccgggcgccgggccctatgctggagaccaaatcaaaaagatggtgggcaaggacatttttgagcctacagaagatcgggccgcgaaagccacctacacgttccagtattttaacctgcttcagaagatgacatccctgaattaccaaaacaccacaggggacacctggcataccctcaatggactggatagacaggctatcattgacgccgtcttcgctaaagccgagaagcccacaaaaacgtacaagcctaccgattttggcgaactgcgcaagctcctgaaacttcccgacgatgcccggttcaacctggtgaactatgggagcctccagacacagaaggagatcgaaaccgttgagaaaaagacaagattcgtggactttaaggcttaccacgatctggtcaaggtgcttccggaggaaatgtggcaatctcgccagctgctcgaccatattggaaccgcgctgacgctgtattccagcgataagcggagacgccggtacttcgccgaggaactcaatctgcctgctgagcttatcgaaaaactgctccccctgaacttttctaagttcggccacctgtccatcaaaagcatgcagaatattatcccttatcttgagatgggccaggtgtactctgaggccacaaccaacaccgggtatgactttagaaagaaacaaatttccaaggacacaatccgggaagagattaccaatcccgtcgttcgcagagccgtgacaaagacgatcaaaatcgtggaacagattatccggagatacggaaagcccgatggcattaacatcgagctcgctcgcgagctggggcggaatttcaaagaaagaggagacattcagaagcgccaggataaaaacagacaaaccaatgacaagatcgccgcggagctgacagaactcggcattcctgtcaacgggcagaatatcatccggtacaaactgcacaaggagcagaacggcgtggatccgtataccggagaccagattccctttgaacgcgctttcagcgagggctacgaggttgatcatatcattccttattccatctcttgggacgatagctacacaaataaggtgcttacctccgccaaatgcaacagagaaaaggggaatcggattcccatggtctatctggccaacaacgagcaacgcctcaatgctctgacgaacatcgccgacaatatcattagaaacagccggaaacgccagaagctgcttaaacagaagctctctgatgaggagctgaaggactggaaacaaagaaatatcaacgatacccggtttattacacgcgtgctgtacaattatttcagacaggctatcgaatttaaccctgagctcgagaagaaacagcgggttctgccccttaatggagaagtgacctccaagattagaagccgctggggcttcctgaaagtccgggaggacggggacctccaccatgccatcgatgcgacagtgatcgccgctattaccccgaagtttatccagcaagtcacgaagtactctcagcaccaggaagtgaaaaacaatcaggccctgtggcacgacgctgagattaaggatgccgaatacgcggccgaggctcaaagaatggacgccgatctgttcaacaaaatcttcaatggatttcctcttccctggcctgagttcctcgacgaactgctggctcgcattagcgataaccccgttgagatgatgaagtcccggtcttggaatacatatacccctatcgaaatcgccaaactcaagcccgtgtttgtcgtgagactggccaaccataagattagcggcccggctcaccttgacacaatccgctccgcgaaactgttcgatgagaaggggattgttctcagccgggtgtctatcaccaaactgaagattaacaaaaagggccaggtcgccaccggagacggcatctacgatcctgaaaattccaacaatggggacaaagtggtgtatagcgctattagacaggccctggaagcccataacggatctggcgagcttgcttttcccgatgggtacctcgaatatgttgaccacggaacaaagaagctggtccgcaaagtgcgggtggccaagaaagtctccctgcccgtgagactcaagaataaagcggctgccgacaacggcagcatggttcggatcgatgtgttcaatacggggaagaagtttgtcttcgtgcctatctacattaaagacaccgttgaacaggtgctgccgaacaaggccatcgctcgcggcaaatccctttggtatcaaattacagagtctgatcagttttgtttcagcctgtaccccggagacatggtccatatcgagtccaagaccggcattaaacctaagtactctaataaggagaacaatacaagcgtggttcccatcaaaaacttttatgggtacttcgatggagccgacatcgcgaccgcttccattctcgtgagagcccacgatagctcttatacggcccggtccatcggcattgctgggctgctgaagtttgaaaaataccaggtcgactatttcggacgctaccacaaggtgcatgagaaaaagagacaacttttcgtgaagcgggatgaatga

SEQ ID NO: 3935 - RNA, 3360 nt, synthetic construct
  misc_feature 1..3360: note = Cas9 variant
  source 1..3360: mol_type = other RNA
atgaacgacaagaaaaatctgggccccctcaccttcgggtttgatatcggaattgccagcgtgggctgggctgtcctgtcccctacaagaatcgttgaccttggggtgcggtgcttcgataaggccgagacggcgaaagaaggagagtctctgaacctcgctcgcagaagcgcccggctgatgcgcagacggcttcgcagacgggcctggcgcctgattaagctcgctagactgctgaaacacgaaggcctcatcgccgacaccaagacatttattcagccgtccgcttctcatgccagcccctggcaactgcggaaggatgggcttgaccgcgcgctgtcccctgaggaatgggccagagtgctctaccacctgtgtaaacatcggggattccactgggtctctcgcgctgaggccagaaaggctgatggcgacaccaaaggcgaagggggaaaggtgaaacagggccttgccagcacaaccaagctgatgaatgataagtcctatcggacagcggccgaaatggttctcgctgagtttcccagcgcccagagaaacaaacgcggggaatacaccaaggctctgtctcgggagctgctcgacaatgagctgaaacagcttttcgaaagacaacgcgagtatggaaaccctcatgccgatacgaatctggaagccaagatccggggctccggggaccacaaaagcggactcttttgggagcagaagcccgctctgtctggcaacgatcttctgaaaatgctcggcaagtgcaccttcgaaaagcaggagtacagagcgcctaaagcctcctttacagctgagcgccacgtgtggctgacccggctgaataacctcagaatcattgtcgacgggcgcacacggccgctggccgacgccgaaagaaccatggctcttagcctgccctatgaacaggtgggagatttcacgtacaagcaactccgcgccgcgctggttaaagctggccttatgcctgactcttttaagttcgcctccctggcctatcccagcgagtttcagaaagctgaggggaaggccaaggatcctgaatccgctgccctcacaaaactggcggcctggcaggagctgcgggctaccctcaagaaagccgacctggagtctgaatggcagcaaatcagctgtgctgcccttgagggacagcccgaaacactggatgagattgcgggcgtgctctccgtcttcaaggacgatgacgaagtgctgaatgagctgcagaaacttgggctcccgggaggcgccaagaccgagaacgctctgctggatatcagattcgacaagtttcatgccctcagcctgaaagcccttcggaagattgtgccttacatggaacgcggcctgagatacgatgaggcttgcgaacgggccgagtatcaccattctcaactccacaaagtcggggagggaaatagaaagtacctgccccctctgtataaatcccgcgacaaggacggccggatggttttcaacgatgaacttggggacatccccagaaatcccgtggtgctccgcagcctgaaccaggctagaaaggtcctgaacgcgctcattgcccggtacggatctcctagctccgtgcacatcgagatggctcgcgaactgtctaaaccgtttgatgagagaatgaaggttggcaaagaacaggaggcctatcgggagcgcaatgaaaaggacaaacagaccttcgtggccgagtttgggatcgtcggcgctgccaagggaggcgagttcgagaaatggaaactttacagagaacaacaggggaagtgtgcgtatagcattcagggaatcgatctgaaccggctcctggagcccggctacgtggagattgaccatgctctgccttactcccgcagctttgatgactctaagtccaataaggttcttgtgctcgccgccgaaaacagaaataaagggaaccggacaccctatgagtacctggatggagaacacaatagcgagcgctggagacagttcgtcggctttgtggaatctaacaagctgtatcggcaagctaaaagatcccgcctcctgcggaaggacttcgggaaggagcaggccgatgagtttagagaacgcaatcttaacgacacgcggtacgtctgcagattctttaaaaatcaggtggagcagttcctgaagctcgcggaaggcagcgagtccaaacgctgtgttgtgctgtctggacaactgaccgctttccttcgggccagatggggcctcatcaaggtccgcgatgagagcgaccggcatcacgccctggacgctgtggttgtggccgcttgcacacatgggatggtcaaaagaatgtccgattatgcccggcgcaaggaactggaccaggtggcggagggatttgtggatgttgaaaccggcgagattatcaacgccgctatgttccagcagctccacgaacactttcctgacccctggccgcatttcagagatgaggtccaaatgcggctgaagatcgacgatcctgcccagcttcgctctgacctgctcagactggggaattacgctgaggaagatgtgcacgccgtgcggcccctgtttgtcagcagagcccctcagcgccggaactccggagctgcgcataaagagacaatttatggccaacccgaaagacttaaggcccaagggggcgtgaccgagaaagttgctctgacggccctcacaatgaaggacctggatcgcctcatcgaccctcaccggaatgaaaaactgtacgccgctattagaaagcgccttgaggagttcggaggcaaggccgataaagcgtttgctgccagcaaccccctgcacaagccggacaaagaagggaaccctaccggacccatcgtgcggaccgtcacactcgagattgacaagctgtctggcgtgcccgttagagggggaatcgccaaaaatgataccatgctgcgcgtggacgtcttcacaaaggctggcaaatttcatcttgtgcctgtttacgtgcaccataaggtcacggggctgccgaacagagccatcgtggcgtccaaggatgaagacgagtggaccgctattgatgacagcttcgaatttctcttctctctgtatcccaatgatctcgtgacaatcacccagaaaggcaaggcccctgtccggggatactatgcctcctgtcaccgcggcacaggggcttttagcctgtgggcccatgacagagcttctagcgttggaaaaggcgggcagattgagggaatcggcattaagaccgcccttgcggtgcagaaatacaacgtggatgtcctgggcacgacctatgccgctcccctcgagcagcggcgcgggctggcctga

SEQ ID NO: 3936 - RNA, 3363 nt, synthetic construct
  misc_feature 1..3363: note = Cas9 variant
  source 1..3363: mol_type = other RNA
atgagaaaggtgaccatcggcttcgacattggggtcagctccgttggatggtctgtggtggatatgaacaatggcgccatcgtcgagacaggggtgcggctgtttagcgcttcctctgccgaaaacaatgttgagcgcagaaacaatcggcagacgcgcagactcaaccggcgcagaaagaatcggctgaaggacgtgaaataccttctggaaaccaaccacttcacatttgatcaagagcagggaaccaatccctatgaactccgcgtcgcgggcctgcatagaaagctcacacggagcgagctggctcgcgccctctaccacctggtgaaaagacgggggatttcctatgacctgaccgatatcgaggaagaggaaattgttacaacctctgcctacaagacggctctcggaaagaaccagagccagctggccgagaaaacccctggcgagatccaattcgctcgccttgaaaattatggcaaggtgagagggtccatcgagattaacgaacaggacatcctgctcaatatttttccgacaagcgcctacctgaacgaggcgaaacggatccttgccacccagagaaagttctatcccgaaattacagaggcttttatcgagaaatactgcaccattctgacgcgcaagcgggaatactatgtcggacctggcacagagaagaatagaaccgattacgggatctatcgcacaaacggagaaaccctcgacaacctgttcgagatcctgattggcaaagataagttttaccccaatgaagaacgggccgctgggaactcttataccgcccagcttttcaattttgtgaacgacctgaataaccttaaaatccaaacaattgaggatcagaagctgacgcctaaacagaaggaagagatcattgaacaggtgaaaaccgcggagaagaaggtctccctcatccaactgatcagcaaaattacaaagacccccaaagaccagatcacaggatacagaaccgataagaatggcaaacctgaccttcattctatggccgttttccgcaaggtgcggaagcagtttctgacgatggaaattgacatcctccactggccggatgagctgctgaacgacctcggcagactgcttacactgaataccgagaaaggggaaattcgcaagcaactcaccaaagatttcatgaagcggtatcccatcctgaacgagcagcttgtggaccagatcattgaaaatagacatatcttcgctgtctccggaaaccacaaatggcaccgctttagcctgcggacaatgaatgagctcctgcctgagatgctggccacctctaaggaacagatgacactcctgtccgagagaggcatgattaagcaacataaacgggattaccttaagatgaacgaactggacgctcgcctcatcagcgaggaaatttacaatcccgtggttgggaaatccgtgagagaggccatcaagctgttcaacgagctgatgaaaaagtatcaggaagtccggtacgtggttcttgagatgcctagagatgacaacgaagagaaggccaaaaaggaactccagaaatatcagaaggagaatgagaacgaaaaagagattgctctgtctgaatttcaacgcaagggattctttagcgatgcgcagctggagcgggccctcatcaaagacagaaagctgaagacgaaaatccgcttctggcaccagcaggaaggcaagtgtctttactccgggcaaattatcacccccgtggagctgctcacaaatagcttttctttcgatattgaccatatcattccgcagtccgtcagctttgacgattctctgaacaataaagtgctgtgcaccaaggagatgaacgaccagaaaggaaagcagacaccttatggcttccttctcaatggcaacgggcaaggatttgatagattcaaggctatggtcaatgccaaccggctgatgagcaaaggcaagaaaaagaatctgctctttatggaagacctgaacaatatcgagacccgcaaaagattcatcgcccggaaccttgtggatacgcgctacgcttccagagttgtgctgaatgaaattcagcagtatctccgggccaagaacaaggacacccaagtcgcggtggttcgcgggaaattcacagctaccctgagaaagcactggaacatcaataaatctcgggagacacaccatcaccatgccctggatgccagcattatcgctattacgccccttctctccgtgtggaagaaaaagcagaccctgatccctaagacactgagcgaggaaaaactcgagtttgaatacgacgatatcgtcgaggacaccattttcgaaaaggccctgtaccagcttcccaaagagaactttaaggagcagctgaataactctcaacccaatatcaaattctcctatcaggtggataagaaaatgaaccgcaaggtgagcgacgctacaatttactctgttaagcaggccaaactctccagcgataagcagtccgaagagtatgtcctggcgaaaatcaaggacatttactctgtggaaggatataaaacctttgccaagatctacgagaaggacaaaagcaagttcctgatggctcaaaatgatcctaaaacctttgaaaaacttgaggagatcattcagtcctatccgtctacaagagaaatcattgtgggcgagaaagtcaaggtggttgacgtgagccccttcgaactctaccggaaggagtacgggtatatcacgaaatacgccaagaaaaacaatggccctattatcagacagctgaagtattacgatcacaaaattggaatgcatctggacatcaccaaccagaagaataacggcaaggggaaaaaggtcatcctccaacagctgaaatcctggcgcacagatgtgtattacaatcacgaaaagcaggagtatgagattatgggacttaaatacagcgacctgcggtttaagaaggatcaatacggcatccccaaagaaagatatcaggaggttaagcagatggagaaaattgctcctcagtctgagttctgtttttccctctaccgcaacgaccggatcaaggtgctgaataaagagaccgatgaagaggtcgaactgcttttcggggccagaaactatacaagcgcgggatacgtggacctgaagcccattgatcgcgttgagtttggcaaaaaggaatggatcccggtgtatcaatacgccacctctgacgggaagtgcaaaaagaaattcgctaagaaaggctatgagatctacaaggtcaacacgacaattctcggagagtcctactatatcaagaaagaacggatgctgcctaagaatattctcgattga

SEQ ID NO: 3937 - RNA, 3363 nt, synthetic construct
  misc_feature 1..3363: note = Cas9 variant
  source 1..3363: mol_type = other RNA
atgagcgacctggtgctcggcctggatatcgggattggatccgtcggcgttgggatccttaacaaggtgaccggagagattatccacaaaaattctagaattttccccgccgctcaggccgaaaacaatctggtgcggcgcacaaacagacaaggccggcgcctcacgagacggaagaaacatcgcagagtccggctgaatcgcctttttgaggaaatcgggctgatcaccgacttcacaaagattagcatcaacctcaatccttaccagctgagagtgaaaggactgaccgatgagctctccaacgaagaactgtttattgcgcttaagaatatggttaagcaccggggcatctcttatctggacgatgctagcgacgatggcaactcctctgtgggggactacgcccagattgtcaaagagaatagcaagcagctcgaaacaaaaaccccgggacaaatccagctggagcgctatcagacatacggccagcttagaggggatttcaccgtggaaaaggacggaaagaagcatcggctgattaacgtttttcccacgtccgcctatcgcagcgaggctctcagaatcctgcaaacccagcaggagttcaatcctcagatcacagatgaatttattaaccggtacctggagatcctcaccggcaagagaaaatattaccacgggcccggaaatgaaaagtctcgcacagactacggccggtatagaacctccggcgagacgctggataacattttcgggatccttattggaaaatgcacattttaccctgacgagttccgcgccgctaaggccagctataccgcgcaagagtttaacctgctcaatgacctgaacaatcttacagtgcccaccgagaccaaaaagctgtctaaagaacagaagaaccagatcatcaattacgtcaagaacgagaaagccatgggccctgctaaactcttcaaatatattgccaagctgctgtcctgtgatgtggctgacatcaaagggtaccggattgataagagcggaaaggccgaaatccatacatttgaggcgtatagaaaaatgaagacgctcgaaaccctggacattgagcaaatggatcgcgagacacttgacaaactggcctacgtgctcaccctgaatacagaacgggagggcatccaggaagctcttgagcacgagttcgccgatgggtctttctcccagaagcaggtcgacgaactggttcaatttagaaaagctaacagctccatcttcggaaagggctggcacaatttttctgtgaagctcatgatggagctgattccggaactgtacgagaccagcgaggaacagatgacgatcctcacacgcctgggcaaacagaagaccacctccagctctaacaaaacaaagtatattgatgagaaacttctgaccgaagagatctacaatcccgtggtcgccaagtccgtgcggcaggccattaagatcgttaacgctgcgattaaagaatatggggacttcgataatatcgtgatcgagatggccagagaaacaaacgaggacgacgagaagaaagctattcaaaagatccagaaagccaataaggatgaaaaagacgccgctatgctcaaggccgcgaaccagtacaacggaaaggctgagctgcctcatagcgtctttcacggccataaacagctggccacgaagattcgcctttggcaccaacagggggaacggtgcctctataccggaaaaacaatctctattcacgatctgatcaataaccccaatcagttcgaggtggaccatatcctgcctctcagcattacctttgatgactccctggccaacaaggttcttgtgtacgctacagccaatcaggaaaaaggccaaagaaccccctatcaggctctggattctatggacgatgcctggagcttccgggagctcaaggcgtttgtccgcgagtccaagacgctgagcaacaaaaagaaagaatacctgcttaccgaggaagacatctctaagttcgatgtgcggaaaaagtttattgagagaaatctcgtcgacacaagatacgcctcccgcgtggttctgaacgctctgcaggaacacttccgggcccataagatcgataccaaagtgagcgtcgtgagagggcaatttacatctcagctccgcagacactggggcattgagaagacccgggacacgtatcatcaccacgctgttgacgccctgatcatcgcggcctccagccagcttaatctgtggaaaaagcagaaaaacacactcgtgtcctactctgaggatcaactgctggacattgaaaccggagagcttatcagcgatgacgaatataaggagtccgtcttcaaggctccgtaccagcatttcgtggatacactcaaatctaaggagtttgaagacagcattctgttctcctatcaggtggatagcaaatttaatcgcaagatctctgacgccaccatttacgctaccagacaggccaaagttggcaaggataaagccgacgagacatatgtcctggggaagatcaaggatatctacacgcaagacggatacgatgctttcatgaaaatttataagaaagacaagtccaaatttctcatgtaccggcacgaccctcagaccttcgaaaaggtgatcgagcccattctggaaaactatcctaataagcagatgaacgagaaaggcaaggaggtgccctgtaatccctttcttaaatacaaggaggaacatgggtatatccgcaaatacagcaagaagggaaacggccctgaaattaaatctctgaagtattacgattccaaactcgggaaccacatcgacattacaccgaaggatagcaataacaaagtcgtgctgcagtctctgaagccctggagaaccgacgtttacttcaataagaacacaggcaaatatgagatccttggactcaagtacagcgatatgcaatttgaaaaaggcaccgggaagtattccatcagcaaagagcagtacgagaatattaaggtgcgggaaggagtcgacgagaactctgagttcaagtttacgctgtataaaaatgatctgctcctgcttaaggactccgaaaacggcgaacagatcctgctccgcttcacaagcagaaatgatacctccaaacactacgtggagctgaagccttataaccggcaaaaatttgaggggtctgaatacctgattaagagccttggaaccgttgtgaaaggcgggcgctgcatcaagggcctgggaaagtccaatatttctatctacaaagtcagaacagacgtgctcggcaaccagcatatcattaagaatgagggggataaacccaagctggacttctga

SEQ ID NO: 3938 - RNA, 3363 nt, synthetic construct
  misc_feature 1..3363: note = Cas9 variant
  source 1..3363: mol_type = other RNA
atgggcctggacatcggggtggccagcgtcggattctccgttctcgatattgacaagggcaaagtgatcgagctgggggctagactcttttctgccaccgtggcggctggaaaccaggatcggcgcgacatgagaggcgcccggcgcctgctcaatagaaacaagcaacggcgccaggatacagggaaactgttcaagaaatttggacttattgacgatttcgacaagggcagcttttacgataatttcaaccagaatctgaacccctatgaactcagagtcaagggcctgacggagcagctgaccaaagaagaactcgccgaatccctgtaccaaatcgtgaagcaccgggggatttcttatgctcttaaagacgccgatgttgacgagggaggcacagattacagcgtgtccctgaagatcaattctcaggagctcgctgagaaaacccctgcccagatccagctgcaacgccttaacgactatgggaaggtcagaggacaggtggttattggcgacgatccggacaatcagaaggtgctgctcaacgtctttcccacaagcgcgtacgagaaagaagccaagcagatcattgctacccaacagcagttctatcctgagtccctgacagataaatttaccgaggaatactgccaaatcctgacgcggaagcgcgactacttcgtggggcccggaaatgagaaaagcagaaccgattatggcatttacaagacagacggccggaccctcgataacctgtttgaggaacttatcgggcatgacaaaatttatcctgaggaactgcgcgcctctgctgcctcctacacagcgcagcttttcaatgtgctgaacgatcttaataacctgagaatcctcaactatgaggacggaaagctgaccaaggaagataaagagaagatcattgccgaaatcaaaaataacacgacaaccattaatatgctgaacgtcatcaagaaagttgctggctgtagcaaggacgacattaaggggtttcgggtgaatgagaaagataagcccgaaatctcttccatgcctgtgtacagaaaaatccacaaggacctcctgaaagccggagtcgatattagcgactggccggtggagttcatcgatgagctttctttcattctgacactcaacaccgaaaatggcgagatccgcaagcagctgaacaatcggcttgctcccaagtttgacttcctgaacgccgatctcattcagctgatcatcgacaataaagattcctttgaaattaagaccaacaataaatggcatagattcagcgttaagacaatgaacaaactgatccctgagatgatggaacgccccgtggagcaaatgacgctcctgaatgagatggggcttgtcaagaaggacaaaaagcggtttgaaaacaacaaatatctgccttacaaggagattgccaaagatatcttcaatcccgtggcttccaagtctgttagagaagcgctcaaaattgtgaacgccgtcctgaagaagtacggacacatcgactatctggtggtcgagatgccgcgcgataaaaatcttaaggaggaacaggacaacattaaagagtttcagaataagaacaaaaaggctaaggacgccgccttcgaggcttttgtgaaaagcgttggctccgaacagcgggtgaaggaagccctcagcaaaaatagaaagctgcaaatgaaaatgcgcctgtggtaccagcagcaggagatcgatccttataacggcaagaccatcgacgcgacagatctcattaataaccccgacaagttcgagatcgatcatattatccctcaatctatttccttttacgacagcatcaataacaaaaccctgtgcttcgcttctatgaatcaggtcaaggggcagaaaacaccctatgaatttatgcttgagggacacggccagagctacgataagttcaaagccaccgtgatggccaacaagaatttcgggaaggctaaacgggccaactatctgtttgaagagaacgtttccgacatcgaaacgagaaagcgcttcctctctcggaatctggtggatacaagatacagctcccgggtcgtgctgaacagccttcaagactttttccgcgagaaatctgctgataccaaggtgaccgttattagaggaaaatttacatccaatatgcggaagcactggcatatcgacaaaaccagagagacattccaccatcacgccattgatgcgagcatcattgccgctacgccctttctccgcatgtggaagaagggcgggaccatcttccctgtcaaagtgggcgaagagtctatcgacattgaaacaggagagatcctggacgataagaactttgacaaagccatgtacgaggaaccgtattccggcttcgtgagcgagattatgaatgctgatgaccggatcaagttttcccaccaggtcgataaaaagatgaacagaaaggtgtctgacgccaccatttacagcacacgcaccgggaaactggcgaaggataaaaaggacgccgaatatatcgttgctaaagtgaaggatatctactccgtcgacggattcaagaaatttaagaaagtgtatgataaggacaaaacgaagttcctcctgtacaagtatgaccccagaaccttctctaaacttgagcggattatcagcgattgtcctgacaaggttgaaaaagtgcagacaaatggcaaggtcaaagccgtggatatttccccctttgagatgtaccgcagagaccatgggatgatcaagaagtacagcaaaaagggaaacggccctgctattaaacaactgaagtatctcgataaaaagctggggtctcacatcgacattacccccgccaatgccaacggcaaacatgttatcctgcagtcccttaagccgtggcggacagatgtgtacctcaatcacgagaccggagaatatgagatcatgggcattaagtacagcgacctgaaattcaacaagaatgaagggtatggaatcaaaaaggataaatacctggagattaagaaggtcgaagaggtgtctgagaaatccgaatttatgttcagcctctatcgcaaggacagagtgaaagtccaggatatgaagacgggcgagtctgttgaactgctgttttggagccggaacttctccaataaaaagtacgctgagcttaagcctatcagccaggcggaaaacgacaaaaagctccccgtgtacgggaaaggacgcctgattaagagactgatccctaaaaactgcaagatctggaaggtgaatacaaccattcttggcgatccctattacctcgagaaagagtctgactcccctaaggacatcctggattga

SEQ ID NO: 3939 - RNA, 3366 nt, synthetic construct
  misc_feature 1..3366: note = Cas9 variant
  source 1..3366: mol_type = other RNA
atgagcgacctggtgctcggcctggatatcgggattggatccgtcggcgttgggatccttaacaaggtgaccggagagattatccacaaaaattctagaattttccccgccgctcaggccgaaaacaatctggtgcggcgcacaaacagacaaggccggcgcctcacgagacggaagaaacatcgcagagtccggctgaatcgcctttttgaggaaagcgggctgatcaccgacttcacaaagatctccattaacctcaatccttaccagctgagagtgaaaggactgaccgatgagctctctaacgaagaactgtttatcgcgcttaagaatatggttaagcaccggggcattagctatctggacgatgcttccgacgatggcaactctagcatcggggactacgcccagattgtgaaagaaaattccaagcagctcgaaacaaaaaccccgggacaaatccagctggagcgctatcagacatacggccagcttagaggggatttcaccgtcgaaaaggacggaaagaagcatcggctgattaacgtgtttcccacgagcgcctatcgctctgaggctctcagaatcctgcaaacccagcaggagttcaatcctcagatcacagatgaatttgttaaccggtacctggagattctcaccggcaagagaaaatattaccacgggcccggaaatgaaaagtcccgcacagactacggccggtatagaaccaacggcgagacgctggataacatcttcgggattcttatcggaaaatgcacattttaccctgacgagttccgcgccgctaaggccagctataccgcgcaagagtttaatctgctcaacgacctgaataaccttacagtgcccaccgagaccaaaaagctgtctaaagaacagaagaatcagattatcaactacgtcaagaatgagaaagccatgggccctgctaaactcttcaaatatatcgccaagctgctgtcctgtgatgtggctgacattaaagggtaccggatcgataagagcggaaaggccgaaattcatacatttgaggcgtatagaaaaatgaagacgctcgaaaccctggacatcgagcaaatggatcgcgagacacttgacaaactggcctacgtgctcaccctgaacacagaacgggagggcattcaggaagctcttgagcacgagttcgccgatgggtctttctcccagaagcaggtcgacgagctggttcaatttagaaaagctaatagctccatcttcggaaagggctggcacaacttttctgtgaagctcatgatggagctgatcccggaactgtacgagaccagcgaggaacagatgacgattctcacacgcctgggcaaacagaagaccacctccagctctaataaaacaaagtatatcgatgagaaacttctgaccgaagagatttacaaccccgtggtcgccaagtccgtgcggcaggccatcaagattgttaatgctgcgatcaaagaatatggggacttcgataacattgtgatcgagatggccagagaaacaaatgaggacgacgagaagaaagctatccaaaagattcagaaagccaacaaggatgaaaaagacgccgctatgctcaaggccgcgaaccagtacaatggaaaggctgagctgcctcatagcgtctttcacggccataaacagctggccacgaagatccgcctttggcaccaacagggggaacggtgcctctataccggaaaaacaatttctatccacgatctgattaacaatagcaaccagttcgaggtggaccatatcctgcccctctccatcacctttgatgactctctggccaataaggttcttgtgtacgctacagccaaccaggaaaaaggccaaagaaccccttatcaggctctggatagcatggacgatgcctggtccttccgggagctcaaggcgtttgtccgcgagagcaagacgctgtctaataaaaagaaagaatacctgcttaccgaggaagacatttccaagttcgatgtgcggaaaaagtttatcgagagaaacctcgtcgacacaagatacgccagccgcgtggttctgaatgctctgcaggaacacttccgggcccataagattgataccaaagtgtctgtcgtgagagggcaatttacatcccagctccgcagacactggggcatcgagaagacccgggacacgtatcatcaccacgctgttgacgccctgattatcgcggccagctcccagcttaacctgtggaaaaagcagaaaaatacactcgtgtcttacagcgaggatcaactgctggacatcgaaaccggagagcttatttccgatgacgaatataaggagttcgtcttcaaggctccctaccagcattttgtggatacactcaaatctaaggagttcgaagacagcatcctgttttcctatcaggtggatagcaaattcaaccgcaagatttctgacgccaccatctacgctaccagacaggccaaagttggcaaggataaagccgacgagacatatgtcctggggaagattaaggatatctacacgcaagacggatacgatgcttttatgaaaatctataagaaagacaagtccaaattcctcatgtaccggcacgacccgcagacctttgaaaaggtgattgagcctatcctggaaaattatcccaacaagcagatgaatgagaaaggcaaggaggtgccttgtaaccccttccttaaatacaaggaggaacatgggtatattcgcaaatacagcaagaagggaaacggccccgaaatcaaatctctgaagtattacgattccaaactcgggaatcacattgacatcacacctaaggatagcaacaataaagtcgtgctgcagtctgttagcccgtggagagcggacgtgtactttaacaataccacaggcaagtatgagattctgggacttaagtacgccgatctccaattcgaaaaaggcaccgggacgtataagatctcccaggagaaatacaacgacatcaagaaaaaggagggagtcgatagcgactctgaatttaagttcacactgtataaaaatgatctgctcctggtgaaggagaccgaaaccaaagagcagcaactttttcggttcctgtcccgcacaatgcccaagcagaaacactacgttgaactcaagccttatgacaaacagaagttcgagggcggggaggctctgattaaggtgctgggaaacgtcgccaatggcgggcagtgcatcaaaggccttggaaagagcaacatttccatctacaaagtgagaaccgatgttctgggcaatcaacatattatcaagaacgaaggggacaaacccaagctcgacttttga

SEQ ID NO: 3940 - RNA, 3366 nt, synthetic construct
  misc_feature 1..3366: note = Cas9 variant
  source 1..3366: mol_type = other RNA
atgaacggcctggtgctcgggctggacatcggaattgccagcgtcggcgttgggatccttgagaaaaattccggaaaaattatccacgctaactctagactgttccccgccgcgaccgctgataataacgtggaacggcgcaagaatagacaggcccggcgcctcaacagacggaaaaagcatcgcggcgtgagatttcaagacctgttcgaggattacgggcttctgacagactttagcaaagtctccattaatctcaacccttatcggctgcgcgtggatggactgaataagcagctcacgaacgaagaactgttcatcgcccttaagaatatcgttaaaagacggggcatttcttacctggacgatgctagcgaagacggcgggaccgtgtcctctgattatggaaaggccgtcgaggagaaccgcaaactcctggctgaacagacaccgggccagatccaacttgagagatttgaaaagtacgggcagctgcggggagacttcaccgtggttgagaatggcgagaaatgccgcctcattaacgtgtttagcacatccgcctataagaaggaagcggagagaatcctgcggaaacagcaggagttcaatagcaagattaccgatgagtttatcgaagactacctgaaaattctcacagggaagagaaaatattaccacggacccggcaacgagaagtctcgcaccgattacggccggttcagaaaagacgggacgaccctggacaacatctttggaatccttattggcaagtgtacattctatcctaatgagtaccgcgcctccaaggctagctataccgcccaagaatttaacctgctcaatgatctgaacaatctttctgtccccacagagaccaaaaagctgtccgaggaacagaaaaagacgatcattgaatacgctaaaagcgccaagacactcggggcgtctaccctgctgaagtatatcgccaaaatgattgacacatccgtggatcagatccggggatacagagtggacgtcaacaataagcctgagatgcataccttcgaggtttatcgcaaaatgcagagcctcgaaaccatctccgtgggcgagctgtctcggaacgtgcttgatgaactggctcacattctcacactgaatacggagagagaagggatcgaggaggccattaacaccaaacttaaggacagcttctcccaagatcaggtcctggaactcgtgcagtttcgcaagaataacagctctctgttctccaagggatggcataattttagcctgaaactcatgatggagctgatccccgaactttacgagacatctgaggaacaaatgaccattctgacacggctcggcaagcagaaaagcaaggagacctccaaaagatctaagtacatcgacgaaaaggagctgacggaagagatctataaccctgttgtggctaaaagcgtccgccaggccattaagatcattaatgaggccacaaagaagtacggcatcttcgataacattgtgatcgaaatggctcgggagaacgacgaagaggatgcgaaaaaggactatattaaaagacagaaggccaatcaagacgaaaagaacgctgccatggagaaagccgcttttcagtacaatgggaagaaagagctgccggataacatcttccacggacacaaggaacttgccaccaaaatccggctctggcatcagcagggcgagaagtgcctgtataccgggaagacaattcccatctccgacctgattcacaatcaatacaaatatgaaatcgatcatgttctccctctgagcctttcttttgacgattccctgagcaacaaggtgctcgtcctggcgaccgctaatcaggagaaaggacagcgcacacccttccaggccctggactctatggatgacggctggtcctacagagaatttaagagctacgtgaaagagtccaaacttctcgggaacaagaagaaggagtatctgctgacggaagaggatatttctaaaatcgaagtcaagcaaaaattcatcgagcggaatctcgtggacaacagatacagctcccgcgttgtgctgaatgcccttcaggatttttataaggctcacaagttcgacaccacaatttctgtcgtgcggggccagtttaccagccagctgagacgcaaatggggactcgagaagtccagagaaacataccaccatcacgccgttgatgctctgatcattgccgcgagctctcaactgcggctttggaaaaagcataacaatcctctcatctcctataaagagggccgcttcattgacagcgaaaccggggagatcatctctctgtccgacgatgaatacaaggagctggtgttcaaagccccctatgaccactttgtcgatacgctcagaagcaagaccttcgaggactctattctgtttagctaccaggtggattccaagtacaaccggaaaatcagcgacgctacaatttatgccacccgcaaggctaaacttgataaggacaaatctgaagagacatacgtgctgggaaagatcaaggatatttattcccaggccggctacgacgcgttcatcaaaatctataataaggataaaagcaagtttctcatgtaccataaagacccgcaaaccttcgaaaaggttattgaggaaatcctgagaacgtatccttccaaggagctgaacgataaaaacaaggagattccctgtaatccttttgaaaaataccggcaggagaacgggcccatccgcaagtactctaaaaagggaaatggccccgaaattaagagcatgaaatattacgacaagaacatccctgagtccttcattaatatcacaccgtctaacagcaataacaaagtccttctcagacagctgtatccctggcggaccgacgtgtactttaatcctcagacagataagtatgaactgctcgggctgaaatacgccgaccttcaattcgagaaggctaccggcaagtattccatcaccattgataaatacaacgagatcaaggaaaaagagggagtgtctaaggaaagcgagtttaaattcacactgtacaagaatgacctcctgctgattaaagatacgaagaacaatgaggaacagatctttcgcttcctttccagaaccatgcccaaccagaatcactatgtcgagctgaagccttacgacaaaggcaacttcgaagggaaggagaaaattaaggtgtttaaaatgacaagcaacggacggtgcatcaagggcctcgggaagaaatatctgtctatctacaaggttaaaaccgatattctcggaaataagcacttcatcaaaaaggaaggcgacgagcccaagctgaaattttga

SEQ ID NO: 3941 - RNA, 3366 nt, synthetic construct
  misc_feature 1..3366: note = Cas9 variant
  source 1..3366: mol_type = other RNA
atgaacggcctggtgctcgggctggacatcggaattgccagcgtcggcgttgggatccttgagaagaatagcggaaaaattatccacgctaactctagactgttccccgccgcgaccgctgataataacgtggaacggcgcaagaatagacaggcccggcgcctcaacagacggaaaaagcatcgcggcgtgagatttcaagacctgttcgaggattacgggcttctgacagactttagcaaagtctccattaatctcaacccttatcggctgcgcgtggatggactgaatcagcagctcacgaacgaagaactgttcatcgcccttaagaatatcgttaagagacggggcatttcttacctggacgatgctagcgaagacggcggggccgtgtcctctgattatggaaaagctgtcgaggagaaccgcaagctcctggccgaacagaccccgggccaaatccagcttgagagatttgaaaaatacggacaggtgcggggagacttcacagttgtggagaatggcgagaagcgcagactgattaacgtctttagcacctccgcgtatcggaaagaagccgagaagatcctcagaaagcagcaagagttcaataaccagattacagatgagtttatcgaagactacctgaaaattctgaccgggaagcgcaaatattaccacggacccggcaacgagaagtcccggacagattacggcagattccgcaccgacgggacgaccctcgacaatatctttggagtgctgatcggcaaatgcacattctatcctaacgagtaccgggcttctaagtccagctataccgcccaggaatttaatcttctgaacgatctcaataacctgacagtgcccaccgagacgaaaaagctgtctgaagaacagaagaaagtcattgttgaatacgctaaggaggccaaaacacttggggcgtccaccctcctgaagtatatcgtgaaaatgattgacgccagcgtggatcaaatctctggatacagagtcgacgtgaataacaagcctgagatgcatacattcgaagtttatcgcaagatgcagtccctggagaccattagcgtgggcgaactctcccggaatgtcctggatgagcttgctcacatcctgaccctcaacacagaaagagaggggatcgaggaagccattaattctaaactgatgggagtgttcagccaggaccaagttcttgagctggtgcagtttcgcaagaacaattccagcctcttctctaaaggctggcataacttttccctgaagctgatgatggaactcatccccgagctgtacgagacgagcgaggagcagatgaccattcttacacggctgggcaaacagaagtctaaggaaaccagcaaaagaacaaagtacatcgatgagaaagaactcaccgaggagatttataatcctgtcgtggctaagtccgtccgccaagccatcaaaatcattaacgaagccacgaagaagcacgggatcttcgacaacattgtgatcgagatggctcgggaaaataacgaggaagatgcgaaaaaggactacattaaaagacagaaggccaatcaggatgagaaaaacgctgccatggagaaggccgcttttcagtataatgggaaaaaggaactgccgggcaacatcttcaatgggcacaaggagctggccacaaaaattcggctttggcatcaacagggagaaaagtgtctctacaccggcaaaaccatccccatctctgacctgattcacaaccagtataagtacgagatcgaccatattctgcctctcagcctgtcctttgatgacagcctttctaataaagttctggtgcacgcgacagctaaccaggaaaaggggcaacgcacccccttccaggccctcgattccatggacgatgcctggagctatagagagtttaagtcttacgtcaaagacctgaagtccctgagcaataaaaagaaagattaccttctcacagaggaagacatctccaagattgaggtgaagcagaaattcatcgaacggaacctggttgatacgagatattctagccgcgtggtcctgaatgctctccaggacttttacaagtcccaccaattcgataccacaatctctgtggtgcggggccagtttaccagccagctgagacgcaaatggggacttgagaagtccagagagacatatcatcaccatgccgttgacgctctgattatcgccgcgagctctcaactccggctgtggaaaaagcagaacaatcctctgattacctacaaggaaggccagttcatcgattcccagacgggggagattatcagccttaccgacgacgaatataaagagctcgtcttcaaggccccctacgatcactttgtggacacactgcattctaaaaccttcgaagatggaatcctgttttcctatcaagtggacagcaagtacaaccgcaaaatttctgatgctacaatctacgccaccagaaaggctaaactcgacaaggataagagcgaggagacgtatgtcctgggcaaaattaaggacatctactcccaggccgggtatgatgcgttcattaaaatctacaacaaggacaaacggaagtttcttatgtatcacaaggatccgcagacattcgaaaaagtgatcgaggaaattctgcgcacctaccctagcaaggagagaaatgacaaaaacaaggaagttccctgcaatccttttgagaaatatcggcaggagaacggacccatccgcaagtactctaagaaaggcaatgggcccgaaattaagtgtctcaaatactatgataacaagctgggcaattacatcgacatttcccctgacggaagcgataaccaagtggtcctgcagtcccttaaaccgtggagaacagacgtgtatttcaatcaccagaccaagaagtacgagctcatgggcctgaaatattctgatctgagctttgaaaaggggtccggaaaatactctatcagcaacgagaagtataattccattaaacggatcgaaggcgttaacgagcagtctgagttcaagtttaccctctacaagaatgacctgatccttattaaagatagcgaaaacaatgagcaaaagctgttccgctttaactccagaaacgacacagccaaacattacgtggaactcaagccctatgataaagctcggttcgacgggcagcaggagctgatcacgattctgggaaatgtcgccaagggcgggcaatgccttaaaggcctgaacaagagcaatatctctattttcaaggtgaaaaccgatgttctcggaaagaaacacatcatcaagaaagagggcgacgaacctaagctgaagttttga

SEQ ID NO: 3942 - RNA, 3366 nt, synthetic construct
  misc_feature 1..3366: note = Cas9 variant
  source 1..3366: mol_type = other RNA
atgagcgacctggtgctcggcctggatatcgggattggatccgtcggcgttgggatccttaacaaggtgaccggagagattatccacaaaaattctagaattttccccgccgctcaggccgaaaacaatctggtgcggcgcacaaacagacaaggccggcgcctcacgagacggaagaaacatcgcatcgtcagactgaatcggctttttgaggaaagcgggctgatcaccgacttcacaaagatttccatcaacctcaatccttaccagctgcgcgtgaaaggactgaccgatgagctctctaacgaagaactgtttattgcgcttaagaatatggttaagcacagaggcatcagctatctggacgatgcttccgacgatggcaactctagcgtgggggactacgcccagattgtcaaagaaaattccaagcagctcgaaacaaaaaccccgggacaaatccagctggagcggtatcagacatacggccagcttcgcggggatttcaccgtggaaaaggacggaaagaagcatagactgattaacgtttttcccacgagcgcctatcggtctgaggctctccgcatcctgaagacccaacaggagttcaatcctcagatcacagatgaatttattaacagatacctggagatcctcaccggcaaacggaagtattaccacgggcccggaaatgaaaaatccagaacagactacggccgctatcggaccaacggcgagacgctggataacattttcgggatccttattggaaagtgcacattttaccctgaagagttcagagccgctaaagccagctataccgcgcaggagtttaatctgctcaacgacctgaataaccttacagtgcccaccgaaaccaagaaactgtctaaggagcaaaagaatcagatcatcaactacgtcaaaaatgaaaaggccatgggccctgctaaactcttcaagtatattgccaaactgctgtcctgtgacgtggctgatatcaaggggtaccgcattgacaagagcggaaaagccgagatccatacatttgaagcgtatcggaagatgaaaacgctcgagaccctggatattgagcagatggacagagaaacacttgataagctggcctacgtgctcaccctgaacacagagcgcgaaggcatccaagaggctcttgaacacgagttcgccgacgggtctttctcccagaaacaggtcgatgagctggttcagtttcggaaggctaatagctccatcttcggaaagggctggcacaacttttctgtgaaactcatgatggaactgattccggagctgtacgaaaccagcgaggagcaaatgacgatcctcacaagactgggcaagcagaaaaccacctccagctctaataagacaaaatatattgacgaaaaacttctgaccgaggaaatctacaaccccgtggtcgccaagtccgtgcgccaggccattaaaatcgttaatgctgcgattaaggagtatggggatttcgacaacatcgtgatcgaaatggcccgggagacaaatgaggatgacgagaaaaaggctattcagaaaatccaaaaggccaacaaagacgagaaggatgccgctatgctcaaggccgcgaaccagtacaatggaaaagctgaactgcctcatagcgtctttcacggccataagcagctggccacgaaaattagactttggcaccagcaaggggagcgctgcctctataccggaaagacaatctctattcacgacctgatcaacaatcccaaccagttcgaagtggatcatatcctgcctctcagcattacctttgacgattccctggccaataaagttcttgtgtacgctacagccaaccaggagaagggccagcggaccccctatcaagctctggactctatggatgacgcctggagcttcagagagctcaaggcgtttgtccgggaatccaaaacgctgagcaataagaaaaaggagtacctgcttaccgaagaggatatctctaaattcgacgtgcagaagaagtttattgaacgcaacctcgtcgatacaagatacgcctcccgggtggttctgaatgctctgcaggagcacttcagagcccataaaatcgacaccaaggtgagcgtcgtgcgcgggcaatttacatctcagctccggagacactggggcattgagaaaacccgcgatacgtatcatcaccacgctgttgacgccctgatcatcgcggcctccagccagcttaacctgtggaagaaacagaagaatacactcgtgtcctactctgaagaccaactgctggatattgagaccggagaacttatcagcgacgatgagtataaggagtccgtcttcaaagctccgtaccagcatttcgtggacacactcaagtctaaagaatttgaggatagcattctgttctcctatcaggtggacagcaagtttaacagaaaaatctctgatgccaccatttacgctacccggcaggccaaggttggcaaagacaagaaggatgaaacatatgtcctggggaaaatcaaggacatctacacgcaagatggatacgacgccttcatgaaaatttataagaaagataagtccaagtttctcatgtaccgccacgaccctcagaccttcgagaaagtgatcgaacccattctggagaattatcctaacaaggagatgaatgaaaaaggcaaggaggtgccctgtaacccctttcttaaatacaaggaggagcatgggtatatcagaaagtacagcaaaaagggaaacggccctgaaattaaatctctgaagtattacgactccaaactcgggaatcacatcgatattacaccgaagaacagcaataacaaggtcgtgctgcagtctgttagcccctggcgggctgacgtgtacttcaataaaaccacaggcaagtatgagatcctgggacttaaatacgcggatctccagtttgagaagggcaccgggacgtataaaatctcccaagaaaagtacaacgacattaagaaaaaggagggagtcgatagcgactctgagttcaaatttacactgtataagaatgatctgctcctggtgaaagacaccgaaaccaaggaacagcagcttttccgctttctgtccagaacaatgcctaaaaagaagcactacgttgagctcaaaccctatgataagcaaaaattcgagggcggggaagccctgatcaaggtgctgggaaacgtcgctaatagcggccagtgcattaaagggcttgccaagtccaacatctctatttacaaggtgcggaccgacgttctgggcaatcagcatatcatcaaaaacgagggagataagcctaaactcgacttctga

SEQ ID NO: 3943 - RNA, 3366 nt, synthetic construct
  misc_feature 1..3366: note = Cas9 variant
  source 1..3366: mol_type = other RNA
atgagcgacctggtgctcggcctggatatcgggattggatccgtcggcgttgggatccttaacaaggtgaccggagagattatccacaaaaattctagaattttccccgccgctcaggccgaaaacaatctggtgcggcgcacaaacagacaaggccggcgcctcacgagacggaagaaacatcgcagagtccggctgaatcgcctttttgaggaaagcgggctgatcaccgacttcacaaagatctccattaacctcaatccttaccagctgagagtgaaaggactgaccgatgagctctctaacgaggagctgtttatcgcgcttaagaatatggttaagcaccggggcattagctatctggacgatgcttccgacgatggcaactctagcatcggggactacgcccagattgtgaaagaaaattccaagcagctcgaaacaaaaaccccgggacaaatccagctggagcgctatcagacatacggccagcttagaggggatttcaccgtcgaaaaggacggaaagaagcatcggctgattaacgtgtttcccacgagcgcctatcgctctgaggctctcagaatcctgcaaacccagcaggagttcaatcctcagatcacagatgaatttattaaccggtacctggagatcctcaccggcaagagaaaatattaccacgggcccggaaatgaaaagtcccgcacagactacggccggtatagaaccagcggcgagacgctggataacattttcgggatccttattggaaaatgcacattttaccctgacgagttccgcgccgctaaggcctcttataccgcgcaagaatttaacctgctcaatgacctgaacaatcttacagttcccaccgagaccaaaaagctgtccaaagaacagaagaaccagatcatcaattacgtgaagaacgagaaagccatgggccctgctaaactcttcaaatatattgccaagctgctgagctgtgatgtcgctgacatcaaagggtaccggattgataagtctggaaaggccgaaatccatacatttgaggcgtatagaaaaatgaagacgctcgaaaccctggacattgagcaaatggatcgcgagacacttgacaaactggcctacgtgctcaccctgaatacagaacgggagggcatccaggaagctcttgagcacgagttcgccgatgggtccttcagccagaaacaggtggacgaactggtccaatttagaaaagctaactcctctatcttcggaaagggctggcacaattttagcgttaagctcatgatggagctgattccggaactgtacgagacctccgaggaacagatgacgatcctcacacgcctgggcaaacagaagaccacctctagctccaacaaaacaaagtatattgatgagaaacttctgaccgaagagatctacaatcccgtggtggccaagagcgtccggcaggccattaagatcgtgaacgctgcgattaaagaatatggggacttcgataatatcgttatcgagatggccagagaaacaaacgaggacgacgagaagaaagctattcaaaagatccagaaagccaataaggatgaaaaagacgccgctatgctcaaggccgcgaaccagtacaacggaaaggctgagctgcctcattctgtgtttcacggccataaacagctggccacgaagattcgcctttggcaccaacagggggaacggtgcctctataccggaaaaacaatcagcattcacgatctgatcaataactccaatcagttcgaggtcgaccatatcctgcccctctctattacctttgatgacagcctggccaacaaggtgcttgtttacgctacagccaatcaggaaaaaggccaaagaaccccttatcaggctctggattccatggacgatgcctggagcttccgggagctcaaggcgtttgtgcgcgagtctaagacgctgtccaacaaaaagaaagaatacctgcttaccgaggaagacatcagcaagttcgatgtcagaaagaagtttattgagcggaatctcgtggacacaagatacgcctctcgcgtcgtgctgaacgctctgcaggaacacttccgggcccataagatcgataccaaagtttccgtggtcagagggcaatttacaagccagctccgcagacactggggcattgagaagacccgggacacgtatcatcaccacgctgtggacgccctgatcatcgcggcctcctctcagcttaatctgtggaaaaagcagaaaaacacactcgttagctactccgaggatcaactgctggacattgaaaccggagagcttatctctgatgacgaatataaggagagcgtgttcaaggctccctaccagcatttcgtcgatacactcaaatccaaggagtttgaagacagcattctgttctcttatcaggtggattccaaatttaatcgcaagatcagcgacgccaccatttacgctaccagacaggccaaagtgggcaaggataaagccgacgagacatatgttctggggaagatcaaggatatctacacgcaagacggatacgatgctttcatgaaaatttataagaaagacaagtctaaatttctcatgtaccggcacgacccgcagaccttcgaaaaggtcatcgagcctattctggaaaactatcccaataagcagatcaacgagaaaggcaaggaggtgccttgtaatccctttcttaaatacaaggaggaacatgggtatattcgcaaatactccaagaagggaaacggccccgaaatcaaaagcctgaagtattacgattctaaactcgggaaccacattgacatcacacctaaggatagcaataacaaagtggtcctgcagtccgtgagcccgtggagagcggacgtttacttcaataagaccacaggcaagtatgagatcctgggacttaaatacgccgatctccaatttgaaaagggcaccgggacgtataaaatttctcaggagaagtacaacgacatcaaaaagaaggagggagtggattccgacagcgagttcaaatttacactgtataagaatgatctgctcctggtcaaagacaccgaaaccaaggaacagcaacttttccggtttctgtcccgcacaatgcccaaacagaagcactacgtggagctcaaaccttatgataagcagaagttcgaaggcggggaggctctgattaaagttctgggaaacgtggccaattctggccagtgcaagaaagggcttggcaagagcaacatctccatttacaaagtcagaaccgacgtgctgggaaatcaacatatcatcaagaacgagggcgacaagcccaaactcgatttctga

SEQ ID NO: 3944 - RNA, 3366 nt, synthetic construct
  misc_feature 1..3366: note = Cas9 variant
  source 1..3366: mol_type = other RNA
atgagcgacctggtgctcggcctggatatcgggattggatccgtcggcgttgggatccttaacaaggtgaccggagagattatccacaaaaattctagaattttccccgccgctcaggccgaaaacaatctggtgcggcgcacaaacagacaaggccggcgcctcacgagacggaagaaacatcgcagagtccggctgaatcgcctttttgaggaaagcgggctgatcaccgacttcacaaagatctccattaacctcaatccttaccagctgagagtgaaaggactgaccgatgagctctctaacgaggagctgtttatcgcgcttaagaatatggttaagcaccggggcattagctatctggacgatgcttccgacgatggcaactctagcgtgggggactacgcccagatcgtcaaagaaaattccaagcagctcgaaacaaaaaccccgggacaaattcagctggagcgctatcagacatacggccagcttagaggggatttcaccgtggaaaaggacggaaagaagcatcggctgatcaacgtttttcccacgagcgcctatcgctctgaggctctccggattctgcaaacccagcaggagttcaatcctcagatcacagatgaatttgtgaacagatacctggagatcctcaccggcaagagaaaatattaccacgggcccggaaatgaaaagtcccgcacagactacggccggtatagaaccaacggcgagacgctggataacattttcgggatccttattggaaaatgcacattttaccctgaagagttccgcgccgctaaggccagctataccgcgcaagagtttaatctgctcaacgacctgaataaccttacagtccccaccgaaaccaaaaagctgtctaaagagcagaagaatcagatcattaactacgtgaagaatgaaaaagccatgggccctgctaaactcttcaaatatatcgccaagctgctgtcctgtgacgtggctgatatcaaagggtaccggattgacaagagcggaaaggccgagatccatacatttgaagcgtatagaaaaatgaagacgctcgagaccctggatattgagcaaatggaccgcgaaacacttgataaactggcctacgtcctcaccctgaacacagagcgggaaggcatccaggaggctcttgaacacgagttcgccgacgggtctttctcccagaagcaggttgatgagctggtgcaatttagaaaagctaatagctccattttcggaaagggctggcacaacttttctgtgaagctcatgatggaactgatcccggagctgtacgaaaccagcgaggagcagatgacgatcctcaaacgcctgggcaagcagaaaacaacctccagctctaataagaccaaatatattgacgaaaaacttctgacagaggaaatctacaaccccgtcgtggccaagtccattcggcaggccatcaaaattgttaatgctgcgatcaaggagtatggggatttcgacaacattgtgatcgaaatggccagagagaccaatgaggatgacgaaaagaaggctatccagaaaattcaaaaggccaacaaagacgagaaggatgccgctatgctcaaggccgcgaaccagtacaatggaaaagctgaactgcctcatagcgtctttcacggccataagcagctggccacaaaaatccgcctttggcaccaacagggggagcggtgcctctatacgggaaagaccatttctatccacgacctgattaacaatcccaaccagttcgaagtggatcatatcctgcctctcagcatcacatttgacgattccctggccaataaagttcttgtgtacgctaccgccaaccaggagaagggccaaagaacaccctatcaggctctggactctatggatgacgcctggagcttccgggagctcaaggcgtttgtccgcgaatccaaaaccctgagcaataagaaaaaggagtacctgcttacggaagaggatatttctaaattcgacgtgagaaagaagtttatcgaacggaacctcgtcgataccagatacgcctcccgcgtggttctgaatgctctgcaggagcacttccgggcccataaaattgacacaaaggtgagcgtcgtgagagggcaatttacctctcagctccgcagacactggggcatcgagaaaacacgggatacctatcatcaccacgctgttgacgccctgattatcgcggcctccagccagcttaacctgtggaagaaacagaagaatacgctcgtgtcctactctgaagaccaactgctggatatcgagacaggagaacttattagcgacgatgagtataaggagtccgtcttcaaagctccgtaccagcatttcgtggacaccctcaagtctaaagaatttgaggatagcatcctgttctcctatcaggtggacagcaagtttaaccgcaaaatttctgatgccacaatctacgctaccagacaggccaaggttggcaaagacaagaaggatgaaacctatgtcctggggaaaattaaggacatctacacacaagatggatacgacgccttcatgaaaatctataagaaagataagtccaagtttctcatgtaccggcacgaccctcagacgttcgagaaagtgattgaacccatcctggagaattatcctaacaaggagatgaatgaaaaaggcaaggaggtgccctgtaacccctttcttaaatacaaggaggaacatgggtatattcgcaagtacagcaaaaagggaaacgaccctgaaatcaaatctctgaagtattacgattccaaactcggcaatcacattgacatcaccccgaaggatagcaacaataaggtcgtgctgcagtctgttagcccctggagagctgacgtgtacttcaacaaaacaaccgggaagtatgagattctgggccttaaatacgcggatctccagtttgagaagggaacaggcacctataaaatctcccaagaaaagtacaatgacatcaagaaaaaggagggggtcgatagcgactctgagttcaaatttacgctgtataagaacgatctgctcctggtgaaagacacagaaaccaaggaacagcagcttttccggtttctgtcccgcaccatgcctaaacaaaagcactacgttgagctcaagccctatgataaacagaagttcgagggaggcgaagccctgattaaagtgctggggaatgtcgctaacagcggacagtgcaagaaaggccttgggaagtccaatatctctatttacaaggtgagaacagacgttctgggcaaccagcatatcattaaaaatgagggagacaagcctaaactcgatttctga

SEQ ID NO: 3945 - RNA, 3366 nt, synthetic construct
  misc_feature 1..3366: note = Cas9 variant
  source 1..3366: mol_type = other RNA
atgaacggcctggtgctcgggctggacatcggaattgccagcgtcggcgttgggatccttgagaaaaattccggaaaaattatccacgctaactctagactgttccccgccgcgaccgctgataataacgtggaacggcgcaagaatagacaggcccggcgcctccatagacggaaaaagcaccgcggcgtgagatttcaagacctgttcgaggattacgggcttctgacagactttagcaaagtctccattaacctcaatccttatcggctgcgcgtggatggactgaaccagcagctcacgaatgaagaactgttcatcgcccttaagaacatcgttaagagacggggcatttcttacctggacgatgctagcgaagacggcgggaccgtgtcctctgattatggaaaagccgtcgaggagaatcgcaagctcctggctgaacagacaccgggccaaatccagcttgagagatttgaaaaatacggacaggtgcggggagacttcaccgttgtggagaacggcgagaagcgcagactgattaatgtctttagcacatccgcctatcggaaagaagcggagagaatcctccgcaagcagcaagagttcaacagcaagattaccgatgagtttatcgaagactgcctgaaaattctgacagggaagcggaaatactatcatggacccggcaatgagaagtctagaaccgattacggccgcttccggacggacgggaccacactcgacaacatctttggaatcctgattggcaaatgtaccttctaccctgatgagtatagagcctccaaggctagctacacagcccaggaatttaaccttctgaatgacctcaacaatctgaccgtgcccacggagacaaagaaactttctgaggaacagaagaaagtgatcgtcgaatatgctaaggaggccaaaaccctgggggcgtccacactcctgaagtacattgccaaaatgatcgatgctagcgttgaccagattcgcggatatcgggtggatgtgaacaataagcctgagatccacaccttcgaagcctacagaaagatgcaatctctggagaccatctccgtcggcgaactcagccgcaacgtgctggacgagcttgctcatattctgacactcaatacggaacgggaggggatcgaggaagccattaacaccaaactgaaggattccttctctcaggaccaggttcttgagctggtgcaatttagaaagaataacagctccctcttcagcaagggatggcacaatttttctctgaaactgatgatggaactcatccccgagctgtatgagacatccgaggaacagatgaccattcttacacgcctgggcaagcaaaagagcaaagaaatctctaagcggaccaaatacatcgatgagaaggaactcacggaggagatttacaaccctgtcgtggccaaaagcgttagacaggctatcaagattatcaatgaagcgacaaagaaacacggcattttcgacaacatcgtgattgagatggcccgggaaaataacgaggaagatgctaagaaagactatatcaagcgccagaaagccaaccaggacgagaagaatgccgctatggagaaagccgcgtttcagtacaacgggaagaaggaactgccggattccatcttccatggacagaaagagctggctaccaagattagactttggcaccaacagggcgaaaaatgcctctataccgggaagaatatccccatttctgacctgatccataaccagtacaaatatgagattgatcacatcctgcctctcagcctgtcctttgacgatagcctttctaataaggtcctggtgctcgccacagccaaccaggaaaagggacaacggacccccttccaggctctggactccatggatgacgcctggagctacagagagtttaaatcttatgtcaaggagtccaaactgcttggcaataagaaaaaggaatacctcctgacagaggaagatatcagcaagattgaggtgaaacagaagttcatcgagcgcaacctgattgacacgcggtactcctctagagttgtgctcaatgctctgcaggatttttataaagcccacaagttcgacaccacaatcagcgtcgtgcgcgggcaatttacctcccagcttagacggaaatggggcctggaaaagtctcgcgagacataccatcaccatgcggttgatgccctcattatcgctgccagctcccagctgagactgtggaagaaacaaaacaatcctcttatcgcttataaggaaggacagttcgtggacagcgagaccggcgaaattatctctctctccgacgatgagtacaaagagctggtcttcaaggccccctatgaccactttgtggatacgctgagctctaaaaccttcgaagactccattctctttagctaccaggtggattctaagttcaaccggaaaatcagcgacgcgacaatttatgccacccgcaaggctaagctggataaagagaagtccgaagagacatacgttcttgggaaaatcaaggacatctacagccaggccggatatgatgcttttattaaaatctacaataaggacaagtctaaattcctgatgtatcataaggatccgcaaacctttgaaaaagtcattgaggagatcctcagaacgtacccttccaaggaactgaacgacaaaaataaggagattccctgtaaccctttcgaaaagtatcggcaggagaacggccccatccgcaaatacagcaagaaatccaatgggcccgaaattaagtctctgaaatattacgataacaaacttggaaatcacatcgacatcacacctgagagctccgacaaccaggtggtgctccagtctctgaagccgtggagaaccgatgtctactttaatcaccaaacaaagaagtatgagctgatgggcctcaaatacagcgacctgtccttcgaaaaggggtctggcaaatatagcatttccaaccagaagtacaatagcatcaagcggattgagggaatcgatgaacagtctgagtttaaattcaccctttataagaacgacctgattctcatcaaagattccgagaataacgaacagaagctgtttcgcttcaatagcagaaacgacaccgccaaacattacatcgagctgaagccctatgataaagccaagttcgacggcgaacaagagcttattacaatcctggggaatgtggctaagggaggccggtgcctcaaagggctgaacaagtctaatatttccatctttaaagttaagacggatgtgctcgggaaaaagcacattatcaagaaagaaggcgacgagcctaagctgaaattctga

SEQ ID NO: 3946 - RNA, 3366 nt, synthetic construct
  misc_feature 1..3366: note = Cas9 variant
  source 1..3366: mol_type = other RNA
atgaacggcctggtgctcgggctggacatcggaattgccagcgtcggcgttgggatccttaataaggataccggagagattatccacacaaactccagaattttccccgctgccacggcggacaataacgtggaacggcgcaattctagacaggatcggcgcctgaacagacggaaaaagcatcgcggcgtgagactccacgacctgtttgaggattacgaccttctgaccgatttcagcaaagtctccatcaatctcaacccttatcggctgcgcgtgcaagggctggacaattctctcacaaccgaagaactgtttatcgctcttaagaacattgttaaaagacggggaatcagctacctggatgacgcctccgaagatggcggcgtggtctctagcgactatgggaaggccgtggaggagaatcgcaagctcctggctgaacagacaccgggacagattcagcttgagagattcaaaaagtacggccaagttagaggggattttaccgtggtcgaaaacggagagaaacgcagactgatcaatgtgttctccacaagcgcctatcggaaggaggctgaacggattctccgcaaacagcaggagtttaacaatcagatcaccgacaagttcattgaagactacctgaagatcctgacggagaaacggaagtattaccatggccccgggaacgaaaaatctagaaccgattacggacgctttcggacagacggcaccacactcgataacatcttcggcattctgatcgggaagtgcaccttttatcctaatgagtacagagcctccaaagcgagctatacggcccaagagttcaaccttctgaatgacctcaacaatctgacagtgcccaccgaaacaaagaaactttctgaggaacagaagaagaccattgtcgagtacgctaaatccgccaagaccctgggagctagcacactcctgaaatatatcgccaagatgattgatgcgtctgttgaccagatccgcggctaccgggtggatgtgaacaataaacctgaaatgcacacgtttgaggtctatagaaagatgcagtccctggagaccatcagcgtgtgggaactctcccgcaacattctggacgagcttgcccatatcctgacactcaataccgaacgggaggggattgaagaggctatcaacacaaagctgatggatgttttctctcaagaccaggtgcttgagctggtccagttccgcaaaaataacagctccctctttagcaagggatggcacaatttctctagaaaactgatgatggaactgattcccgagctctacgaaacctccgaggagcaaatgacgatcctgacacggcttggcaagcagaaaagcaaggaaacctctaagagaaccaaatacatcgatgagaaggaagtgacagaggaaatttataaccctgttgtggccaaaagcgtccggcaggctatcaagattatcaatgaggccaccaaaaagtacgggatttttgacaacatcgtgattgagatggcccgcgaaaacaatgaggaagacgctaagaaagattatatcaagagacagaaagcgaaccaagacgagaagaatgtcgccatcgaaaaagctgccttccagtacaacggaaagaaagagctgccggattccatttttcacggccataaggagctcgccacaaagatccggctgtggcaccagcagggcgaaaaatgtctgtatacggggaagaatattcccatctctgaccttattcataaccaatacaaatatgagatcgatcacatcctccctctgagcctgtccttcgacgatagcctctctaataaggtgctggttcttgctaccgccaaccaggaaaaaggacagagaacaccctttcaggcgctggactccatggatgacgcttggagctaccgcgagttcaagtcttacgtgaaggattccaaactcctgggcaataagaaaaaggactatctgcttaccgaagaggatattagcaaaatcgaggtcaagcaaaagtttattgaacggaacctcgtggacacaagatactcctctcgcgttgtgctgaataccctgcaggacttctataaagcccacaagtttgatacgaccatcagcgtcgtgagagggcagttcacatcccagctccggcgcaaatggggactggagaagtctagagaaacctaccatcaccatgccgtggacgctcttattatcgccgctagctcccaactgcggctctggaaaaagcaggccaaccctctgatcagctataaggaggatcagtttgttgactctgagacaggcgaaattatctccctgaccgatgacaaatacaaggagcttgtcttcaaagcgccctatgcccacttcgtggatacgctcagctctaagaaatttgaagactccattctgttcagctaccaagtggattctaagtacaatcgcaaaatcagcgacgctacaatttatgccaccagaaaggtcaagctggataaagacaagtccgaggaaacatacgtgctcgggaaaatcaaggatatctatagccaggctggctacgacgcctttattaaaatctataacaaggacaagtctaaattcctgatgtaccataaggatccgcagacctttgagaaagttattgaggaaatccttcggatttatccttccaaggagttcaatgagaaaaacaaggaggtgccctgcaacccttttgaaaagtaccgccaggagaatggacccatctgtaaatacagcaagaaaggcaacgggcccgagattaagtccctgaaatattacgacaagaatatccctgaatctttcatcgatattaccccgagcaactccaagaataaagtcatcctcagacaactgaacccctggcggacagacgtgtattttaatcaccagacggagaagtacgaactgcttggactcaaatatgcggatctgcagttcgagaagaaaaccgaaacatactctattaccatcgacaagtataacgagattaaggagaaagaaggcgttggggagcacagcgaatttaagttcacactgtacaaaaatgatctcctgcttatcaaggacatggagatcaaagaggaacagatttttcgcttcctgtccagaaccatgcctaacaagaaacattacgtggagctcaagccctattacaagggaaatttcgaaggcaaagagcggatcaaggtctttaacacgacatctaatgggagatgcctgaaaggcctgggaaagaaaggccttagcatttataagatcaagaccgatgtgctggggaacaaacacttcattaagaaagaaggagagaagcctaaactcaagttttga

SEQ ID NO: 3947 - RNA, 3366 nt, synthetic construct
  misc_feature 1..3366: note = Cas9 variant
  source 1..3366: mol_type = other RNA
atggacagaaccgaggtgaacatcggcttcgatattgggatcagctccgtcggatggtctgttgtggccacaaagagcggccggattctggaatccggggtgtctctctttagcggagcttccgccgcgaaaaatgaggaacgcagaaacttccggcagtctcgcagactgcttcggcgcagaaagaatcggatcagcgacctgaaaaagtacctcaaagagcaatcctttacgtataacggcgaactgcttaatgagaacccctacgagattcgcgtcaaggggctgaccgaaaagctcagcaaagaggaaatcgctctggccctgctccacatcgtgaagagacggggagtttcttatgatctgggcgacattgaggaggaaggcacaaccgggtcctacaaagagggagtgaagaaaaatcagaaacttctgaaggaaaagacccctgccgagatccagttccagcgcctcaagaaatttcataaggtcagaggccaaattgctatcgatgaaaacgacgtgctgcttaatgttttcccgaaccacgcctatgtggatgaggctcagcagattctgtacacacagcaagagttttatcccgaaatcaatgagacattcattaaccaggtcaccgactttatcagccggaaacgcgattacttcatcgggcctggatctgaaaagtccagaacggactacggcatttatcggaccgatgggacaaccctccagaatctgtttagcatcctgattggaaaagacaagatcttccccgatgagtttagagccgcgggcaactcttacacagcccaggtgtataatctcctgaacgaccttaacaatctggctattgacgataccgaaacgggcaagctcacaaaacaacagaaggagaaaatcatcatggagctgaagaccacagaaaaatccgtgaacatgatgaaacttattgccaagaccgctggggtcaccgttgagcagatcagccgctaccggattaatagagacggaaagtccgaaatccataacatggccgtgtatcgcaagattcggaaagtgttcctggagctcggctacgaaatcaatgagtggccttctcaactgctggatgagctcggggacgcgctgagccttaacacagaaaatggagagatcagacgcattctgacggataacctcgccaataagtataaaatcctggaccagcagcttattaacctgatcattgaaaataagaacgctttcaccctctccacaaatcagaagtggcaccggtttagctacaaaaccatgaagatcctgattcccgagctgctcgagacaaacaaagaacaaatgaccatcctgacggagatgggccttatgaagaaagatcagagaaattacgtcgggaagaacaagatcgactctgaagccctgctcgagaacctgtataatcctgtggttcgcaaatccacacggcagaccatgaagctgttcaacacccttctcaaaaagtacccgaatattgcttatgtggtcatcgaaatgcccagagaggatgacgaggataaagcccgccgggactacgtgaagtttcagaaagacaacgaaaaggagaaggatgccgctctgaaaaatttcattatggaaagcggaaagtctgaggcggaagttatcgccaaatatagacaaagcaagaaatttcggtccaaggtgcgcctgtggtaccagcagatgggcagatgcctctattctggcaaggctatgcctgccgagcgggtcttcagagacgatcattttacagacattgatcacgtgatccccctgagcgtctccttcgacgatgggatgaacaataaagtgctttgtctggccgagatgaaccgccagaaggacaaacaaaccccttacgcctttttcaatgctggacacggccaggggtttcaggcgatgaacgctatgctcaagaataacaatcggatcagctctgccaaaaagagaaacctgctgttcacagaaaatcttaacgatctcgaggttcgcaagagatttattgaacggaacctggtggacacgcgctacgcctccagagtcgtgctgaatgagctccagcaattcgttaaagctaagcagctggataccaaagtgacagtcatccggggaaagttcaccagcaaacttcgcgaaaagtggaacattaataagtctagagacacacatcaccatcacgccgtggatgctgccgtgatcgcggtttcccccatgctgaacctctgggagaaaggcgccagcattatcccgaataaggtcggggagaacgtgatcgacattaaaaccggcgaaatcattacggaccacgattatgaggctgacgtgtacgaactgccttatgccaagtttctggagcagatccccaaagtcaagaaagatattaagttccggcatcaagtggacaagaaaaagaatcgcaaagtttccgatgctaccatctacacaaccagaaaggccaaagtgggaaaggacaaggaggaaacagattatgtccttggcaccatcaaagacatttactctctcgaggggtatgtgagctttaagaaaatctacaacaaggataaagcgaagttcctgatggcccggattgaccctaagacgtttgaaaaactggagaagatcgttgctgaataccccgagtccattgaggtggtccaggataatggaaaagtggacgttcagaagatctctcccttcgaactctatcgcaaagataacggctttgtgacaaagttcgccaagaaaaataacgggcctgctgtcaagagcctgaaatactatgactccaaacttggaagctctattgacgtgaccccggataatgccaagaacaagaaggtgatcctgcagtccctcaaaccctggagaacagacgtctactttaatgaggaaaaccaagagtatgaaatcatgggcctgaagtacagcgatctgaaattcgggaagaacggcaaatatggagttcctaaggtgcggtacgaggagattaaacaggaagaggaaatctctgagggctccaagtttcttttcagcctctacagaggggaccgcattaaggtgaccaatgaactgggagagaacctggatctcctgttttctagccggacccttcccgcccagaaaggctatgtcgagctgaagcctatcgacaaaacaaagttcgatgggaaagaaaaggtgtccttctacggaacggttacccccaatggccagtttgtgaagaaattcgctaagaaagggtataagattctcaaactgaacacagacgagctgggcaatacctacatcgaaaacggagagaaggagccgagcgatatccttgacatgtga

SEQ ID NO: 3948 - RNA, 3366 nt, synthetic construct
  misc_feature 1..3366: note = Cas9 variant
  source 1..3366: mol_type = other RNA
atgaacggcctggtgctcgggctggacatcggaattggcagcgtcggggttggaatccttaataaggataccggcgagattatccacgccaactccagaattttccccgctgccacagcggacaataacgtggtgcggcgctctagcagacaggggcggcgcctgaatcatcggaaaaagcacagatccgtccgcctcaaagatctgtttgaatactatgaccttctgacggatttctctaaggtgagcatcaacctcaatccttacagactgcgggttaacggactgaatcaacagctcaccaacgaggaactgtttatcgctcttaaaaatattgtgaagcgcagaggcatctcctatctggacgatgcctctgaggacggcggggccgtcagctccgattacggaaaggctgtggaagagaaccggaaactcctggccgagcagacaccgggccagattcaacttgaacgcttcgagaagtatgggcaggttagaggagactttaccgtggtcgaaaatggcgagaaacggcgcctgatcaacgtgttcagcacatctgcttacaagaaagaggccgaacggattctcagaaagcagcaggagtataataaccaaatcatggatgaatttattgcggactacctgaccatcctgacagggaagagaaaatactatcatggacccggcaacgagaagtcccgcaccgattacggccggttcagaacggacgggaccacactcgacaatatctttggcattctgatcggaaaatgcaccttctatcctgaaaagtaccgcgccagcaaagcctcttatacagctcaggagtttaaccttctgaatgatctcaacaatctgaccgtgcccacggagacaaagaaactttccgaagaacagaagaagaccattgtcgaatacgctaaaagcgccaagacactgggggcgtctaccctcctgaaatatatcgccaagatgattgacgcttccgttgatcagatccggggatacagagtggacgtgaaaaacaagcctgagatgcacaccttcgaagtctaccgcaagatgcaaagcctggagacaatctccgtgggcgagttttctcgggaagttctcgatgagctggcccatgtgcttacgctgaataccgaaagagaggggattgaagaggctatcaacacaaaactccgcgacagcttctcccaggatcagattctggagcttgtccaattccggaagaataacagctctctgttttccaaaggatggcacaatttcagcctcaagctgatgatggaactgatccccgagctctatgaaacctctgaggagcagatggccattctgacaagacttggcaaacagaagtttaaggaaaccagcaaacgcacgaagtacatcgacgagcaggaagtgacagaggaaatctataaccctgttgtggccaaatccgtccggcaagctattaagatcattaatgaggcgaccaaaaagtacggcatcttcgataacattgtgatcgagatggccagagaaaataacgaggaagaggctaagaaagactatattaagcggcagaaagccaaccacgatgaaaagaatgccgctatggagaaagccgcgtttcagtacaacggggagaaggaactgccggactctatcttccatggacacaaagagctcgctaccaaggtccgcctgtggcatcagcaaggcgaaaagtgtctgtatacagggaaaaatatccccattagcgaccttatccacaaccagtacaagtacgagattgatcacatcctccctctgtccctgagctttgacgattctctctccaataaagtgctggttcttgccaccgccaaccaggaaaagggacagagaacacccttccaagctctggacagcatggatgacgcctggtcttatcgggagtttaaatcctacgtgaaggatagcaagtccctcggcaataaaaagaaagactatctgctgacggaggaagatatttctaagatcgaggtcaaacagaagttcatcgaaagaaaccttgtggacacccgctacagctcccgggttgtgctcaatacactgcaggatttttataaggctcataaattcgacaccacaatttctgtcgtgagagggcagtttaccagccaactgcgcagaaagtggggcctcgagaaatcccgggagacgtaccaccatcacgccgtggatgcgctgatcattgccgctagctctcagcttcgcctgtggaagaaacagaacaatcctctcatctcctataaggaaggacaattcgttgacagcgagaccggcgaaattatctctctgacagacgatgagtacaaggaactggtcttcaaagccccctacgaccattttgtggatacccttagatccaagaaattcgaggacagcatcctcttttcttatcaggtggatagcaagttcaaccggaaaatttccgacgctacaatctacgccacccgcaagacgaaactggataaggacaagagcgaggaaacatatgtcctggggaaaattaaggatatctactctcagtccggatatgacgcgtttattaaaatctacaataaggataaaagcaagttcctcatgtatcacaaggacccgcagacctttgagaaagtgatcgaagagattctgagaacatacccttccaaggagttcaacgagaaaaataaggaggtttcttgcaacccctttgaaaaatacaagcaagagaacggccctatccggaagtatagcaaaaaggggaatggacccgaaattaaatcccttaagtactatgataaaaacatccccgagtctttcattaatatcacccctagcaactccaagaataaggtgattctgcgccagctcaacccgtggagaaccgacgtctactttaatcaccagacagaaaaatatgagctgctgggccttaagtacgccgacctccagttcgagaaaaagacggggacctattctatcacaatcgataaatacaacgaaattaaggagaaggaaggcgtgagcgagcattccgagtttaaattcaccctgtacaagaatgacctgctcctgatcaaagatacagaaattaaggaggaacaaatcttccggtttcttagccgcaccatgcccaaccagaaacactatgttgagctgaagccttactataaaggaaatttcgaaggcaaggagagaattaaggtgtttaacacgacatctaatgggcggtgtctcaaaggactgagaaagaaaggcctgtccatctacaagatcaaaaccgacgtccttgggaacaagcatttcattaagaaagagggagaaaagcccaaactgaagttttga

SEQ ID NO: 3949 - RNA, 3366 nt, synthetic construct
  misc_feature 1..3366: note = Cas9 variant
  source 1..3366: mol_type = other RNA
atgagcgacctggtgctcggcctggatatcgggattggatccgtcggcgttgggatccttaacaaggtgaccggagagattatccacaaaaattctagaattttccccgccgctcaggccgaaaacaatctggtgcggcgcacaaacagacaaggccggcgcctcacgagacggaagaaacatcgcatcgtcagactgaatcggctttttgaggaaagcgggctgatcaccgacttcacaaagatttccatcaacctcaatccttaccagctgcgcgtgaaaggactgaccgatgagctctctaacgaagaactgtttattgcgcttaagaatatggttaagcacagaggcatcagctatctggacgatgcttccgacgatggcaactctagcgtgggggactacgcccagattgtcaaagagaatagcaagcagctcgaaacaaaaaccccgggacaaatccagctggagcggtatcagacatacggccagcttcgcggggatttcaccgtggaaaaggacggaaagaagcatagactgattaacgtttttcccacgagcgcctatcggtctgaggctctccgcatcctgcaaacccagcaggagttcaatcctcagatcacagatgaatttattaacagatacctggagatcctcaccggcaagcggaaatattaccacgggcccggaaatgaaaagtccagaacagactacggccgctatcggaccagcggcgagacgctggataacattttcgggatccttattggaaaatgcacattttaccctgacgagttcagagccgctaaggcctcttataccgcgcaagagtttaacctgctcaatgacctgaacaatcttacagtgcccaccgagaccaaaaagctgtccaaagaacagaagaaccagatcatcaattacgtcaagaacgagaaagccatgggccctgctaaactcttcaaatatattgccaagctgctgagctgtgatgtggctgacatcaaagaataccgcattgataagtctgggaaggccgagatccatacatttgaagcgtatcggaaaatgaagacgctcgagaccctggacattgagcaaatggatagagaaacacttgacaaactggcctacgtgctcaccctgaatacagagcgcgaaggaatccaggaggctcttgaacacgagttcgccgatggctccttcagccagaagcaggtcgacgagctggttcaatttcggaaagctaactcctctatcttcgggaagggatggcacaattttagcgtgaagctcatgatggaactgattccggagctgtacgaaacctccgaggagcagatgacgatcctcacaagactgggcaaacagaagaccacctcctcttccaacaaaacaaagtatattgatgaaaaacttctgaccgaggaaatctacaatcccgtggtcgccaagagcgtgcgccaggccattaagatcgttaacgctgcgattaaagagtatggcgacttcgataatatcgtgatcgaaatggcccgggagacaaacgaggacgacgaaaagaaagctattcaaaagatccagaaagccaataaggatgagaaagacgccgctatgctcaaggccgcgaaccagtacaacgggaaggctgaactgcctcattctgtctttcacggacataaacagctggccacgaagattagactttggcaccaacagggcgagcgctgcctctataccgggaaaacaatcagcattcacgatctgatcaataactccaatcagttcgaagtggaccatatcctgcccctctctattacctttgatgacagcctggccaacaaggttcttgtgtacgctacagccaatcaggagaaaggacaacggaccccttatcaggctctggattccatggacgatgcctggagcttcagagagctcaaggcgtttgtccgggaatctaagacgctgtccaacaaaaagaaagagtacctgcttaccgaagaggacatcagcaagttcgatgtgcgcaaaaagtttattgaaagaaatctcgtcgacacacggtacgcctctagagtggttctgaacgctctgcaggagcacttccgcgcccataagatcgataccaaagtgtccgtcgtgcggggccaatttacaagccagctcagacgccactgggggattgagaagaccagagacacgtatcatcaccacgctgttgacgccctgatcatcgcggcctccattcagcttaatctgtggaaaaagcagaaaaacacactcgtgtcttacagcgaagatcaactgctggacatcgagaccggcgaacttatttccgatgacgagtataaggagtctgtcttcaaggctccctaccagcatttcgtggatacactcaaaagcaaggaatttgaggactccatcctgttcagctatcaggtggattctaaatttaatcggaagatttccgacgccaccatctacgctacccgccaggccaaagttggaaaggataaagccgacgaaacatatgtcctgggcaagatcaaggatatttacacgcaagacgggtacgatgctttcatgaaaatctataagaaagacaagagcaaatttctcatgtacagacacgacccgcagaccttcgagaaggtgattgaacctatcctggagaactatcccaataagcagattaacgagaaaggaaaggaagtgcctgtcaatccctttcttaaatacaaggaggaacatggctatatccggaaatactctaagaaggggaacggacccgagattaaatccctgaagtattacgatagcaaactcggcaaccacatcgacatcacacctaaggattctaataacaaagtggttctgcagagcgtgtccccgtggcgcgcggacgtctacttcaataagaccacagggaagtatgaaattctgggccttaaatacgccgatctccaatttgagaagggaaccggcacgtataaaatcagccaggagaagtacaacgacattaaaaagaaggaaggggtggattctgactccgagttcaaatttacactgtataagaatgatctgctcctggttaaagacaccgaaaccaaggagcagcaacttttcagatttctgagccggacaatgcccaaacagaagcactacgtggaactcaaaccttatgataagcagaagttcgagggaggcgaggctctgatcaaagtcctggggaacgtggccaattccggacagtgtaagaaaggccttgggaagtctaacattagcatctacaaagttcgcaccgacgtgctgggcaatcaacatatcattaagaacgaaggagacaagcccaaactcgatttctga

SEQ ID NO: 3950 - RNA, 3366 nt, synthetic construct
  misc_feature 1..3366: note = Cas9 variant
  source 1..3366: mol_type = other RNA
atgaacggcctggtgctcgggctggacatcggaattgccagcgtcggcgttgggatccttgagaaaaattccggaaaaattatccacgctaactctagactgttccccgccgcgaccgctgataataacgtggaacggcgcaagaatagacaggcccggcgcctcaacagacggaaaaagcatcgcggcgtgagatttcaagacctgttcgaggattacgggcttctgacagactttagcaaagtctccattaatctcaacccttatcggctgcgcgtggatggactgaatcagcagctcacgaacgaagaactgttcatcgcccttaagaatatcgttaagagacggggcatttcttacctggacgatgctagcgaagacggcggggccgtgtcctctgattatggaaaagctgtcgaggagaaccgcaagctcctggccgaacagaccccgggccaaatccagcttgagagatttgaaaaatacggacaggtgcggggagacttcacagttgtggagaatggcgagaagtgccgcctgattaacgtctttagcacctccgcgtatagaaaagaagccgagaagatcctccggaagcagcaagagttcaataaccagattacagatgagtttatcgaagactacctgaaaattctgaccgggaagagaaaatattaccacggacccggcaacgaaaagagccgcacagattacggccggttcagaaccgacgggacgaccctcgacaatatctttggagtgctgatcggcaaatgtacattctatcctaacgagtaccgcgcttctaagtccagctataccgcccaggaatttaatcttctgaacgatctcaataacctgacagtgcccaccgagacgaaaaagctgtctgaagaacagaagaaagtcattgttgaatacgctaaggaggccaaaacacttggggcgtccaccctcctgaagtatatcgtgaaaatgattgacgccagcgtggatcaaatctctggataccgggtcgacgtgaataacaagcctgagatgcatacattcgaagtttatagaaagatgcagtccctggagaccattagcgtgggcgaactctcccgcaatgtcctggatgagcttgctcacatcctgaccctcaacacagaacgggaggggatcgaggaagccattaattctaaactgatgggagtgttcagccaggaccaagttcttgagctggtgcagtttagaaagaacaattccagcctcttctctaaaggctggcataacttttccctgaagctgatgatggaactcatccccgagctgtacgagacgagcgaggagcagatgaccattcttacacgcctgggcaaacagaagtctaaggaaaccagcaaacggacaaagtacatcgatgagaaagaactcaccgaggagatttataatcctgtcgtggctaagtccgtcagacaagccatcaaaatcattaacgaagccacgaagaagcacgggatcttcgacaacattgtgatcgagatggctcgcgaaaataacgaggaagatgcgaaaaaggactacattaaacggcagaaggccaatcaggatgagaaaaacgctgccatggagaaggccgcttttcagtataatggaaagaaggaactgccgggcaacatcttcaatgggcacaaggagctggccacaaaaattagactttggcatcaacagggagaaaagtgcctctacaccggcaaaaccatccccatctctgacctgattcacaaccagtataagtacgagatcgaccatattctgcctctcagcctgtcctttgatgacagcctttctaataaagttctggtgcacgcgacagctaaccaggaaaaggggcaacggacccccttccaggccctcgattccatggacgatgcctggagctatcgcgagtttaagtcttacgtcaaagacctgaagtccctgagcaataaaaagaaagattaccttctcacagaggaagacatctccaagattgaggtgaagcagaaattcatcgaaagaaacctggttgatacgcggtattctagcagagtggtcctgaatgctctccaggacttttacaagtcccaccaattcgataccacaatctctgtggtgcgcggccagtttaccagccagctgcggagaaaatggggacttgagaagtcccgcgagacatatcatcaccatgccgttgacgctctgattatcgccgcgagctctcaactcagactgtggaaaaagcagaacaatcctctgattacctacaaggaaggccagttcgtcgattcccagacgggggagatcattagccttaccgacgacgaatataaagagctcgtgttcaaggccccctacgatcactttgtggacacactgcattctaaaaccttcgaagatggaatcctgttttcctatcaagtcgacagcaagtacaaccggaaaatctctgatgctacaatttacgccacccgcaaggctaaactcgacaaggataagagcgaggagacgtatgtgctgggcaaaatcaaggacatttactcccaggccgggtatgatgcgttcatcaaaatttacaacaaggacaaaagaaagtttcttatgtatcacaaggatccgcagacattcgaaaaagttatcgaggaaatcctgcggacctaccctagcaaggagcgcaatgacaaaaacaaggaagtgccctgtaatccttttgagaaatatagacaggagaacggacccattcggaagtactctaagaaaggcaatgggcccgaaatcaagtgcctcaaatactatgataacaagctgggcaattacattgacatctcccctgacggaagcgataaccaagtcgtgctgcagtcccttaaaccgtggcgcacagacgtttatttcaatcaccagaccaaggagtacgaactcatgggcctgaagtattctgatctgagctttgagaaagggtccggaaagtactctattagcaacgaaaaatataattccatcaagagaattgagggcgtgaacgagcagtctgagttcaaatttaccctctacaagaatgacctgatccttatcaaggatagcgagaacaatgaacaaaaactgttccggtttaactcccgcaacgacacagccaagcattacgtcgagctcaaaccctatgataaggctagattcgacgggcagcaggagctgattacgatcctgggaaatgtggccaaaggcgggcaatgtcttaagggcctgaacaaaagcaatatttctatcttcaaggttaagaccgatgtgctcgggaaaaagcacattatcaaaaaggaaggcgacgagcctaaactgaagttttga

SEQ ID NO: 3951 - RNA, 3366 nt, synthetic construct
  misc_feature 1..3366: note = Cas9 variant
  source 1..3366: mol_type = other RNA
atggccgacaagaccctgggcgctctcacattcgggtttgatatcggaattgccagcgtgggctggtgcgtcctgggggagaacagaatcgttgaccttggagtgcgggcgttcgataaagctgaaacggccaaggagggcgaatccctgaatctcgcccgcagaaccgctcggctgatgcgcagacggcttcgcagacgggcctggcgcctgacaaaactcgctagactgctgaagcgggaggggctcattgccgacgcgtttcagatgcaccaaccctctgccaccagcccttggaaactgcgcgtggaagctcttgatagacggctgacagacgatgagtgggcccgcgtcatctaccatctctgtaagcacagaggattccattggatttcccgggctgaggaaaagaaagccgagggcgacgcgaagggcgaatctgggagagtgaaaaagggactgagcgatacccagcgccggatgggcgagaaagggtatagatccgccgctgagatggttcttgccgaatttccggaggctcagcgcaacaagcagggagactacggcaaggccctgtctcgggtgctcctgagcgaagaactggccctcctgttcagacgccaacgggaacttgggcacacacatgcttccaaagagctggaggcggccatcctcggaaatggcgatagaaagggcgggctgttttgggctcagaaaccccctcttgccggagccgacctgctcaagatgctgggcaaatgcaccttcgaaaaggatgagtatcgcgctcccaaagccagctttacggcggaacggcacgtctggctgaccagactcaacaatctgcgcgtggttgtggacgggacaacccggcctcttacagaggacgaaagacgggtcgctctgcccctcccttacggatatgccgatgccaagctgacctacaagcagcttcgcgctgccctgtctaaagctggcctctccaacttcagctttgccgggatcgcggacgataaggagaaagacacgctgacaaagctgccggcctgggagaccctctctaaaacactgaagggaaagggccttgaaaccgagtgggaaggcatggctggggccgctaccggaggcgatcccacactgctcgacgagatttccagagtgctgagcgtgtataaagatggggacgaagtcgatgttgagctgcggaagctccctctccccggaggcgagaaaatggtggaaacgctgtctgagatctccttcgacaagtttcacgccctgagcctcaaagcgctgagaaagattgtgcctcatatggaaaccgggcttcgctacgatgaggcctgtgctgccgctggctaccaccattcccagctgcacgaggccggagccggcgggcaaaagtatcttcccccgttctacacacggagagacaaagacggacgcatggtcttcgatgaggagctggacgtgcctagaaatcccgttgtgctgcgggctcttaaccaggcgcgcaaggtcctcaatgccctggtgagagcttatggctctcctagcgccgttcacatcgaaatggcccgggatctgtccaaacccctcgtggggcatcccacccctaacggaggctacattgaggggcgcagagacatcgaaaagctgcagaaagagtatcgggagcgcaatgaaaaggataaggctgcctttgcggctgagcacggcattgccgccaaaagcagagagttcgaaaagtttcagctttaccgggaacaacagggaaaatgcgcttattctctgaagccgctcgacctgcatcgcgtcctgcacgatatcggctacgccgaggtggaccatgcgcttccctactccagaagctatgatgacgggaaaaacaataaggtcctcgtgctgacagaggaaaaccggaataaaggaaacagaaccgcttacgagtatctgtgtgccttccctggcggggaaaacggagagcgctggcggaattttgttgcctacgtggaatctaacaagagctatagactcgctaagcgcacgcggctgcttagaaaagatttcggcgggaaggccgctgaggagtttcgcgaacggaatctgaacgacacaagatacatctgcaaattctttaagaatttcgtcgagcgctttctccagctgaaagtgggcgccgatggaaccgcggccaagcggtgtgttgtgctgtccggccaaaccacagctttccttagagcccggtgggggctcctgaaggtccgcggagcttctgacagacaccacgccctggacgccgctgtggtggcggcctgcagccatggcatggttaaacggctcgctgattattcccgcaccaaggaactggccaaagtcagagacgggtttcccgatcctgagacaggagagattgtggaccccgccatgttccagcagcttcacgctcatttcccggatccttggccccactttcggggcgaactggaggccagactccagctggacgatagcgcggaactgcgcgctcaacttgagatgttcgggacgtaccctgccgaagccctggagaccctccggcccctgtttgtgtctagagctcctcagcgccggaacggcggagccgcgcacaaggagacaatctacgctcagcccgaaagactcaaagagcagggcggggtcacccaaaaggtgtccctggccagccttaagccgacagacattgataaactgatcgaccctcatcgcaatgaaaagctctatgccgctattcgggccagactggaggctcacggaggcaaatctgataaggccttccccgcggacaaccccctgcgcaaacctgatagagacgggaatccgaccggacccatcgttcgggccgtgacgatggtcatcgacaaactttccggcattcagatccgcggcgggattgctaagaacgataccatgctgagagtggacgtttttcggcataagaaggatggaaaattccacctcgtgcctctgtacgtccatcacgccgtggctcaggaactccccaatcgcgccatcgttgcctttaaggacgaggatgagtggacactgattgacgataacttccactttcttttcagctttcatcctaatgacttcatcagaatcacccagaaaaacaaggctcccattctgggctattacgcgtcctgtcaccgggggacaggaaatctcaacctgtgggcccatgatagaaaccaaaaagtgggcaaggacgggcagatcgaaggaattggcgtcaagaccgctgtggccctggagaaatttcacgtggatgtccttggcaatatctatcctgctcccccggaacagcgccatgggctggcctga

SEQ ID NO: 3952 - RNA, 3366 nt, synthetic construct
  misc_feature 1..3366: note = Cas9 variant
  source 1..3366: mol_type = other RNA
atgagcgacctggtgctcggcctggatatcgggattggatccgtcggcgttgggatccttaacaaggtgaccggagagattatccacaaaaattctagaattttccccgccgctcaggccgaaaacaatctggtgcggcgcacaaacagacaaggccggcgcctcacgagacggaagaaacatcgcagagtccggctgaatcgcctttttgaggaaagcgggctgatcaccgacttcacaaagatctccattaacctcaatccttaccagctgagagtgaaaggactgaccgatgagctctctaacgaggagctgtttatcgcgcttaagaatatggttaagcaccggggcattagctatctggacgatgcttccgacgatggcaactctagcgtgggggactacgcccagatcgtcaaagaaaattccaagcagctcgaaacaaaaaccccgggacaaattcagctggagcgctatcagacatacggccagcttagaggggatttcaccgtggaaaaggacggaaagaagcatcggctgatcaacgtttttcccacgagcgcctatcgctctgaggctctccggattctgcaaacccagcaggagttcaatcctcagatcacagatgaatttatcaacagatacctggagattctcaccggcaagagaaaatattaccacgggcccggaaatgaaaagtcccgcacagactacggccggtatagaaccagcggcgagacgctggataacatcttcgggattcttatcggaaaatgcacattttaccctgacgagttccgcgccgctaaggcctcttataccgcgcaagaatttaacctgctcaatgacctgaacaatcttacagtgcccaccgagaccaaaaagctgtccaaagaacagaagaaccagattatcaattacgtcaagaacgagaaagccatgggccctgctaaactcttcaaatatatcgccaagctgctgagctgtgatgtggctgacattaaagggtaccggatcgataagtctggaaaggccgaaattcatacatttgaggcgtatagaaaaatgaagacgctcgaaaccctggacatcgagcaaatggatcgcgagacacttgacaaactggcctacgtgctcaccctgaatacagaacgggagggcattcaggaagctcttgagcacgagttcgccgatgggtccttcagccagaagcaggtcgacgaactggttcaatttagaaaagctaactcctctatcttcggaaagggctggcacaattttagcgtgaagctcatgatggagctgatcccggaactgtacgagacctccgaggaacagatgacgattctcacacgcctgggcaaacagaagaccacctctagctccaacaaaacaaagtatatcgatgagaaacttctgaccgaagagatttacaatcccgtggtcgccaagagcgtgcggcaggccatcaagattgttaacgctgcgatcaaagaatatggggacttcgataatattgtgatcgagatggccagagaaacaaacgaggacgacgagaagaaagctatccaaaagattcagaaagccaataaggatgaaaaagacgccgctatgctcaaggccgcgaaccagtacaacggaaaggctgagctgcctcattctgtctttcacggccataaacagctggccacgaagatccgcctttggcaccaacagggggaacggtgcctctataccggaaaaacaattagcatccacgatctgattaataactccaatcagttcgaggtggaccatatcctgcccctctctatcacctttgatgacagcctggccaacaaggttcttgtgtacgctacagccaatcaggaaaaaggccaaagaaccccttatcaggctctggattccatggacgatgcctggagcttccgggagctcaaggcgtttgtccgcgagtctaagacgctgtccaacaaaaagaaagaatacctgcttaccgaggaagacattagcaagttcgatgtgcggaaaaagtttatcgagagaaatctcgtcgacacaagatacgcctctcgcgtggttctgaacgctctgcaggaacacttccgggcccataagattgataccaaagtgtccgtcgtgagagggcaatttacaagccagctccgcagacactggggcatcgagaagacccgggacacgtatcatcaccacgctgttgacgccctgattatcgcggcctcctctcagcttaatctgtggaaaaagcagaaaaacacactcgtgagctactccgaggatcaactgctggacatcgaaaccggagagcttatttctgatgacgaatataaggagagcgtcttcaaggctccctaccagcatttcgtggatacactcaaatccaaggagtttgaagacagcatcctgttctcttatcaggtggattccaaatttaatcgcaagattagcgacgccaccatctacgctaccagacaggccaaagttggcaaggataaagccgacgagacatatgtcctggggaagattaaggatatctacacgcaagacggatacgatgctttcatgaaaatctataagaaagacaagtctaaatttctcatgtaccggcacgacccgcagaccttcgaaaaggtgattgagcctatcctggaaaactatcccaataagcagattaacgagaaaggcaaggaggtgccttgtaatccctttcttaaatacaaggaggaacatgggtatatccgcaaatactccaagaagggaaacggccccgaaattaaaagcctgaagtattacgattctaaactcgggaaccacatcgacattacacctaaggatagcaataacaaagtcgtgctgcagtccgttagcccgtggagagcggacgtgtacttcaataagaccacaggcaagtatgagatcctgggacttaaatacgccgatctccaatttgaaaagggcaccgggacgtataaaatctctcaggagaagtacaacgacattaaaaagaaggagggagtcgattccgacagcgagttcaaatttacactgtataagaatgatctgctcctggtgaaagacaccgaaaccaaggaacagcaacttttccggtttctgtcccgcacaatgcccaaacagaagcactacgttgagctcaaaccttatgataagcagaagttcgaaggcggggaggctctgatcaaagtgctgggaaacgtcgccaattctggccagtgcaagaaagggcttggcaagagcaacatttccatctacaaagtgagaaccgacgttctgggaaatcaacatattatcaagaacgagggcgacaagcccaaactcgatttctga

SEQ ID NO: 3953 - RNA, 3366 nt, synthetic construct
  misc_feature 1..3366: note = Cas9 variant
  source 1..3366: mol_type = other RNA
atgaacggcctggtgctcgggctggacatcggaattggcagcgtcggggttggaatccttaataaggataccggcgagattatccacgccaactccagaattttccccgctgccacagcggacaataacgtggtgcggcgctctagcagacaggggcggcgcctgaatcatcggaaaaagcacagatccgtccgcctcaaagatctgtttgaatactatgaccttctgacggatttctctaaggtgagcatcaacctcaatccttacagactgcgggttgacggactgaaccaacagctcaccaatgaggaactgtttatcgctcttaaaaacattgtgaagcgcagaggcatctcctatctggatgacgcctctgaggatggcggggccgtcagctccgactacggaaaggctgtggaagagaatcggaaactcctggccgagcagacaccgggccagattcaacttgaacgcttcgagaagtatgggcaggttagaggagattttaccgtggtcgaaaacggcgagaaacggcgcctgatcaatgtgttcagcacatctgcttacaagaaagaggccgaacggattctcagaaagcagcaggagtataacaatcaaatcatggacgaatttattgcggattacctgaccatcctgacagggaagagaaaatactatcatggacccggcaacgagaagtcccgcaccgactacggccggttcagaacggacgggaccacactcgataacatctttggcattctgatcggaaaatgcaccttctatcctgaagagtaccgcgccagcaaggcttcttatacagcccaggagtttaatcttctgaacgacctcaataacctgaccgtgcccacggaaacaaagaaactttccgaggaacagaaaaagaccattgtcgagtacgctaagagcgccaaaacactgggggcgtctaccctcctgaagtatatcgccaaaatgattgatgcttccgttgaccagatccggggatacagagtggatgtgaataacaagcctgaaatgcacaccttcgaggtctaccgcaaaatgcaactgctcgagacaatccccgtgggcgaatttagccgggaggttctggacgaacttgcccatattctgacgctcaataccgagagagaagggatcgaggaggctattaacacaaagctgatggatgtgttctcccaggaccagatccttgaactggtccaattccgcaagaataactctagcctcttttccaaaggatggcacaatttcagcctgaagctgatgattgagctcatccctgaactgtatgagacctctgaggaacagatggccatccttacacggctgggcaaacagaagtttaaagagacctccaagagaacgaagtacattgatgaacaggaggtgacagaagagatctataacccggttgtggccaaaagcgtccgccaagctattaagatcattaatgaggcgaccaaaaagtacggcatcttcgacaacattgtgatcgaaatggcccgggagaataacgaagaggaagctaaaaaggattatatcaagagacagaaagccaaccacgacgagaagaatgccgctatggagaaagccgcgtttcagtacaacggggaaaaggagctccccgactctattttccatggacacaaagaactggctaccaaggtccggctgtggcatcagcaaggcgagaaatgtctttatacagggaagaatatccctattagcgatctcatccacaaccagtacaagtacgaaattgaccacatcctgcccctgtccctctcttttgatgacagcctgtccaataaagtgcttgttctggccaccgccaaccaggagaagggacgcagaacacctttccaggctctcgatagcatggacgatgcctggtcttatcgggagtttaaatcctacgtgaaggacagcaaatctctgggcaataagaagaaagattatctgcttacggaagaggacatctccaagattgaagtcaaacaaaagttcatcgagagaaacctcgtggatacccgctacagctcccgggttgtgctgaatacactgcaggacttttataaagctcataagttcgataccacaatttctgtcgtgagagggcagtttaccagccagctccgcagaaagtggggcctggagaaatcccgggaaacgtaccaccatcacgccgtggacgcgcttatcattgccgcttctagccaactgcgcctctggaagaaacagaacaatcccctgatctcctataaggagggacagttcgttgacagcgaaaccggcgagatcatttctctgacagatgacgaatacaaagagcttgtcttcaaggccccgtacgatcattttgtggacaccctcagatccaagaaattcgaggatagcatcctgttttcttatcaagtggactccaagttcaaccggaaaattagcgatgctacaatctacgccacccgcaaggcgaaactggacaaggataaatctgaagagacgtatgtcctcgggaagattaaggacatctacagccagtccggatatgatgcctttatcaaaatttacaataaggacaaaagcaagttcctgatgtatcacaaagatcctcagacatttgaaaaggtgatcgaggaaattcttagaacctacccctctaaggagttcaacgagaaaaataaggaagtttcctgcaacccttttgagaaatacaagcaggaaaacggccccatccggaaatatagcaagaaggggaatggacccgagattaaatccctgaagtactatgacaaaaacatccctgaatctttcattaatatcacaccgagcaactccaagaataaagtgatcctccgccaactgaacccctggagaaccgacgtctactttaatcaccagaccgagaagtatgagctgcttggcctcaagtacgctgatctgcagttcgagaaaaagacagggacgtattctattaccatcgacaaatacaacgagattaaggaaaaagagggcgtgagcgagcattccgaatttaagttcacactgtacaagaatgatctcctgcttatcaaagacaccgagattaaggaagaacagatcttccggtttctgtctcgcacaatgcctaaccaaaaacactatgttgaactcaagccctactataaaggaaatttcgagggcaaggagagaatcaaagtgtttaacaccacgagcaatgggcggtgtctgaagggactgagaaagaaaggcctttccatttacaagatcaaaacagatgtcctggggaacaagcatttcattaaaaaggaaggagagaagcctaaactcaagttttga

SEQ ID NO: 3954 - RNA, 3369 nt, synthetic construct
  misc_feature 1..3369: note = Cas9 variant
  source 1..3369: mol_type = other RNA
atgaacggcaagatcctggggctcgacattggagtggccagcgtcggcgttgggatcctggataaaaagaccggagaaattatccacgcttcctctagaattttccccgccgcgacagctgacagcaatgtggaacggcgcggctttagacaggggcggcgccttggaagacggaaaaagcatcgcaaagtgagactggccgatctcttctccgacacgggcctgatcaccgatttttctaaggtcagcatcaaccttaatccttacgagctgcggattaagggcctcaacgaaaaactgacaaatgaggaactgttcatcgccctcaagaacattgtgaaacgcagagggatctcctatctggacgatgctaatgaggacggagagtctagctccagcgaatacggcaaggccgttgaggaaaaccggaaacttctggctgataagaccccggggcaaattcagctcgagcgctttgagaagtatggacaggtgagaggcgacttcacaatcgaagagaatggggaaaaacaccggctgcttaacgtcttttctacctccgcctacaagaaagaggcggaacgcattctgacaaagcagcaagattataatcaggacatcaccgatgagttcatccaggcctacctcacgattctgaccggaaaaagaaagtattaccatggccccggcaacgagaaaagccggacagactacgggagatttcgcaccgacggaacaaccctggataatatcttcggcattctcatcgggaagtgcacgttttatcctgaagagtaccgggctgccaaggcttcttatacagcccaggagttcaacctgcttaatgacctgaacaacctcaccgtgcccacagagaccaaaaagctgtccgaagaacaaaagagacagattatcgagtacgcgaagggagccaaaacccttggcgctgccacactgctcaagtatatcgctaagctggttgatgggagcgtggaagacattaaaggataccgcatcgataagtctgagaaacctgaaatgcacacgtttgacatttatcggaagatgcagaccctggagacagtcgatgtggaaaaactctccagagaggtgctggacgagcttgcccatatcctgaccctcaatacagaacgcgagggcattgaagaggccatcaaggtcagcttcatcaagcgggagttcgaacaggatcaaattgctgagctggtttcctttagaaaatctaacagctcccttttcggcaaggggtggcacaattttagcatcaaactgatgaccgaactcattcccgagctgtacgaaacgtctgaggagcagatgacaatcctgacccgcctcggaaagcagaaaaccaaggcgcggtccaagagaacaaaatacattgacgaaaaggagctgaccgatgaaatctataaccctgtggtggccaaaagcgtccgccaagctattaagatcatcaatcttgccacgaaaaagtacggcgtgttcgacaacattgttatcgagatggcccgggaaaataacgaggaggacgctaaaaaggattatgtgaagagacagaaagccaatgaagacgagaagaacgcggctatggaaaaagccgcccaccagtacaatgggaagaaagagctgccggataacgtctttcatggacacaaggaactcgctacaaagattcggctgtggcatcagcaaggcgagaaatgtctgtataccgggaagaatatccccatttctgaccttatccacaaccagtacaaatatgagatcgatcacattctccctctgagcctgtccttcgacgattctctcgccaataaggtgctggttcttgctacagccaaccaggaaaaaggccagcgcaccccctttcaagcgctggacagcatggatgacgcctggtcctacagagagttcaaggcttacgtgcggggagccagagctctcagcaacaagaaaaaggattatctgctgaatgaagaggacatcaacaaaattgaggtcaagcagaaatttatcgaacgcaatcttgtggatacacggtactcttccagagtcgtgctcaacgccctgcaggacttctataagctgaatgactttgataccaagattagcgttgtgcgcggccagttcacgtctcaactcagacggaaatggcgcatcgacaagtccagagagacctaccatcaccatgcggtcgatgccctgatcattgctgccagctcccagcttcggctgtggaaaaagcaggggaaccctctcatctcttataaagaaaatcagtttgtggacagcgagacaggagaaattatctccctgaccgatgacgagtacaaggagctggttttccgcgctccctatgatcacttcgtggacacagtctctagcaaaaagtttgaagatcggattcttttctcctaccaagtggacagcaagtacaacagaaaaatctctgatgccaccatctattccacgcgcaaggccaaactcggcaaggacaaaagcgaggaaacatacgtgctggggaagattaaggatatctatacccagacaggatacgacgcttttattaaactgtataagaaagacaagtctaaattcctcatgtaccataaggatccgatcacctttgagaaggttattgaagagatcctgaaaacctatcctgacaaggagattaatgaaaaaggcaaggaggtcgcgtgcaaccccttcgaaaaatacagacaggagaatgggcctcttcggaagtactccaagaaaggcaagggacccgaaatcaaaagcctgaagtattacgataacaaactcggcaatcacatcgacattacacccgataactctgagaatcaagtgatcctgcagagcctgaagccttggcgcacggacgtgtattttaaccacaagaccaaaatttacgagcttatggggctcaagtattccgatctgagcttcgaaaaaggatctggcaagtacagaatctccctggacaaatataacgtcattaagaaaaaggagggggtgcataaggaaagcgagtttaaattcacactctacaagaatgatctgatccttatcaaagacctggagaagtccgaacagcagctctttcggtacaactctagaaatgataccagcaaacactatgttgagctgaagccgtacgacaaggccaaattcgaaggaaaccaacccctgatggctctttttggcaatgtggccaaagggggccagtgtctgaaaggactcaacaaggccaatatttccatctataaagtccagacagacgtgctgggcaacaagcgcttcattaagaaagagggggatgctcctaagctcgagttctga

SEQ ID NO: 3955 - RNA, 3369 nt, synthetic construct
  misc_feature 1..3369: note = Cas9 variant
  source 1..3369: mol_type = other RNA
atgagcgacctggtgctcggcctggatatcgggattggatccgtcggcgttgggatccttaacaaggtgaccggagagattatccacaaaaattctagaattttccccgccgctcaggccgaaaacaatctggtgcggcgcacaaacagacaaggccggcgcctcacgagacggaagaaacatcgcatcgtcagactgaatcggctttttgaggaaagcgggctgatcaccgacttcacaaagatttccatcaacctcaatccttaccagctgcgcgtgaaaggactgaccgatgagctctctaacgaggagctgtttattgcgcttaagaatatggttaagcacagaggcatcagctatctggacgatgcttccgacgatggcaactctagcgtgggggactacgcccagattgtcaaagaaaattccaagcagctcgaaacaaaaaccccgggacaaatccagctggagcggtatcagacatacggccagcttcgcggggatttcaccgtggaaaaggacggaaagaagcatagactgattaacgtttttcccacgagcgcctatcggtctgaggctctccgcatcctgcaaacccagcaggagttcaattcccagatcacagatgaatttattaacagatacctggagatcctcaccggcaagcggaaatattaccacgggcctggaaatgaaaagagcagaacagactacggccgctatcggaccaacggcgagacgctggataacattttcgggatccttattggaaaatgcacattttaccccgacgagttcagagccgctaaggcctcttataccgcgcaagaatttaatctgctcaacgacctgaataaccttacagtgcctaccgagaccaaaaagctgtccaaagaacagaagaatcagatcatcaactacgtcaagaatgagaaagtgatgggccccgccaaactcttcaaatatattgctaagctgctgagctgtgatgtggccgacatcaaagggcatcgcattgataagtctggaaaggctgaaatccacacatttgaggcctaccggaaaatgaagacgctcgaaaccctggacattgagcaaatggatagagagacacttgacaaactggcgtatgtcctcaccctgaacacagaacgcgagggcatccaggaagcccttgagcacgagttcgctgatgggtccttcagccagaagcaggttgacgaactggtgcaatttcggaaagccaattcctctatcttcggaaagggctggcataactttagcgtgaagctcatgatggagctgattcctgaactgtacgagacctccgaggaacagatgacgatcctcacaagactgggcaaacagaagaccacctctagctccaataaaacaaagtacattgatgagaaacttctgaccgaagagatctataacccggtcgtggctaagagcgttcgccaggccattaagatcgtgaatgccgctattaaagaatacggggacttcgataacatcgtcatcgagatggcgcgggaaacaaatgaggacgacgagaagaaagccattcaaaagatccagaaagctaacaaggatgaaaaagacgccgccatgctcaaggctgccaaccagtataatggaaaggcggagctgccccactctgtgtttcatggccacaaacagctggctacgaagattagactttggcaccaacagggggaacgctgcctctacaccggaaaaacaatcagcattcatgatctgatcaacaatcctaaccagttcgaggttgaccacatcctgcccctctccattacctttgatgactctctggccaataaggtgcttgtctatgccacagctaaccaggaaaaaggccaacggaccccttaccaggccctggatagcatggacgatgcttggtccttcagagagctcaaggcctttgtgcgggagagcaagacgctgtctaataaaaagaaagaatatctgcttaccgaggaagacatctccaagttcgatgtccgcaaaaagtttattgagagaaacctcgtggacacacggtacgcgagcagagttgtgctgaatgccctgcaggaacatttccgcgctcacaagatcgataccaaagtctctgtggttcgggggcaatttacatcccagctcagacgccattggggcattgagaagaccagagacacgtaccaccaccatgccgtggacgctctgatcatcgccgcgagctcccagcttaacctgtggaaaaagcagaaaaatacactcgtctcttatagcgaggaacaactgctggatattgagaccggagaacttatctccgacgatgagtacaaggagtctgtgttcaaggccccctatcagcacttcgtggacacactcaaaagcaaggaatttgaggattccattctgttcagctaccaggttgactctaaatttaaccggaagatctccgatgctaccatttatgccacccgccaggctaaagtcggcaaggacaaaaaggatgaaacatacgtgctggggaagatcaaagacatctatacgcaagatggatacgacgccttcatgaagatttacaaaaaggataaaagcaagtttctcatgtatagacatgacccgcagaccttcgagaaggtgatcgaacctattctggagaattaccccaacaaagagatgaatgaaaagggcaaagaggtcccttgtaacccctttcttaagtataaagaggaacacgggtacatccggaagtattctaagaaaggaaacggccccgaaattaagtccctgaaatactatgacagcaagctcctggggaatcctatcgatattacaccggagaactctaaaaataaggtggttctgcagagccttaagccctggcgcaccgacgtgtacttcaacaaaaatacaggcaagtacgagatcctcggactgaaatatgccgatctgcagtttgaaaagaaaaccggcacgtacaagatctcccaagagaagtataacgggattatgaaagaagagggagtcgacagcgattctgagttcaagtttacactctacaaaaatgacctgcttctggtgaaggataccgaaaccaaagagcagcaactcttcagatttctgtcccggacaatgcctaacgttaagtattacgtggaactgaaaccctatagcaaggacaagttcgagaaaaatgaatcccttatcgagattctgggctctgctgataagagcgggcgctgcatcaaaggactcggcaagtccaacatttctatctacaaagtcagaaccgacgtgctggggaatcagcacatcattaagaacgagggcgataagcctaaactcgacttctga

SEQ ID NO: 3956 - RNA, 3369 nt, synthetic construct
  misc_feature 1..3369: note = Cas9 variant
  source 1..3369: mol_type = other RNA
atgagcaacggcaagatcctggggctcgacattggaatcgcctccgtgggcgtcggggttattgatgctcagaccggagagatcattcacgcctctagcagaatcttcccctccgcgaatgctgccaacaatgccgaacggcgcacatttagaggctctcggcgcctgatcagacggaaaaagcatcgcattaaaagacttgacgatctgttcaacgactttcacatcaatctcgatggggagatgagcacggacaacccttacgtgctgcgggtgaagggactttcccaaaaactgaccgtcgaagaactctatatttctatcaagaatattatgaagcgcagaggcatcagctacctggatgacgctgaatccgataacgaggccggccggagcgactatgctaaagccattgagcgcaatagacagctgctcacatctaagaccccgggggaaatccagctggagcggcttgaaaaatacggacagctgcgcggcaacttcacaatcattgatgaggaggggcaatcccagcagatcattaatgtgtttagcacctctgactatgttaaggaagtggagaaaatcctcgattgccagaagatgtaccataagttcatttccgacgaattttgtgacaaactgatcgagcttctgagagaaaagcggaaatattacgtcggacccggcaacgaaaagagcagaacagattacgggatctatcgcaccgacggaacgaccctcgagaatctgttcggcattctgatcggcaaatgcacattttaccctgatcaatatcggtcttccagagcgagctacaccgcccaggagttcaactttctcaatgacctgaacaaccttacagtgcccaccgagacgaagaaactgtcccaggaacagaaggagttcctcgttaattatgctaaggaaacatctgtgctgggggccggaaaaattcttcaacagatcgctaagctggccgattgtaaagtcgaggacattcgcggctaccggctcgataacaaggacaaacctgagctgcacatctttgaaacctatagagcgatgaaggggctggtgcccctcgtggatatcggagtcctgagccgcgagcagcttgacattctggccgatatcctcacactgaataccgacttcgaaggcattcgggaggctcttaagaaacaactgcctaacgttttcgacgaaaaacaggtgaaggggctcgcctcctttagaaagagcaaatctcagctgttcgctaagggatggcataatctgtcccagaagatcatgctcgaggtgattccggagctgtacgccaccagcgatgaacaaatgacaatccttacgcgcctgggcaaatttgagaagtctagcgtcgccgaatacccctcctctattaacgtggacgagatcaccgatgagatctataatcctgttgtggctaaaagcattcggcagacaatcaagattatcaacgcgtccattaaaaagtggggcgagttcgaccagatcgtcatcgagatgcccagagatcgcaatgaagacgaggaaaagaaacggattgccgatgggcagaaggctaacgccaaagagaaggccgacagcatcctcagagctgccgagctgtactgcgcgggaaaagtgctgcctgattatgtttacaatggccacaaccaacttgctaccaagattcggctctggtatcagcagggggaacgctgtatctacacaggacagcccatttctatccacgacctgatccataatcaaaaccagtatgagattgatcacatcctgccgctctccctgacctttgacgatagcctttctaataaagtgctggtcctcgccacggccaaccaggaaaaggctcagagaacaccttacaactacctgaagtccgccaccagcgcttggtcctatcgggagttcaaagactacgtgaccaagagaaaaggcattgggaagaaaaagtgcgaatatctgacatttgaggaggacatcaatggcttcgaagtccgctctaagtttattcaacggaaccttgtggataccagatacgccagcaaagttatcctcaatgcgctgcaggactatttcaagatctccggcattcagacaaaagtgtctgtcgtgcgcggacaatttacgagccagctgagacataagtgggggatcgagaaaacccgggaaacataccaccaccatgccgttgatgctctcattatcgccgcttccagccagctgcgcctttggaagaagcaggagtctcccctggtggtcgactatcaagaaggaagacaggtggatctcgagaccggcgagattctggaactgacagacgagcagtacaaagaacttgtgtaccagcctccctatcaagggttcgttaacaccatctccagctctgcctttgataatgagattctcttctcctaccaggtcgacagcaaggtgaaccggaaaatctctgatgcgacgatctatgccacccgcaatgctcagctgggaaaggacaaaacagagggcatttacgtgctggggaagatcaaggatatttatacccaggccggctacgaggctttcctcaaaagatatacaaaggacaaaaccagctttctgatgtaccacaaggatcttgacacgtgggagaaagtcatcgaaattatcctgcgggactaccgcgagtatgatgaaaagggaaaagagatcggcaaccccttcgagagataccggcgcgaaaatgggtatgtgaagaagtactccagaaaaggaaacggcacagccattaagagcctcaaatattacgacaataagctggggaaccatatcgatattacccctgaaaattctcggaacgccgttgtgctgcaatcccttaaaccgtggagaacagacgtctattttaataaggaaaccggaaagtacgagttcctcggcatcaaatacagcgatctgtcctttgaaaaggggaccggcgagtatggaatttctcaggagaaatacgacagcatcaagatcgctgaaggcgtggcgaaaaagtccattttcaagtttacactgtataaacaggatctcctgttcatcaaggacattgagaacaactttgggaaacttctgcgcttcacgtctaagaatgataccagcaaacactacgttgaactcaagccctatgacaagaacaaatttggaacagaggaacctctgctgcccgtgcttggcaatgtcgccaagtccgggcaatgtatcaaaggactgaacaagtctaatattagcatctacaaagtgcggaccgatattctcggctatagacatttcatcaagcaggagggggagcaccctcagctgaagtttaaaaagtga

SEQ ID NO: 3957 - RNA, 3369 nt, synthetic construct
  misc_feature 1..3369: note = Cas9 variant
  source 1..3369: mol_type = other RNA
atgagcaacggcaagatcctggggctcgacattggaatcgcctccgtgggcgtcggggttattgatgctcagaccggagagatcattcacgcctctagcagaatcttcccctccgcgaatgctgccaacaatgccgaacggcgcacatttagaggctctcggcgcctgatcagacggaaaaagcatcgcattaaaagacttgacgatctgttcaacgactttcacatcaatctcgatggggagatgagcacggacaacccttacgtgctgcgggtgaagggactttcccaaaaactgaccgtcgaagaactctatatttctatcaagaatattatgaagcgcagaggcatcagctacctggatgacgctgaatccgataacgaggccggccggagcgactatgctaaagccattgagcgcaatagacagctgctcacatctaagaccccgggggaaatccagctggagcggcttgaaaaatacggacagctgcgcggcaacttcacaatcattgatgaggaggggcaatcccagcagatcattaatgtgtttagcacctctgactatgttaaggaagtggagaaaatcctcgattgccagaagatgtaccataagttcatttccgacgaattttgtgacaaactgatcgagcttctgagagaaaagcggaaatattacgtcggacccggcaacgaaaagagcagaacagattacgggatctatcgcaccgacggaacgaccctcgagaatctgttcggcattctgatcggcaaatgcacattttaccctgatcaatatcggtcttccagagcgagctacaccgcccaggagttcaactttctcaatgacctgaacaaccttacagtgcccaccgagacgaagaaactgtcccaggaacagaaggagttcctcgttaattatgctaaggaaacatctgtgctgggggccggaaaaattcttcaacagatcgctaagctggccgattgtaaagtcgaggacattcgcggctaccggctcgataacaaggacaaacctgagctgcacacctttgaaacatatagagcgatgaaggggctggtgcccctcgtggatatcggagtcctgagccgcgagcagcttgacatcctggccgatattctcaccctgaataccgacttcgaaggcatccgggaggctcttaagaaacaactgcctaacgttttcgacgaaaaacaggtgaaggggctcgcctcctttagaaagagcaaatctcagctgttcgctaagggatggcataatctgtcccagaagattatgctcgaggtgatcccggagctgtacgccacaagcgatgaacaaatgacgattcttacccgcctgggcaaatttgagaagtctagcgtcgccgaatacccctcctctatcaacgtggacgagattacagatgagatctataatcctgttgtggctaaaagcatccggcagaccattaagatcattaacgcgtccatcaaaaagtggggcgagttcgaccagattgtcatcgagatgcccagagatcgcaatgaagacgaggaaaagaaacggatcgccgatgggcagaaggctaacgccaaagagaaggccgacagcattctcagagctgccgagctgtactgcgcgggaaaagtgctgcctgattatgtttacaatggccacaaccaacttgctacaaagatccggctctggtatcagcagggggaacgctgtatttacaccggacagcccatctctattcacgacctgatccataatcaaaaccagtatgagatcgatcacattctgccgctctccctgacgtttgacgatagcctttctaataaagtgctggtcctcgccacagccaaccaggaaaaggctcagagaaccccttacaactacctgaagtccgccaccagcgcttggtcctatcgggagttcaaagactacgtgacaaagagaaaaggcatcgggaagaaaaagtgcgaatatctgacctttgaggaggacattaatggcttcgaagtccgctctaagtttatccaacggaaccttgtggatacaagatacgccagcaaagttattctcaatgcgctgcaggactatttcaagatctccggaatccagacgaaagtgtctgtcgtgcgcggccaatttaccagccagctgagacataagtgggggattgagaaaacacgggaaacctaccaccaccatgccgttgatgctctcatcattgccgcttccagccagctgcgcctttggaagaagcaggagtctcccctggtggtcgactatcaagaaggaagacaggtggatctcgagacaggcgagatcctggaactgaccgacgagcagtacaaagaacttgtgtaccagcctccctatcaagggttcgttaacacgatttccagctctgcctttgataatgagatcctcttctcctaccaggtcgacagcaaggtgaaccggaaaatttctgatgcgaccatctatgccacacgcaatgctcagctgggaaaggacaaaaccgagggcatctacgtgctggggaagattaaggatatctatacacaggccggctacgaggctttcctcaaaagatataccaaggacaaaacgagctttctgatgtaccacaaggatcttgacacatgggagaaagtcattgaaatcattctgcgggactaccgcgagtatgatgaaaagggaaaagagatcggcaaccccttcgagagataccggcgcgaaaatgggtatgtgaagaagtactccagaaaaggaaacggcaccgccatcaagagcctcaaatattacgacaataagctggggaaccatattgatatcacacctgaaaattctcggaacgccgttgtgctgcaatcccttaaaccgtggagaaccgacgtctattttaataaggaaaccggaaagtacgagttcctcggcattaaatacagcgatctgtcctttgaaaaggggacaggcgagtatggaatctctcaggagaaatacgacagcattaagatcgctgaaggcgtggcgaaaaagtccatcttcaagtttacgctgtataaacaggatctcctgttcattaaggacatcgagaacaactttgggaaacttctgcgcttcacctctaagaatgatacaagcaaacactacgttgaactcaagccctatgacaagaacaaatttggaaccgaggaacctctgctgcccgtgcttggcaatgtcgccaagtccgggcaatgtattaaaggactgaacaagtctaatatcagcatttacaaagtgcggacagatatcctcggctatagacatttcattaagcaggagggggagcaccctcagctgaagtttaaaaagtga

SEQ ID NO: 3958 - RNA, 3372 nt, synthetic construct
  misc_feature 1..3372: note = Cas9 variant
  source 1..3372: mol_type = other RNA
atggccaagatcctgggcctcgacctggggaccaacagcattggatgggctcttatcgatgacgtgcagaataaaattctgggcgtcgggtccagaatcttccccatgggagttgagaacctcggcgatggggacggagaaatttctaagaatgccagccggacaggcacgcgcggcgtgagacggcaatttttccgcagacggctgcgcaaaaaggtgcttctgaaagcgctctccgagaacaatatgtgccctatgatcacctctgattttgacaactggaagaagacaaaacagttcccgagcgaaaagctggcttcctggtttgccctgaatccctacgagctcagaaacaaagccctgtctgaaaaacttaccctggaggagatcgggcggattttctatcacctcatccagcgcagaggatttctgagcaattcccggaaaggcgggacagatgacggagctattttcaagggcaaccctaaggaagggaaaatcggaattaccgatacacaggagagcatccaagacaagacccttggctcttacctgtttgaaatttatcccaaagagaatcagcctttccagaacggcctcgagcgcatcagaaatcggtacacggtccgcaagatgtatgtggatgaatttgagatgatctgggaaaaacaggcccaatactattccaacctgaatgaggacctgaagaccctcttcgggggaagaaaactggatggctacaaggaagacgggattctttttcatcagcggcccctgagaagccagaagcacctcgttggaaactgtgtgttcgagcctaacaaaacaaagtgcccgatctctgctattcccttcgagcagtttcgcgtctggcaatgggtgaataccgttgaatacaacggcaaaaagatctcccaggtggagaaagaaaagattgtcgagttcctgtatgccaatgacaagacagattttaaaaagatccggaaagcgatcgggaaggaaagcaccgagttcaaatttaactacaaggacgatgacaagattgtgggaacgtatacagtgtctcatctttccaataaaaagtacttcggcaaaaagtggtttgagttcagcgaaaaagagcaggaagatatctggcacattctgtactttttcgactccaagtctaacctcaaggagtatgccatcaaaaattggaactttaccgaggaacaagctgagagcattgccaagttcaatgtcaaagatggctattccagcctgtctagaaaggctatctccaacatcctgccttttctcaaactggggttcacatacgacgttgccgtggtgcttggaggcattaagaatgtcttcgggcatgaatgggagaaactgagcgatgaaaagcgcaactttctcatcgacaatgtggagggaattgttcggtctaagaccaaaggcgggttcatcgatgtgattaaggacatcctgagaaacgactacaatattagcgataaccagcttcgcaaactgtatcaccactccgcgaccatctacgtcgccgagctcctggaaaagctgcccgtgggcaaagaggctgacaaggaaatccagtctattcggaaccctatcgttattacagccctctttgagctgagaaaacttgtgaatgaactgatcgatgacttcggaagcattgatgagatcaaagtcgagatggctcgcgacctcaagatctccaaaagccagcggaacaagattagacgcgaacaaaaacggctggagagagaaaatgatcgggtgaaggcccgcctgcttgaggaaggccagagaatcacgcatgacaacattctcctgtataagctgtgggaggagtgtaaaaagacctgcccctacacagggaatccgatccctctctataaactgtttaccggagaaattcagatcgagcacatccatccctggtctcggtcccttaacgatagcttcgccaataagacactgtgttacgctgacgaaaacagaaagaagggcgataagaccccttatgagttttacgggaatgacgaatctaactggtccgcgattaaagagcgcgccctcaagctgttcagcgatacgaaagagtaccccaatgcttatcagaagtttaaacggttcgtccaacacaagtttgacgacgatttctcctctagacagctgaacgacacacgctacatcagcaaagaagccaagaattatctttccaagatttgcaaaaaggtggccgtttctcccggacaggctaccagcaacctcagacagaaatggggcatgaataacatcctgaacgatgagaatgaaaagacccgggaggaccaccgccatcacgccattgatgcgctggtgatggcttgtacaaaaatctcctacgtccaagagctcagcaagtggaacagatataatcggaacgccgaactgaagaaatttcctcttccgtgggagaccttctggtctgacgccaatcgcgctgtggataagatcctgatttcccataaaaaggttagcaacgacatcacagggagaacgcacatttctgaaaagaatggcaagaagtacaaaaacgtgggagtcgccgctcggggccagctccataaggagaccgtgtatgggaaacgcacattcaatggagaagaggcctttcacgtgagaaagaccatcgattccctgacaaccgagaaacagctggaaaaggttgtcgacgagagcattaaacttctcatcaagaagcgggtgcaggaactgggcgggttcgtgaaaggagcgattcccgccaacacgtttttcgtcgtggatgagaatggcatcaagcaacctcagatctttctgcccaacaaaaatggggctcctgttcccgtgctcaaggtccgcatgaaggaaaacattggcggagccgagaaactgaaggagaatgtgaaccagtgggttaacccgagaaataaccaccatgtgcttatctacaaagacgaaaagggcaatctgaaagaggaagtcgtgaccttctggacagttgtggagcggaagagaaccgggcaatctgcttaccagctcccttttgatggaaaagaaattgtcacaaccctgcacatcaacgacatgttcctgcttggcctcaatgaggaggaaattaactgggagaatcccgactatgaagtgctgaaggagcatctgtaccgcgtgcagaagtttacgagcggggattattacttccggatcgccaaaacatccagcatccagaacgcgattgagaagcaacagatcaattcttttggattcggcaaaaacgggtggtccacccacaatcctattaaggtcaaaatcagcgtttccggcaagatttctaaggtgtga

SEQ ID NO: 3959 - RNA, 3372 nt, synthetic construct
  misc_feature 1..3372: note = Cas9 variant
  source 1..3372: mol_type = other RNA
atgaacggcctggtgctcgggctggacatcggaattggcagcgtcggggttggaatccttaataaggataccggcgagattatccacacaaactccagaattttccccgccgctacggccgacaataacgtggaacggcgcaattctagacaggcgcggcgcctgaacagacggaaaaagcatcgcggggctagactccacgatctgtttgaggactacgatcttctgatcgacttcagcaaagtgtccatcaatctcaacccttatcggctgcgcgtccaaggactggataatccgctcaccacagaagaactgtttattgcccttaagaacatcgtgaaaagacggggcatttcttacctggacgatgccagcgaaaatggcggggctgtttcctctgactatggaaaggccgtggaggagaaccgcaagctcctggctgaacagacccccggccagatccagcttgagagattcgaaaaatacgggcaagtccggggagattttacagtggaggagaagggcgacaaacatcgcctgattaatgttttcagcacctccgcctatagaaaggaagcggagcggatcctcagaaaacagcaggaatttaacaatcagattacagataagttcatcgaggactacctgaagatcctgaccgaaaaacgcaagtattaccacgggcctggaaacgagaaaagccggacggactacggcagatttcgcaccgatggcacaaccctcgacaacattttcgggatcctgattggaaagtgcacattttatcccaatgagtaccgggcctctaaagcctcctataccgctcaagagttcaaccttctgaatgatctcaacaatctgacggtgcctacagagaccaagaaacttagcgaagaacagaagaagacaatcgtcgaatacgctaaatctgccaagaccctgggcgcgtccaccctcctgaaatatattgccaagatgatcgacgctagcgtggatcagatcagagggtaccgcgtggacgtcaacaataaacccgagatgcatacatttgaggtttatcggaagatgcagtctctggaaacgattcctgtgggagagttctccagagaagtgctcgatgagctggcccacatccttaccctgaacacagaacgcgagggcattgaggaagctatcaataccaagctcatggacgtcttcagccaagatcagattctggagcttgtgcagtttcggaaaaacaattcctctctgttcagcaaggggtggcacaacttttccctcaaactgatgatggaactgatcccggagctctacgagacaagcgaggagcaaatggccatcctgaccagacttggaaagcagaaattcaaggaaacgtctaagcgcacaaaatacattgacgagaaggaagttaccgaggagatctataatcccgtggtcgccaaatccgtgcggcaggctattaagatcattaacgaagcgaccaaaaagtacggcatctttgataatattgttatcgagatggccagagaaaacaacgaggaagacgctaagaaagactatatcaagcggcagaaagccaatcatgatgagaagaacgccgctatggagaaagccgcgttccaatacaatggcaagaaagaactgcctgacagcatttttcacgggcataaggagctcgctacaaagatccgcctgtggcaccagcagggagaaaaatgtctgtataccggcaagaacattcccatctctgatcttattcacaatcagtacaaatatgagatcgaccatatcctccctctgagcctgtccttcgatgactctctcagcaacaaggtgctggtccttgccacagccaatcaagaaaaagggcagagaacgccctttcaggctctggattccatggacgatgcctggagctaccgggagttcaagtcttacgtgaaggactccaaactcctgggaaacaagaaaaaggattatctgcttaccgaggaagacattagcaaaatcgaggtcaagcagaagtttattgaaagaaatctcgtggatacacgctactcttcccgggttgtgctgaacaccctgcaagacttctataaagctcacaagtttgacacaaccatcagcgtcgtgagaggccagttcacgtcccagctccgcagaaaatgggggctggagaagtctcgggagacctaccatcaccatgccgttgatgcgcttattatcgccgctagctcccagctgcgcctctggaaaaagcaagccaatccgctgatctcttataaggaagaccagttcgtggatagcgagacaggcgaaattatctccctgaccgacgataaatacaaggagcttgtctttaaagctccttatgcccacttcgtggacacactcagctctaagaaatttgaagattccattctgttcagctaccaggtggactctaagtacaacagaaaaatctccgatgcgaccatttatgccacgcggaaggttaagctggacaaagataagagcgaggagacatacgtcctcggaaaaatcaaggacatctattctcaagctggctacgatgcctttattaaaatctataataaggacaagagcaaattcctgatgtaccacaaggacccccagacctttgaaaaagtgattgaggaaatccttcgcacatatccttccaaggagttcaacgagaaaaataaggaagtgccctgcaacccctttgagaagtacagacaggaaaacgggcctattcggaaatacagcaagaaaggaaatggcccggagatcaagtctctgaaatattacgataagaacattcccgaatccttcatcaatatcacccctagcaactccaagaataaagtcattctccgccagctgaacccctggagaaccgacgtgtattttaatcatcaaacagagaagtacgaactgcttgggctcaaatatgctgatctgcagttcgagaagaaaacgggaacctactctatcacaattgacaagtataacgagatcaaggaaaaagagggcgttggggaacagagcgagtttaagttcaccctgtacaaaaatgatctcctgcttattaaggacaccaaaaacaatgagaagcagatcttccggtttctgtcccgcacaatgcctaacgtgaaacactacgtcgaactcaagccctatgataaggccaaattcgacggcaatcaaccgctgatcacgatttttggaaacgtggccaagggcgggcagtgtctgaaaggacttaataagtctaacatcagcattttcaaagttaagacagatgtgctgggcaacaagcattttatcaccaaagagggggaaaagcctaaactcaagttctga

SEQ ID NO: 3960 - RNA, 3378 nt, synthetic construct
  misc_feature 1..3378: note = Cas9 variant
  source 1..3378: mol_type = other RNA
atgaacggcctggtgctcgggctggacatcggaattgccagcgtcggcgttgggatccttaataaggagaccggagaaattatccacgtgaactccagaattttccccgctgccacagcggattctaatgtggagcggcgcggctttagacaggggcggcgcctgggaagacggaaaaagcatcgcagcgctagactcaacgacctgttcgaagagtttggcttcatcacggatttttccgccgtccctcttaatctgaacccgtacgccctccgggtgaaaggcctgtctgaagaactgaccaatgaggaactcttcatcgctctgaagaacattatcaaacgcagagggattagctatcttgacgatgcctccgaggacggagaaacagcttctaatgagtacggcaaggccgttgaggaaaaccggaagctgctcgcggataaaacccccgggcaaatccagctggagcgctttgaaaagtatggacaggtgagaggcgacttcacagtcgtggagaatggggaaaaccaccggcttattaatgtttttagcacctccgcctacaaaaaggaggctgagcgcatcctgagacggcagcaagagttcaacgtgagaattagcgatgagtttatcgaagcctatctcacaatcctgaccggaaaacgcaagtactatcatggccctggcaatgagaagtctcggacggactacgggagattccgcaccgatggaacaaccctggacaacatttttggcatcctcattgggaaatgcacattctaccccgatgaatatcgggctgccaaggcgtcctacaccgcccaggagttcaacctgcttaatgacctgaacaatctcacggtccctacagagaccaaaaagctgagacccgaacagaaacgccagatcgtggagtatgctcggacagccaagacccttggaacccctacactgctcaaatacattgctaagctggtggacggcagcatcgatgacatcaaggggtatagaattgataaatctgacaagccggaaatgcacacgtttgatgcctaccgcaaaatgcggaccctggagctcgtcgacgttgatatcctgtccagagaaacacttgacgatctggcctatattctcaccctgaacacagagagcgagggaatccttgaagctctcaattctaagatgcccggcaccttcacgaaagagcaaattgacgaactgatccagtttcgcaagaagaactccgcggtgttcggcaaagggtggcataattttagcctgaagctgatgaacgagctcatccctgagctgtacgaaacatccgaggaacagatgaccattcttacccggctgggaaaacagagatctcgggagatcagcaagcgcacaaaatacattgatgaaaaggagctcaccgacgagatctataatcccgtggtcgccaagtccgtgagacaagctattaaaatcattaacctggccacaaagaaatacggcatcttcgacaatatcgttattgaaatggcccgggagagcaacgaagatgacgagaagaaagctatccagaatgtgcagaaggccaacgaagatgagaagaaagcggctatggagaaggccgccgacctgtataatgggaaaaaggaacttcctgattctatttttcacggacacaaagagctcgctacgaagatcagactgtggcatcaacagggcgaacgctgtctgtacaccgggaaaaacatttccatccacgacctcatccataacccccaccagtatgagattgatcacatcctgccgcttagcctgtctttcgacgatggcctcgccaataaggtcctggtgctggctacagccaaccaggaaaagggacaacggaccccttttcaggcgcttgacagcatggatgacgcctggtcctacattgagttcaaacagtatgttagaaattctaagagcctctccaacaaaaagaaagattacctgctgacagaggaagacatcagcaagattgaggtgaagcagaaatttatcgaacgcaatctcgtcgacaccagatactcttcccgggtggtcctgaacacgcttcaagagttctataagaccaatgattttgacacaaaaatcagcgtggttcgcggccagttcacctctcagctgagacggaagtggaaaattgagaagtcccgcgatacataccatcaccatgctgtggacgccctcatcattgctgccagctcccagctgagactgtggaagaaacaaaacaatccccttatctcttatcgggaagggcagctcgtcgatcctgagaccggagaaattctgagcctgacggacgatgagtacaaggaactcgtgctgcgccctccctatgactacttcgttgatacacttaaatccaagtcttttgaggacagcatcctgttctcctatcaggtggatagcaaatacaacagaaagatctctgacgcgaccatttacggcacacggaaggcccagctcgggaaagataagcaagaggaaacctatgtcctgggaaaaatcaaggacatttactcccagaaaggctatgaggactttatcaagcgctacaaaaaggataccacacagttcctgatgtatcacaaggacccccaaacgtttgctaaagtgattgaagagatccttaagacctacccggataaagaactcaatgagaaggggaaagagattccctgcaaccctttcgaaaagtatagacaggagaatggccccatccggaagtacagcaaaaagggaaaaggccctgaaatcaagtctctgaaatactatgacaacaagctggggaatcatattgatatcacacccgtgaactcccagaaccaggttgtcctccaaagcctgaagccgtggagaaccgacgtgtactttaatcctcagacatctaaatatgagcttatgggactgaagtacagcgatctccgcttcgaaaaaggctccgggagctatggaatttctcccgagaagtacaacaaagtgaaggccaaggagggcgtcgacgaagattccgagtttaaattcaccctgtataagaatgacctgatccttattaaagatacggaaacaggggagcagcagctgtttcggtacggcagcagaaacgacacctccaagcactacgtggagctcaaaccttatgaaaaggctaagttcgagggaaatcaacagctgatgaacctcctgggcaccgttgccaaagggggacagtgtcttaagggcatcaataaacccaacctgtctatctacaaggtgaaaacagacgtcctcgggaataagtattttattaaaaaggaaggagatcagcctcaactgaacttcaagaaaaagatctga

SEQ ID NO: 3961 - RNA, 3378 nt, synthetic construct
  misc_feature 1..3378: note = Cas9 variant
  source 1..3378: mol_type = other RNA
atgaccagcaagcaggagaacctgggcgccctcacattcgggctggacatcggaattgcttccgtgggctgggccgtccttggggaaaatagaatcattgatctgggagttcggtgctttgacaaagcggagacggctaaggaaggcgagtctctcaacctggcccgcagaatggcccggcttctgcgcagacggctccgcagacgggcttggcgcctgaccaaactggccagactcctgaagcgggaagggcttatcgctgatgccaatctgttcaaaaacaagattgagaagaatacacccgtgcctaaaagctcctggcaactccgcgtggacgcgctggatagaaagctgaacgccgaggaatgggctcgggtcatctaccacctgtgtaaacatcgcggatttcactggatctctagagccgaggaaaaggctgccgagagcgactccaaaggcgagtctggcaaggtgaagcaggggctcgcgggaaccaaaaagctgatgcaggaaaagaattatcggacagccgctgagatggttctggccgagttcccggaagctcagagaaacaagcaaggcgattacagcaaagccctctcccgcattctgcttggggacgaactgaagaccctctttgagcatcagcggaaactggatagccccttcgccacagagaaacttgaagctgcgatcctgggaaatggcgacagaaagtctgggctcttttgggcccagaaccctgctctggccggatccgatctgctcaaaatgctgggctattgcaccttcgagaagacggaataccgcgcccccaaagctagctttaccgccgagcggcacgtgtggcttacaagactgaataacctccgcattgtcgtggacggcaccacacggcctctgaatgaagcggagagacgcatcgcccttctgatgccctatcagcaagccggggatttcacctacaagcagctccggacggccctgacaaaagctggatttctgcctgagtctttcagatataccggcctctcctacgccagcgggcagaaggctggagaaaagacaaaagacccggagtctgccgcgctggttaagtttcccgcctggcaggaacttcgcaaaaccctggagaagaaagaactcgcttccgagtggcaaaagattagcaccgacgccctggatggcaagcctcagctgcttgaccagatcgcttgggtgctctccgtctacaaagatgacgatgaggtgaaggccgaactgtctaaactgaacctccccaatgcggagaagatgattgacgccctgcttgatatccggttcgacaaattcagcaacctgtccctcaaggctctgtgtaagatcgtgcctctgatggaacaagggcagagatatgatgaggccattgctaacatccccgagtacggacatcacagccagcttcacaaagtcggcgccggcgaacataagtatctcccgcctttttacaaagagcgggacaagacagggcgcatggttttcaatgatgacatggacattcccagaaaccctgtggtgctgcgggccctgaatcaggctagaaaagtcgtgaacgcgctcatcaagaaatatgattctccccacgaagttcatattgagatggcccgcgacctgtcccggccccttgatgaaagacgcgaggtggagaagctgcaaaaggaatttagagacaataacgagaaaggaaaggctcagttcgcccaggattttaatatcgtcggcgccgtgaaagggaaggagttcgaaaaataccagctctatcgggaacaacagggaaagtgcgcttacagcatcgagcctatggacattcaccgcctgtttgagcagggctacgttgaaatcgatcacgccctgccgtattctcggagcttcgacgattccaagaacaatagagtgcttgtcctcgcgaaagagaaccgcgacaaggggaatagaacgccctttgaatacctgggcggaaaagataactctgagccttggcggcagttcgtggcttttgtcgaaggcaataaggcctatcgcctggccaaaagaagccggctcctgcgcaaggacttcggggataaggaggctaaagagtttagagaacggaaccttaatgacaccagatacatttgtaagttcttcaaaaactatgtggagcaatacctgcagctccatgaagactccgaggccaagcgctgcgttgtgctgagcggacagatgacatcttttctgcgggcgagatggggccttgtcaaagtgcgcggggattccgaccggcaccatgctctcgatgccgccgttgtggctgcctgtagccacggaatggtcaagagactgtctgactattcccgccggaaggagctggaacaggtgagagagggcttcgtggatgttgacaccggggaaatcgtcaaccccgctatgtttcaacaggtgcaggagcatttccctaatccctggccgcactttcgcgatgaagtgaaactccggctgagcatggacgatcctgcccttctgagatccgagatggagaagttcggcacatacacccccgaagcgctccaagccctgcaccctctgtttgtctctcgggctccccagcgcagaaacagcggagccgctcataaagacacgatttacgcccagcctaagcggcttgtggcccagggcggggttacacaaaaagtggctctgacctccctcaccctgaaggatctcgacaaactgatcgatccccaccgcaatgacaaactttatacagcgatcagagcccggctggagcagcatggaggcaagggggacaaggctttcccgtctagcaaccctctcagaaagcccgattccgaaggaaatcccaccggccctattgtccgcggggtgacaatggttatcgacaaactgagcggcattccgatccggggaggcattgccaagaacgattctatggtgagagtcgacgtgtttacgaaagccaataagttccacctggttcccgtgtacgtccaccataccgtggctaaggcccttcctaaccgcgcggtggtcgcttttaaagatgaggacgaatggacactgatcgatgactccttcgatttttgcttcagcctccaccccaatgacctggttcaggtgcagcaaaaggggaaagccggaatgattggctattactcttcctgtcatcgggggaccggaaacatcaatctctgggcccacgatagaaaccttcaggtgggcaaggacgggatgatcgagggcattggagtcaaaacagctcttagcctggagaagttcaatgtggacgttctcggcaaccgctatcctgctccccctgaaaagcggagagatctggcgtga

SEQ ID NO: 3962 - RNA, 3378 nt, synthetic construct
  misc_feature 1..3378: note = Cas9 variant
  source 1..3378: mol_type = other RNA
atgaccgacagaatcagcctgggcctcgatattggggtggcctccgtcggattctctgttctggacatcgataagggcaaagtgattgagcttggggctcggctgtttaacgccacagtggcggctggaaatcaggaccgcagagatatgcggggcagccgcagactcctgaaccggaataagcaacgcagaaaagacgtctccaagctgttccaggaatacgggctgctcgataactttgaccgggataatttccacacggcctttaacaataactggaatccctatgagctgcgcgtgaaaggactgaccaagcagctcaacaaggaagaactggccgactctctttaccagatcattaaaagacggggcatcagctatgctctgaaggatgccgacgctaatgaagatggcacagactactcctctagcctcaaaatcaactcccaagagctgattgagaagacccctgcccagatccagcttcagcgcctgaatgactatgggaaagttagaggaaaggtgattgtcggcgatgacatcgatgaccaaaaggtgctcctgaacgttttcccgacaaatgcgtacgaaaaagaggcccggcagattatcgctacccagcagcaattttatcccgaaattctgacaggggagttcgtgaaggagtactgccagatcctcacccgcaaaagagattactttgtcggacctggcaacgaaaagagccggacggactatgggatctacaaaaccgatggaagaacactggacaaccttttcgaggaactgattggccatgataagatctatcccgacgagctccgcgcctctgctgcctcctacaccgcgcagctgtttaatgtgcttaacgatctgaataacctccggattctgagctatgaagacggcaaactgacacaaatcgacaaggagaagattatcgccgagatcaaaaataacaccacggtggtcaatatgctcaacgttattaagaaagtgacagggtgtcagaaggatgacatcaaaggattcagactgaatgaaaaggataagcctgagatttcttccatgcccatctaccgcaaagctcacaaggactttcttaaagtgggcattgatatcaccgactggcctatcgatttcattgaccggctgagcttcatcctcacactgaacaccgaaaatggggagattagaaagcagatcaacaaacgccttgtcccggattttgacttcctgaatgatgacctcgtgcagctgattatcgataacaaggactcttttgacattaagaccaataacaaatggcatcggttctccctgaagacaatgaacaaactcatccccacgatgatcgaaagacctgttgagcaaatgaccctgcttacagagatgggactgattaagaaagataccaagcgctttgaaggcaataagtatctcccctacaaagagatcgccaacgacattttcaatcctgtggctagcaagtccgtccgggaagccctgaaaatcgtgaacgccgttctgaagaaatacgggcacattgagtatatcgtgatcgaaatgcccagagataagaatcttgacgaggagcgcaaacagattgctgattttcagaagaagaacaaaaagatcaaagacgcggccttcaatgcttttgtcaaggccgtgggatctaaaaagaacgtcaagattgccctcagcaaaaatcggaagctgcagatgggcatcagactgtggcatcaacagcagggcattgatccgtacaacggggaagagatcaatgctaacgacctcatctccaatcctgataaattcgaaattgaccacatcattccccagagcatctcttttgatgacggaattaacaataagacactgtgcttcgcctccatgaaccaagtgaaaggccagaagaccccttatgagtttcttaacgaggggcacggacagggctacgcgaagttcaaagctatcgttagcaagaataaaaacttctctaaggccaaacgggataattatctgtttgaagagaacgtgagcaatatcgaaacgcgcaagagattcctctcccggaacctggtcgacacaagatactctagccgcgtggttcttaattcccttcaggagtttttccatgaaaagagcgacgataccaaagtgaccgtcattcgggggaagtttacatctaacatgagaaaacactggcatatcgacaagacccgcgatacattccaccaccatgccattgacgcttccatcattgccgctacgccctttctcagaatgtggaaaaagggcagcaccatcttccccacaaaaattaatgagacctctatcgatatcgagacaggagaaattctggacgataagaactttgacaaggtgatgtatgaggaaccttactccggcttcatcagcgagattatgaatgccgatgaccggatcaaattttcccaccaagtggataagaaaatgaaccgcaaggtttctgacgcgaccatttacagcacgagaatcgggaaactgtccaaggacaagaaagatgccgaatatgtcgtggctaaggtgaaagacatctactctgtcgatggatatgagaatttcaagaaagtgtacaagaaggacaaaaccaagtttctcctgtataaatacgatccgcggacattcagcgagcttgaaaagattgttatcgactatcccgataaaattgagaaggtgcagaccaacggcaagatcaaagccgtcgacatttcccctttcgaactgtaccgcagagataatgggatggtgcggaagtacagcaaaaagacaggacccgctatcaaacagctcaagtatctggacaagaaactgggctctcatatcgatattacccctaagaacgccaacaataaacacgttgtgcttcaatccctcaagccctggcgcacggacgtctacctgaaccatgagacaggggaatatgagatcatgggcattaaatacagcgatctgaagtttaataaaaacgagggatatggcatcaagaaggacaaatacctcaagattaaaaatatcgaaggggtgtctgagaactccgagttcatgtttagcctgtatagaaaggaccggattaaagttcaggatatggagaccaatgagtctgtggaacttctgttctggagccgcaacttttccaataagaagtacgcggagctcaaaccgatcagccagatcgacaacgataaggtcctgcctatttacggaagaggccggctgatcaaaagacttattcccaagaattgtaaaatctggaaggtgaacacatctattctcggggacacctattacctggaaaaggagtccaattatcctcagaaaatcctggattga

SEQ ID NO: 3963 - RNA, 3381 nt, synthetic construct
  misc_feature 1..3381: note = Cas9 variant
  source 1..3381: mol_type = other RNA
atgaacggcctggtgctcgggctggacatcggaattgccagcgtcggcgttgggatccttaataaggagaccggagaaattatccacgctaactccagaattttccccgccgcgacagctgattctaatgtggagcggcgcggctttagacaggggcggcgcctgggaagacggaaaaagcatcgcagcgccagactcaacaatctgttcgaagagtttggcttcatcacggacttttccgccatccctcttaacctgaatccgtacgctctccgggtgaaaggcctgtctgaagaactgaccaacgaggaactcttcattgccctgaagaatatcattaaacgcagagggatcagctatcttgatgacgcttccgaggatggagaaacagcctctaacgagtacggcaaggcggtcgaggaaaatcggaagctgctcgccgacaaaacccccgggcaaattcagctggagcgctttgaaaagtatggacaggtgagaggcgatttcacagttgtggagaacggggaaaatcaccggcttatcaacgtctttagcacctccgcttacaaaaaggaggccgagcgcattctgagacggcagcaagagttcaatgtgagaatcagcgacgagtttatcgaggcttatctcacaattctgaccggaaaacgcaagtactatcatggccctggcaacgagaagtctcggacggattacgggagattccgcaccgacggaacaaccctggataacatctttggcattctcatcgggaaatgcacattctaccccgacgaatatcgggccgcgaaggcctcctacaccgctcaggagttcaatctgcttaacgatctgaataacctcacggttcctacagagaccaaaaagctgagccccgaacagaaaagacagattgtggagtatgcccgcacagctaagacccttggaacccctacactgctcaaatacatcgccaagctggtcgacggctctatcgacgatattaaggggtatcggatcgacaaatccgataagccggaaatgatgcacacgtttgacgcctacagaaaaatgcgcaccctggatctcgtgaatattgacgctctgagccgggagacacttgatgacctggcgcatatcctcaccctgaacacagaatctgagggcattcttgaggccctcaattccaagatgcccagcaccttcacgaaagaacaaatcgatgagctgatccagtttagaaagaagaactccgctgtgttcggaaaaggctggcacaatttttctctgaagctgatgaacgaactcattagcgagctgtatgagacatccgaagaacagatgaccatccttacccgcctggggaaacagcggagcagagaaatttctaagcggacaaaatacatcgacgagaaggaactcaccgaggagatttacaatcctgtcgttgccaagtccgtgcgccaagccatcaaaattatcaacgaagctacaaagagatatggaatcttcgataatattgtgatcgagatggcccgggaaaacaatgaggaagacgcgaaaaaggactacattaaaagacagaaggctaaccaggatgagaagaacgccagcatggagaaagccgcttttcaatataatggcaagaaagaactgcccgactctatcttccacgggcataaggagctggccacgaaaattcgcctttggcaccagcagggagaacggtgtctctacaccggcaagaacatcagcatcagagatctgattcataatcctcaccagtatgagatcgaccacattctgcccctctccctgtcttttgatgacgggcttgctaacaaagtcctggtgctcgccacagcgaatcaagaaaagggccagcgcaccccgttccaggccatcgatagcatggacgatgcttggtcctacagagagtttaagcagtatgttcggaacagcaaatctctgtccaataagaaaaaggactacctgcttacagaggaagatattagcaaaatcgaggtgaagcaaaagttcatcgaacgcaacctcgtcgacaccagatactcttcccgggtggttctgaatacgctgcaggagttttataaaaccaacgatttcgacacaaagattagcgtggtccgcggacagttcacctcccagctcagacggaaatggaagatcgagaaatctcgcgacacataccatcaccatgccgtggatgctctgattatcgccgcgagctcccaacttagactgtggaagaagcagaataaccctctcatttcttataaagaaggccagtttgtcgaccccgagaccggggaaatcctgagcctgacggatgacgagtacaaggaacttgtgttccggcctccctatgattactttgttgacacactcaaatccaagagcttcgaggattctatcctgttttcctatcaggtggacagcaaatacaatcgcaagatttctgatgccaccatctacggaacaagaaaggctcaactgggcaaagacaagcaggaggaaacctatgtcctcgggaaaattaaggatatctactcccagaaaggatatgaggacttcattaagcggtacaacaaagatgaaacccaatttctgatctatcacaaggacccccagacattcgagaaggtgattgaagagatccttaaaacgtaccctgacaaggagctgaatgaaaaaggcaaggagatcccgtgcaacccctttgaaaaatatagacaggagaacgggcctattcgcaagtacagcaagaaaggcaagggacccgaaatcaaaattctcaagtactatgataataaactgggcaaccatatcgacattacccctgttaattctcagaaccaagtggtcctgcagagccttaagccctggcggacagatgtgtacttcaatccgagaacctccaagtatgagctcatggggctgaaatacagcgacctgcgctttgagaagggatctggctcctatgggatcagccctgaaaaatacaacaaggtgaaagccaaggagggagttaatgaagattccgagttcaagtttacactctataaaaacgacctgatccttattaaggataccgagacgggcgaacagcagctgttccggtacgggtctagaaatgacacaagcaaacactacgtcgagctcaagccctatgaaaaagctaagttcgagggcaaccaacagctgatgaatctgcttggaaccgtggccaagggcgggcagtgtctgaaaggaatcaacaagcctaatctctccatttacaaagtgaagaccgatgtcctgggcaacaaatattttatcaagaaagaaggggaccagccccaactcaatttcaagaagaaattttga

SEQ ID NO: 3964 - RNA, 3381 nt, synthetic construct
  misc_feature 1..3381: note = Cas9 variant
  source 1..3381: mol_type = other RNA
atggccagcaagcacgagaacctgggcgctctcaccttcgggctggacatcggaattgcctccgtgggctgggcggtccttggggaaaatagaatcattgatctgggagttcggtgctttgacaaagctgagacagccaaggaaggcgagtctctcaacctggcccgcagaacggctcggcttctgcgcagacggctccgcagacgggcctggcgcctgaccaaactggctagactcctgaagcgggaagggcttatcgccgatacaaatgtgttccagaaaccctttaacctgaaggacgcgaatgagaagggactcagcttctggcagctgcgcgtggatgcccttgacagaaaactgtccgctgaggaatgggcccgggtcatttaccatctctgtaagcaccgcggctttcattggatctctagagctgaggaaaaagccgcggagggcgatagcaagtccgaagggggaaaagtgaagcagggcctggccgggaccaagaaactgatgcaggaaaagaactatcggacagctgccgagatggttctcaccgagttccctgaggctcagagaaataaacaaggagactactctaaggccctgagccgcatccttctgggcgatgaaatgacacagctctttaaacaccagcgggagctggggaacccgcatgccaccgagaaacttgaagctgcgattctgggaaatggcgaccacaaatccggcctcttctgggcccagaaccccgctctggccgggaatgatctgctcaagatgctgggacactgcacgtttgagaaggccgaatatagagtgcctaaagctagcttcaccgccgagcgccatgtctggcttacacggctgaacaatctcagaatcgtggttgacggcaccacacgccccctgaacgaagcggagcggcaccttgctctgctcatgccttaccaacaggccggggatctgacctataagcagctgagaacggccctcacaaaagctggatacctgcccgagtcttttcgctataccggccttgcctacgcttccgggcagaaggccgacgaaaaagcgaaggaccctgagagcgccccgctggtgaagctccccgcttggcatgaactgcggaaaacactggagaagaaagaacttgcctctgagtggcaaaagatttccagcgatgctctcgacggaaaacctcagctgctggatcagatcgcctgggtcctctctgtgtacaaggacgataccgaggtggaagcggagctgtgtaaacttaatctgcccaacgccgaaaagatgattgacgctctcctggatatcagattcgacaagttttccaacctgagccttaaggccctccgccaaattgtccctctgatggagcagggccagcggtatgatgaggctgttgccaatatccccgaatacggccaccactcccagctgcatgaggtgggggccggagaacacaagtatctcccgcctttctacaaagagagagacaagaccggccggatggtgttcaacgatgacatggacatcccccgcaatcctgtcgtgctgagagctcttaaccaagcgcggaaggttgtgaatgccctgattaaagaatatgggtctccccatgaggtccacatcgagatggctagagatctcagccgccccctggacgaacggagagatgtggagaagctgcagaaagaatttcgcgacagaaacgagaaggataaagcccttttcgcccaggactttaatattgttggagctgtgaagggcaaagagttcgaaaagtaccagctctatcgggagcaacaggggaagtgcgcctactccatcgaacctatggatattcatcgcctgtttgagcagggctacgtcgaaatcgaccacgcgctgccgtatagcagatctttcgatgactccaaaaacaatcgggtgctcgtcctggctaaggagaaccgcgataaaggaaatagaacaccctttgaataccttggcgggaaggacaacagcgagcggtggcgccagttcgtggcctttgttgagggaaataaatcttatagactggccaagcggagccgcctcctgagaaaggatttcggcaaagacgaagctaaggggtttcgggagagaaacctgaatgacacgcgctacatctgtcggttctttaaaaactatgtggaacaataccttcagctccacgaggattccgacgccaagagatgcgtcgtgctgtctggacagatgaccagcttcctgcgcgcgcggtggggcctcgttaaagtgagaggggattccgaccgccatcacgctctggatggcgccattgtcgccgcttgtagccattctatggtgaagcggctttccgactatagcagacgcaaggagctggaacaggtgcgggccggattcgttgatgtcgacacaggcgagatcgtgaaccctgctatgtttcaacaggtgcaggaacacttccccaatccttggccccactttagagatgaggtcaaactccggctgaacgtggacgatccggccctgcttcattctgaaatgaatcgcttcgggacctactcccctgaggcgctgaaggccctcagacccctgtttattagccgggctcctcaacgcagaaactccggagccgctcacaaagacacaatctacgcccagcccgagcggctcgttgcccagggcggggtgacccagaaggtccctctgacgtctcttacactgaaagatctcgacaagctgattgacccccatagaaatgaaaagctgtatagcgctatccgcatccggcttgagcaacacggaggcaaaggggataaggcgttcccggcctccaaccctctgagaaaacccgactctgaaggcaatcccaccggacctattgtgcgcggcgttaccatggtgatcgataagctcagcgggattccgatccggggaggcattgctaaaaacgactccatggtcagagtggatgtttttacaaaggccgggaaattccatctggtgcccgtctacgtgcaccacgccgtggctaaggtcctccctaatcgcgccgttgtggcgtataaggacgagaccgaatggacactgatcgatgacggatttgatttctgctttagcatgtaccccaacgaccttctgcggattaaactcagaaatgcttctcatctgggctattacgcctcctgtaaccgcagcacgggggccatcaatctgtggtctcacgatagaaaccaacaggtgggcaaggacggaatgatcgagtccattggcgtcaaaaccgctcttaatgtggagaagctgaacatcgacgttctcgggaaccggtatcctgcgccccctgaaaaacgcagagatctggcctga

SEQ ID NO: 3965 - RNA, 3384 nt, synthetic construct
  misc_feature 1..3384: note = Cas9 variant
  source 1..3384: mol_type = other RNA
atgagcgacctggtgctcggcctggatatcgggattggatccgtcggcgttgggatccttaacaaggtgaccggagagattatccacaaaaattctagaattttccccgccgctcaggccgaaaacaatgtggagcggcgcatcaacagacaaggccggcgcctgacaagacggaagaaacatcgcagagtccggctcaatcacctgtttgaagagagcgggcttatcacggacttcaccaacgtgtccattaatctgaacccttaccagctccgcgttaagggactgacagatgaactgtctaatgaggagctctttatcgcgctgaaaaacatggtgaagcatagaggcattagctatcttgacgatgcttccgacgatggcaattctagcgtcggggactacgcccagatcgtgaaggaaaactccaaacagctggagaccaagacaccgggacaaattcagctcgaacggtatcagaaatacggccagctgcgcggggatttcaccgttgaggaggacggaaagaaacacagacttatcaatgtgtttcccacaagcgcctatcgggctgaagccctgcgcattctccaaacccagcaggagttcaaccctcagatcacggatgaatttatcaattcttacctgcaaattctgaccggcaagagaaagtattaccatgggcccggaaacgagaaatcccggacagactacggcagatataccacaaagaaagatagcgaagacgagtacatcaccctcgacaacattttcggcatcctgattgggaagtgcacgttttatcctgaggaataccgcgctgccaaagcgtcttatacagcccaggagttcaatcttctgaacgatctcaataacctgaccgtccccacagaaaccaagaaactttccgaggaacagaagaatcaaatcatcaccaacgtgaagaatgagaaagctatgggacctgccaagctgtttaaatacattgctaagctcctgagctgtgacgtggccgatatcaaaggctatcggattgacaagtctgataaggcggagatccacacattcgaagcctacagaaaaatgaagacgctggctaccattgacatcgagcagatggaacgcgagaacctcgataaactggcctacgtccttacactgaataccgaaaaggaggggatccaggaggctctcgaacacgagtttgccgacggaacattctcccaggaacaaattgatgagctggttcagttccggaaagccaacagctccatctttggcaaggggtggcattctttcagcgtgaaacttatgatggagctgattccggaactctatgctacctccgaggaacagatgacgatcctgacaagactgggaaagcagaagaccacctctagctccaataaaacaaagtacattgacgagaaacaactcaccgaagagatctataaccccgtggcggccaagagcgtccgccaggctattaagatcgtgaatgccgccatcaaagagtacggcgattttgacaacattgttatcgaaatggctcgggagacaaatgaagacgatgagaagaaagccattcagaagatccagaaagcgaacaaggacgaaaaagatgctgccatgctgaaggccgctaaccaatataatggcaaggccgagcttcctcactctgtgttccatgggcacaaacagctggctacgaagattagactctggcaccagcagggagagcgctgcctgtacaccggcaaaacaatcagcatccatgacctgattaacaattccaaccaatttgaaatcgatcacattcttcccctctctatcaccttcgacgatagcctggccaataaggtcctggtgtatgcgacagccaaccaggagaaagggcagcggaccccttaccaagctctcgactccatggatgacgcctggagctttagagaactgaaggctttcgttcgcgattctaaggccctttccaataaaaagaaagagtacctgctcacggaagaggacattagcaagtttgatgtgcggaaaaagttcatcgagagaaacctggtcgacacccggtatgcgtctcgcgtggtcctgaatgcccttcaggaacattttagagtgcacaagacagacaccaaagtttccgtggtccggggacagttcacaagccagctcagacgccattggggcatcgagaagacccgggatacgtaccaccaccatgctgtggacgccctgattatcgctgcctcctctcaactgaacctctggaaaaagcagaaaaatacactggttagctattccgaagatcagcttctggacattgagaccggggagctcatctctgatgacgaatacaaggagagcgtgtttaaggccccctatcagcacttcgtcgatacactgaaatccaaggagttcgaagacagcattctgttttcttaccaagtggattccaaattcaacagaaagatcagcgacgctaccatctatgcgacccgccaggccaaagtgggcaaggataaaaaggacgaaacatacgttcttggaaagattaaagatatctactctcagacgggctatgacgcttttattaagatctacaaaaaggacaaatccaagttcctcatgtatagacatgatccgcagacctttgagaaggtcattgagcctatcctggaaaattaccccaacaaagagctgaatgaaaaggggaaagaggtgccttgtaaccccttcctcaagtataaagaagaccacggatacattcggaagtatagcaagaaaggcaacgggcccgagatcaagtctctgaaatactacgatagcaaacttggaaatcacatcgacattacacctaagaactccaataacaaggtggtcctgcaaagcgtgtctccgtggcgcgccgatgtttattttaataagaccacaggcaaatacgagatcctcgggctgaagtatgccgacctgaaattcgaaaagggcaccggaacgtacaaaatttccgaggaaaagtataacgatatcaagattaaagagggcgtggacagcgattccgaatttaagttcacactttacaaaaatgacctcctgctgatcaaggataccgagaccaaagagcagcagctctttagattcctgtctcggacaatgcccaacgtcaagcattatgtggaacttaaaccttacgacaagcaaaagtttgacgataatgaggaactgatcaaaattctcgggatcgttgctaagggaggccagtgcaaaaagggggtgagcaaacccaacatttccatctacaagattcgcaccgacgtcctgggaaatcagcacatcatcaagaacgagggcgataaacctaagctggacttctga

SEQ ID NO: 3966 - RNA, 3384 nt, synthetic construct
  misc_feature 1..3384: note = Cas9 variant
  source 1..3384: mol_type = other RNA
atgaacggcctggtgctcgggctggacatcggaattgccagcgtcggcgttgggatccttgagaaggattccggaaaaattatccacgctaattctagaattttccccgccgcgaccgctgacaacaatgtggaacggcgcacaagcagacaggcccggcgcctgaacagacggaagaaacatcgctccgtgagactccacgatctgtttgaggaatacggccttctgacggacttctctaaggtcagcatcaatctcaacccttatcaaatccgggtgcaggggctggataaacgcctgaccaatgaggaactctttattgccctgaagaacatcgttaagagacggggaatttcctaccttgacgatgcttctgaggacggcggcgccgtgagctccgattatgggaaagctgtcgaggaaaatcgcaagctgctcgcccagcagacaccgggacaaatccagctggacagattcgagaaatacggccaggtgcggggagattttaccgttgtggaaaacggagagaagcgcagacttattaatgtcttcagcacatctgcgtatcggaaagaggccgaaagaatcctgcgcaagcagcaagagtttaacaataagattaccgaaggcttcatcgaggactacctcacaatcctgaccgggaaacggaagtattaccatggacccggcaacgaaaaatccagaacggattacggccgctataccacaaagaaagacagccagggggagtacattaccctggacaatatctttgggattctcatcggcaagtgcacattctatcctgatgagtaccgggcttctaaagcctcctataccgctcaggaatttaacctgcttaacgacctgaataacctcacggtgcccacagagaccaagaagctgagcgtggaacagaaaaagacaattgtcgagtacgccaaaaccgcgaagacccttggggcctctacactgctcaaatatatcgctaagctgatcggagtttccgtggatcaaattcacggctacagaatcgaccctaatgaaaagcccgagatgcatacgttcgaggtgtaccgcaaaatgcagagcctggaaaccattcgggtcgaggaactccctagaaaggtgatcgatgagctggcccacattcttacactgaacaccgaacgcgaggggatcgaggaagctatcaatgccaaactcaaggacatcttttcccaggatcaagttctggagcttgtgcagttccggaaaaacaattctagcctgttctccaagggatggcacaactttagcctcaagctgatgatggaactgattccggagctctatgagacatctgaagaacagatgaccattctgacgagacttggcaaacagaagtccaaagaaacaagcaagcgcaccaaatacatcgacgagaaggaactgaccgaggagatttataatcccgtcgtggccaagtctgttcggcaagctatcaaaattatcaacgaagcgacaaagagatacggcatcttcgataatattgtgatcgagatggcccgggaaaacaatgaggaagacgctaaaaaggagtatattaaacgccagaaggccaacctcgatgagaaaaatgccgctatggaaaaggccgcgtttcagtacaacgggaagaaagagctgcctgacaacgtcttccatggacacaaggaactggctaccaaaatcagactttggcatcagcaaggcgagaagtgtctctatacagggaaaaatattcccatcagcgacctgatccagaaccggtacaagtacgaaattgatcacatcctgcctctctccctgtcttttgacgatagcctttccaataaggtgctggtcctcgccacggccaaccaggagaaaggacagagaacccccttccaagctctggacagcatggattatgcctggtcttaccgcgagtttaagtcctatgtgaaagacagcaagctgctttctaataaaaagaaggattacctcctgacagaagaggacatttccaaaatcgaagttaagcagaaattcattgagcggaacctggtggataccagatatagctcccgcgtcgtgctcaatgctctgcaggacttttacaaggagcaccagttcgatacaaccatctctgttgtgagaggccaatttacgagccagcttcggcgcaaatgggggatcgaaaagtccagagagacctatcatcaccatgccgtcgacgcgctgattatcgccgcttctagccagctccggctgtggaagaaacacaacaatccgctgatttcctacaaggaggagcaattcgtggatagcgaaacaggcgagatcatttctatgtccgacgacgagtacaaagaacttgtgtttaaggccccttatgatcatttcgttgacaccctcaaaagcaagaaattcgaggattctatcctgttttcctaccaggtcgacagcaagtataaccgcaagatctctgatgctacaatttacgccaccagaaaagcgaagctggacaaagataagagcgaagagacgtatgtgctcggaaaaatcaaggacatttactcccaggccggctatgatacattcatcaagatttacaataaagacaagagccggtttctgatgtaccacaaagatccccagaccttcgaaaaggtgatcgaggagattcttcgcacatatccttctaaagaactgaacgagaagaataaggaagtcccctgcaacccctttgagaaatacagacaagaaaatgggcctatccggaagtattcccgcaaaggaaacggcccggagatcaagagcctcaaatactatgacaacaagctggggaatcacattgatatcacccccaacgagtccatgaatcaggtggttctgcagtctcttaagccttggagaaccgacgtgttctttaaccatcagacagaaaaatacgagctcatgggactgaagtatagcgacctgaatttcgaaaaaggctccgggaagtactctattagcctcgagaaatacaactccatcaagatgaatgagggcgtctctgaagagagcgaatttaagttcacgctgtataaaaacgatcttattctgatcaaggacgctctcaccaaagaggcccaaatctttcggtacggatccagaaatgatacaagcaagcactatgtggaactgaaaccctacgacatgtctaagttcgagggcgatgagcgcctgattaaagttcttgggaccgtggctaagggaggccggtgtatcaaggggctgaacaaaaaggacatttccatctttaaagtcaagacagatgtgctcggaaataaacatttcattaagaaggaaggcgaggaacctaaactgaagttctga

SEQ ID NO: 3967 - RNA, 3387 nt, synthetic construct
  misc_feature 1..3387: note = Cas9 variant
  source 1..3387: mol_type = other RNA
atgaccaagctgggcaaaccctacgggatcggagtggacattggcagcaactccatcgggttcgccgctgtcgatgaaaattctcacctcattagactgaagggaaaaacagttatcggcgcccggctttttgaagaggggaaggcggctgccaaacgcagagccggacggacgacccgcagacggctgagccgcaacagatggcggctctccttcctgcgcgactttttcgaatctcatattacacctaccgatccgaactttttcatgagacagaagtatagcgagatctcccccaaggacaaagctcggtacaagtatgaaaaacgcctttttaatgatagaacagacgccgagttctaccaacagtattctaccatgtaccatctgcggaatcgcctcatgacagatcctagcagagctgacgtgcgggagatctattttgccattcaccacatcctgaagtccagaggccatttcctgacccccggcgatgcgaaagactttaacacgaatgatgtggccctcgacgaaattttccctgctctgcaggatgcctacgctcaggtctaccccgaccttgggatcacctttgacgaggataaggccaacgagttcaagacaattctgctcaatgagatcgcgaccagcattgacacacaacgcgccctggtgaaacttctgctcgctgaggaagatgacaaggatatcctgaaacagcagaagcaggttctgaccgagttcgccaaagctgtggtcggactcaagacgaaactgaaccttgccctgggcacagaagtggactcttccgaggccaccgcttggaattttagcctcgggcaactggatgacaagtgggcgggaatcgaatctgccatgacagatgagggcaccgagattcttgaccagatccgggatctgtatagagctcgcctcctgaacgggattgttcctaccggaaagacactgtcccaggccaaagtggacgactacacgcagcaccacgaagatctccaactgttcaaggcctatcttaaacagctggaggacgatggcaccgctaaggccatccggcagctctacgacagatatattgatggcgacgatgcggctccgtttctgcgcgaaaatttcgtcaaagcccttacaaaggacgtgaccgcccatcccaacacaaagagccctgagctgctcgaacggctggctcaacccgattttatgctgaaacagagaaataaggccaacggggctatccctgtgcagatgcagcaacgcgagctcgaccagatcattaaaaaccaggccgtctactatgattggctggcggcccccaatccggttgagaagcaccggaaatctatgccttaccagcttgacgaactgctcaacttcagaatcccctactatgtgggacctctggtgaccgctaaggagcaaaaggccgctcagggcggggtctttgcctggatggtgcgcaaagatcccgaaggaaatattacgccctacaacttcgacgagaaggttgaccgggaagcgtccgccaatacatttatccagagaatgaaaaccaccgatacatatctgattggcgaggacgtgcttcctaagcagagcctcctgtaccaacggtatgaggtcctgaacgaactcaataacgtgcgcgttaataacgagaaactgtccatcgaacagaagcaacaggtgatcagagagcttttcgagcggcataattctgtcaccattaagcaatttgctgaaaacctgagagcccacggggattacgctcacatcccggagattcgcggactcgccgacgaaaaacggttcctgagctccctgagcacatatagacagcttaagtctctcctgcccgaggccatcgatgaccctgctaaacaggcggatattgaaaatatcattgcctggtccacggtgtttgaggacgctgccatcttcaagaccaaactgaaggagatcagctggctcggctctgaagccattacaaaactgagcaacatccgctacagaggctgggggcaattctcccggaagtttcttaatggactgaccctcggcaacgggcatacaattatccaggagctgctgctttctaccaacaatctcatgcagattctgacggatgaaaccctgcagaagaaaatgacagagctcaacgctgacaagctgaaaaccgccaatatcaacgatgcgatcgacaatgcttacacaagcccctccaacaagaaagcccttcgccaagtcctgagagtggttgatgacattaagcgggccgctgacggacaggatcctagctggctctatgtggaaaccgccgacggcgggggcacgcccggaaagcgcacaagagcgcggcagcaccagctgcaagagatctacgctaatgccgcccatgagctgattgataccgctgtccgcggcgaacttgaggacaaaatctctgataaggccgacttcaacgatagactcgtgctgtattttatgcaagggggacgggacatttacacaggcgctccgctgaatatcgatcagctctccagctatgacatcgatcacattctgcctcagtctcttatcaaagacaactccctggacaatcgcgttctcgtgcatgccattatcaacagagaaaagaatgcgaccttcgccagcaccatttacgctcagaaaatgaacgccacatggcggcagtggcacgaggctgggctgatctccggaagaaagctgcgcaatcttcagatgcggcccgatcagatcgacaagtatgcctctggctttgtcgccagacagctggtggaaacgcgccagattatcaaactcaccgagcagattgtggctgcgcaataccctgatacaaagatcattgccgttaaagctgggctgagccaccagctccgggaggaactggagttccccaagaacagagacgtcaaccattaccaccatgcctttgatgccttccttgctgcccgcatcggcacctatctgctcaaacggtttcctaatctgcaggcgttctttacatacggaaagttcaccaaggctgacgtgaaaaagctgagaggctttaacttcattcgcgatatcacgcacgccgaagacaaaatcgtggccaaggatacaggggaggtcgtgtgggacaaacagcgggatgttgacgagcttgatagaatttataatttcaagcggatgctgatcacccacgaagtgcgctttgagaccgctgacctcttcaaacaaacagtctacggagccagagactccaaggaagcgggcgggtctaagcagctgattcccaaaaagaaagatatccagctcatttttatgggagctatcagcgagcggacccgcccgatcctgcctctttga

SEQ ID NO: 3968 - RNA, 3387 nt, synthetic construct
  misc_feature 1..3387: note = Cas9 variant
  source 1..3387: mol_type = other RNA
atggacgagaagatggattacagaatcggcctggacattgggatcgccagcgtgggatgggctgtcctccagaacaattccgatgacgaacccgttcggattgtggatctgggcgtgcgcatcttcgacaccgccgagattcctaaaacaggggaatctcttgcgggaccgagacgggctgcccgcacgaccagacggcgcctgagacggcgcaagcacagactcgatcggatcaaatggctgtttgagaaccaaggccttatcaatattgacgatttcctgaagcgctataacatggccgggctccccgacgtctaccagctgagatatgaagctctggatcggaaactcacagacgaggagctggcccaggtgcttctgcatatcgctaagcaccgcggatttagaagcacccggaaggccgaaacagcggccaaagagaatggcgctgttctcaaggccaccgatgaaaaccagaaaagaatgcaagagaagggctaccgcacagtgggggagatgatttatctggacgaggctttccggatcggatgctcctggtctgagaaaggctacattcttacccctagaaataaggccgaaaactatcagcatacgatgctgcgcgcgatgctcgtcgaggaagtgaaggagatctttagctcccagcggagactggggaataaaaaggccaccgaggaactggaggaaaaatacctcgagattatgacatctcagcgcagcttcgacctgggacccggcatgcaacctgatgggaagccctccccttacgctatggaaggatttagcgaccgggttggcaaatgtaccttccttggcgatcagggggagctgagaggagccaagggcacatataccgctgagtactttgtggccctccagaaaatcaaccacacgaagctggtcaatcaggacggggaaacacgcaacttcaccgaggaagaacggagagcccttacactgctcctgtttacccaaaaggaagtgaaatatgctgcggtgcgcaagaaactgggactcccggaggatatcctgttctacaatcttaactataagaaagccgctaccaaggaggaacagcagaaggagaatcaaaacacagaaaaagccaagtttattggcatgccctactatcatgactacaaaaagtgcctggaggagcgggtcaaatacctcacggaaaacgaggttagagatctgttcgacgaaatcgggatgattcttacctgttataagaatgatgactctcggacagagcgcctggccaagctcggactggtgcctatcgaaatggagggcctgctcgcttacacccccacaaaattccagcacctgtccatgaaggccatgagaaacattatcccttttcttgagaaaggcatgacctatgataaggcgtgcgaagaggctgggtacgacttcaaagccgacagcaagggaacgaagcagaaactgctcacaggcgaaaatgtgaaccagaccatcaatgagattaccaaccccgtcgtgaagcggtctgtttcccaaacagtgaaagtcatcaatgccattatcagaacctatgggagcccgcaggctattaacatcgaactggcccgcgagatgtctaagacatttgaggaacggagaaaaatcaagggagatatggagaaacgccagaagaataacgaagacgtgaagaaacagattcaagagctgggcaaactttcccctacggggcaggatatcctcaagtacagactgtggcaggaacagcaaggcatttgtatgtatagcggaaagaccatccccctggaggaactcttcaaacctggctacgacattgatcacatcctgccctactccattacatttgacgattctttccggaataaggttcttgtgaccagccaggaaaaccgccagaaggggaatagaacaccctatgagtacatgggaaacgacgaacagcggtggaatgagtttgagacccgcgtcaaaacgaccatcagagattataagaaacaacagaagctgctcaaaaagcatttctccgaagaggaacggagcgagtttaaggaacgcaacctgacagacaccaaatacatcacaaccgtgatttataacatgatcagacagaatctggagatggctcctcttaaccggccggagaagaaaaagcaagtccgcgccgtgaatggcgcgattacggcctacctcagaaaacggtgggggctgccccagaagaacagagaaacagatacccaccatgctatggacgccgttgtgatcgcttgctgtacagatggaatgattcagaagatctctcgctataccaaagtccgggagagatgctactccaagggcaccgagttcgtggacgccgagacaggggaaatctttcgccctgaggactacagccgggcggagtgggatgaaattttcggcgttcacatccccaaaccttgggagacgtttagagccgaactggacgtgcgcatgggagatgaccccaagggcttcctcgatacccactctgacgtcgctctggagcttgattatccggaatacatttatgagaatctgcggcctatcttcgtgagcagaatgcccaaccataaagtgacaggggccgctcacgccgacaccattcgctcccctcggcattttaaggatgagggaatcgttctcacaaaaaccgccctgacggacctgaaacttgataaggacggcgaaatcgatgggtactataatccccagtctgacctcctgctgtacgaggctctcaagaagcaactgcttctgtatggaaacgacgcgaaaaaggccttcgctcaggattttcacaaacctaaggccgacggcacagaagggcccgtcgtgagaaaggtgaaaattcagaagaaacagaccatgggcgtcttcgtggatagcggaaatggcatcgccgagaacgggggaatggttcggattgacgtgtttcgcgtcaatggcaagtactacttcgtgccggtttataccgctgatgtggtcaaaaaggtgctccctaacagagcctccacagcgaataagccctacagcgagtggcggaccatggaagacaaagattttctgttctctctgtattcccgcgaccttgttcatatcaagagcaaaaaggggattcccatcaaaaacgtggatggatctctcggcgagtccaaggaagtctacgcttattacatcggggccgacattagcggcgccaagatcgagggaaaagctcacgattccagatatacatttcggggcattggggtgcaaaagctggaactgatcgagaaatgtcaggtggacattctcggacacatctctacggtcaagaatgagaaaagaatgggcttcagctga

SEQ ID NO: 3969 - RNA, 3387 nt, synthetic construct
  misc_feature 1..3387: note = Cas9 variant
  source 1..3387: mol_type = other RNA
atgaacgacaagaatcagaaatacagactgggcctcgatctggggaccaacagcatcggatggtgcatttattcccttgacgtgaataacaagcccgagacactgatcgatatgggcgtccggattttctctgacgggcgcgatcctaaaacgaaggaaccgctcgccgttgagagacggaccgctcgcggactgagacggatccttcaccgcagaaaactgcggcgcagacaaatgtttcggctcctgcaggaacagggcctgatgcccaatgacgccagcgaggcggctgccctcaagtccctgaacccttacgaacttcgcgtgaaggccctggatacaaaactcgagccctatgagctggggagagctcttttcaatctgtctgtgcggcgcggatttaagagcaacagaaaagaagccgtccaggagaaggaaaaagactcccaaaatgatgctaagtctcagaacgagaagtgtgagcatctcgccaaagcgattaaggacagcggctgccggaccctgggcgagttcctgtggaaacacaagaatacagagacccagcagacagaaaacgatgccagaaatatcgggatgcgctttgtgcctggacggtccaactactatcccaccagacgcatgtacgttgaggagttcgacgctatccggaaagcccaagaaccttattacagcggcgtgaattgggatgctctccatgagaagctgttttaccagagaccgcttcgcgcccaggaacgggggaaatgtagatatatgcccgacaaggagcgcacgttcaaggcgatgccttgctctcagaaaattcggatcctgcaagaagtctacaacatggactatattgatgagtacggaaagaccatccccctcgaagaggcccagacagactccctgattagccttctggataaaagagagaagctctcttttaaagctatgaagaaggaactgggcatcgacgagtcctgtaccttcaacctggaacgcgggggacgggagtatctccagggcaatgccgctgccgtgaaactgagaaacaagaaacggtttggcgaactttgggatagcctgtctctcgccaagcaagacgctattgttgagaaactgatcacagcggatgaggacgccgaaatcatttccatgcttgctcagtacaatctgaccgatgagcagaagaagaacatcgccgtgacggtcctccctagcgggacagccatgctgtgcaaagaagtgaccgagatgctggtgcagaagatggagcaaaataaaattcccctcacagtcgctgttcagatgctgggatatacctacgccgaccagtccgtgcgcgaagaggatacccttccgtactatggcgcgatcctgacagggtctacgatgggagctcaccctgaagccgacgagagcgaacccgagctcaagtacggcaaaatttccaaccctaccgtgcatgtcgccctgaatcagacaagaaccgtggttaacgctctgatcaaggcctatgggaagccccaacagatcgtggtcgagcttagccgggacctcaaggcttctagagaagccaaagcgcgcattcagaaaacaatcaccatgaatcagaagcggaacgagagagataataaaaacattacggacatcacaaagattccctaccctaatcgcaacgatagactgaaatatcggctgtgggaagaactcggatccggcagcaattctttcagccgcaagtgtctgtactgcggcaagccgatctccgggtctgaaatctttaccgagaacattgagatcgaacacattcttcccttcggaagaaccctgttcgacggcgagacaaacaaaaccgtggcccacacagattgtaatcgggacaagggggatcgcagcccttttgaggctttcggatccagccccaacggctataattggcatgaaatctgcgccagagctaactctctcaaaaatcctgccaagcggacgctgtttgcggaaaacgccatggagaaattcgagaaggacaattcctttattcaacgccagctgaccgataacgcttaccttagcagatctgccctccggtacctgcgctgtatctgcaaggacgtttggtccattaatgggggcatgacaaaactgctcagagataagtggaacatcgacagcatcctgaaacggaagattgatgaccccgaaatcgctcacttcgagcttaaaaatgaccagattggacagtataagaagaacagatacgatcatcgccaccacgccctggacgcctccgtgatcgctctcattgatcgggcgatggtccaagaaatctctcagctgaataaaatcagactgaagaaccgcattgaggccccgcagatgcctgtgcttcggagcgagctcatcgaaaaagtcaagcatattaccgtgtcctttaaacccgaccacggcagacaagggaagctgtctaaggagacactgctcggaaaaatcaagaaaattgaaaaggttgatatcgacagcatccagaccgatgacattgcttccatcaaagatgacgccattcgcacgcggttcgagaccaagagacgcgaactgggcgatatcacaaaagccaaggctgcccttaagaccgagtttcctaaactggacgtgttcaagacatattacgtcagccggacccccattgtgtctctcacggagaaaaatatcaactccatcgttgatgaaaagattaaagagaagctgaagacatttatcaaagaacatgcggacctgagcttcgctgagcagcttcagaagttttctgaaaccgagtggattgggaaaccttccgccgccggaaagcccggcaaaaagtatagaatcgagaaggtgcggtgcattaactgggggcaaacaccgatcaccattaccagctctgctgtccctcgctacctctgtcccgaagactatctggccgcggtggtgtggcagatccccagcaaaaagaaagatacagagcctgaatacaaggctacgttcctgagacgggacgagttcgatgttaataacaaaccgaagaagctcgaaaaaccccacgacgccgcccagtacatctgcatgctgtataaggatgactaccttgagtttaccgagtccggcgctacacatctgtgtcgcattgccggactccctgctagccagaataacaaaatcgatattagacccatctatgccgtctctgactgcaaggattggattatcgcgaccaatgaaaacatgctggagccttgttggaaaccccaaaaggaagagaagcggatctccgtgaatgtgctgttcggcaaacacaaggccagaagcgtcacagtgaaccctattgggcgcgtttttcggaaatga

SEQ ID NO: 3970 - RNA, 3387 nt, synthetic construct
  misc_feature 1..3387: note = Cas9 variant
  source 1..3387: mol_type = other RNA
atgagcgacctggtgctcggcctggatatcgggattggatccgtcggcgttgggatccttaacaaggtgaccggagagattatccacaaaaattctagaattttccccgccgctcaggccgaaaacaatgtggagcggcgcacaaacagacaaggccggcgcctgacgagacggaagaaacatcgcagagtccggctcaatcacctgtttgaagagagcgggcttatcaccgacttcacaaaggtgtccatcaacctgaatccttaccagctccgcgttaaaggactgattgatgaactgtctaacgaggagctctttatcgcgctgaagaatatggtgaagcatagaggcattagctatcttgacgatgcttccgacgatggcaactctagcgtcggggactacgcccagatcgtgaaagaaaattccaagcagctggagaccaaaacaccgggacaaattcagctcgaacggtatcagaagtacggccagctgcgcggggatttcaccgttgaggaggacggaaagaagcacagacttatcaacgtgtttcccacaagcgcctatcggtctgaagctctgcgcattctccaaacccagaaggagttcaatcctcagatcacggatgaatttatcaacagatacctggagattctgaccggcaaacggaagtattaccatgggcccggaaatgaaaaatccagaacagactacggccgctataccacaaagaaagatagcgagaacgagtacatcaccctcgacaacattttcggcatcctgattgggaagtgcacgttttatcctgaagagtaccgggccgctaaagcctcttatacagcgcaggagttcaatcttctgaacgacctcaataacctgaccgtccccacagaaaccaagaaactttccgaggaacagaaaaatcagatcatcaactacgtgaagaatgagaaagccatgggacctgctaagctgtttaaatatattgccaagctcctgagctgtgatgtggctgacatcaagggctacagaattgataaatctgacaaggccgaaatccacaccttcgaggcgtaccgcaaaatgaagacactggaaacgattgattttgagaaaatgtcccgggaccagctcgataagctggcctatgtccttaccctgaacacagaaagagaggggatccaagaggctctcgaccacgagttcgccgatggaaatttcagccaggaacagatcgacgaactggttcagtttcgcaaggctaactcctctattttcggcaaagggtggcataattttagcgtgaaacttatgatggagctgatcccggagctctacgccacctccgaggaacaaatgacaattctgacccggctgggaaaacagaagacgacatctagctccaacaaaaccaagtatatcgatgaaaagctcctgaccgaggaaatttacaatcccgtggtcgccaaaagcgtgagacaggctatcaagattgttaacgcggccatcaaagagtatggcgacttcgacaatatcgtgattgagatggctcgcgaaacaaacgaggatgacgaaaagaaagccatccagaagattcaaaaagccaacaaggatgagaaggacgctgccatgcttaaagcggctaatcagtacaacggccgggccgaactgcctcactctgtctttcatgggcacaagcagctcgccaccaaaatcagactgtggcaccagcaaggagagcgctgcctgtatacaggcaagacgattagcatccatgatcttatcaataaccccaatcagttcgagattgaccacatcctccctctgtccattacctttgatgactctctggctaacaaagtgctcgtttacgccacagctaatcaggaaaaggggcagcggaccccctaccaagccctggatagcatggacgatgcgtggtccttcagagagcttaaggcctttgtgcgggaaagcaaatctctgtccaacaagaaaaaggagtatctcctgacagaagaggacatcagccgcttcgatgtcagaaagaagtttattgagcggaatctggtggacaccagatacgcttctcgcgtcgtgcttaacgccctccaggaacatttccgggctcacaagacggacaccaaagtttccgtggtcagaggacagtttacaagccaactgcgcagacattggggcatcgagaagacccgggatacatatcaccaccatgccgtggacgcgctgatcattgccgcttcctctcagctcaatctgtggaaaaagcagaaaaacacccttgttaattacagcgaaaaccagctgctcgatatcgagacgggggagctgatttccgacgatgaatataaggagtctgtgttcaaggccccgtaccaacacttcgtcgacacactgaaaagcaaggaatttgaggattccatccttttcagctatcaggtggactctaaatttaatcgcaagatttccgatgctaccatctacgccacaagacaggccaaagtgggcaaggacaaaaaggatgaaacctacgttctcggaaagatcaaagacatttatagccagaccggctacgatgctttcatcaagatttatcaaaaagacaagtctaaatttctgatgtaccggcatgaccctcagacattcgagaaggtcatcgagcccattctggaaaactatcctaacaaggagatgaatgaaaaagggaaggaggtgccctgtaacccctttctcaaatacaaggaggaacacggagattatatccgcaaatactccaagaagggcaatgggcctgagattaaaagcctgaagtactatgactctaaacttggaaaccacatcgatatcacgccgaaggacagcaataacaaagtggtcctgcagtccgtgagcccctggagagcggatgtttacttcaataagaccacaggcaagtatgaaattctcgggctgaaatacgccgacctgcagtttgagaagggcaccggaacatataaaatctctcaagaaaagtacaacgtgattaaaaagaaggagggcgtcgattccgacagcgagttcaaatttaccctttataagaatgatctcctgctgatcaaagacacggaaacaaaggagcagcaactcttccggtttctgtcccgcaccaaacctaacgtgaagcattacgttgaacttaaaccctacgataagcaaaagttcgaggggaatgaatctctgattaacgtgctcggagctgtcgccaaaggcgggcagtgccagaagggaatcaataaacctaacatcagcatttataaggtgagaaccgacgttctgggcaatcagcacatcattaaaaacgagggggacaagcccaagctggatttctga

SEQ ID NO: 3971 - RNA, 3387 nt, synthetic construct
  misc_feature 1..3387: note = Cas9 variant
  source 1..3387: mol_type = other RNA
atggacgagaagatggattacagaatcggcctggacattgggatcgccagcgtgggatgggctgtcctccagaacaattccgatgacgaacccgttcggattgtggatctgggcgtgcgcatcttcgacaccgccgagattcctaaaacaggggaatctcttgcgggaccgagacgggctgcccgcacgaccagacggcgcctgagacggcgcaagcacagactcgatcggatcaaatggctgtttgagaaccaaggccttatcaatattgacgatttcctgaagcgctataacatggccgggctccccgacgtctaccagctgagatatgaagctctggatcggaaactcacagacgaggagctggcccaggtgcttctgcatatcgctaagcaccgcggatttagaagcacccggaaggccgaaacagcggccaaagagaatggcgctgttctcaaggccaccgatgaaaaccagaaaagaatgcaagagaagggctaccgcacagtgggggagatgatttatctggacgaggctttccggaccggatgctcctggtctgagaaaggctacatccttacgcctagaaataaggccgaaaactatcagcataccatgctgcgcgcgatgctcgtcgaggaagtgaaggagatttttagctcccagcggagactggggaatgagaaagccacagaagaactggaagagaagtacctcgaaatcatgacctctcagcgcagcttcgacctgggacccggcatgcaacctgatgggaaaccctccccttacgctatggagggatttagcgaccgggttggcaagtgtacattccttggcgatcagggggagctgagaggagccaaaggcacctatacggctgaatactttgtggccctccagaagattaaccacacaaaactggtcaatcaggacggggagacccgcaacttcacagaagaggaacggagagcccttaccctgctcctgtttacccaaaaggaggtgaagtatgctgcggtgcgcaaaaagctgggactcccggaggatatcctgttctacaatcttaactataaaaaggccgctacaaaagaagaacagcagaaggaaaatcaaaacacggagaaggccaaatttatcggcatgccctactatcatgactacaagaaatgcctggaggaacgggtcaagtacctcaccgagaacgaagttagagatctgttcgacgagattgggacaatccttacctgttataaaaatgatgactctcggacagaacgcctggccaagctcggactggtgcctattgagatggagggcctgctcgcttacacccccacgaagttccagcacctgtccatgaaagccatgagaaacatcattccttttcttgaaaagggcatgacatatgataaagcgtgcgaggaagctgggtacgacttcaaggccgacagcaaaggaatcaagcagaagctgctcaccggcgagaaagtgaatcagaccatcaacgaaattacaaatcccgtcgtgaagcggtctgtttcccaaaccgtgaaagtcatcaacgccattatcagaacatatgggagcccgcaggctattaatatcgagctggcccgcgagatgtctaagacgtttgaggagcggagaaaaatcaagggagatatggaaaaacgccagaagaacaatgaggacgtgaagaaacagattcaagaactgggcaaactttcccctaccgggcaggatatcctcaagtacagactgtggcaggagcagcaaggcatttgtatgtatagcggaaagacaatccccctggaggaactcttcaaacctggctacgacattgatcacatcctgccctactccattacctttgacgattctttccggaacaaggttcttgtgacaagccaggagaatcgccagaaggggaacagaaccccctatgaatacatgggaaatgacgagcagcggtggaacgagtttgaaacgcgcgtcaaaaccacaatcagagattataagaaacaacagaagctgctcaaaaagcatttctccgaggaggaacggagcgaatttaaggagcgcaatctgaccgacacaaaatacatcaccacggtgatttataacatgatcagacagaacctggagatggctcctcttaatcggccggaaaagaaaaagcaagtccgcgccgtgaacggcgcgattacagcctacctcagaaaacggtgggggctgccccagaagaatagagagaccgatacacaccatgctatggacgccgttgtgatcgcttgctgtaccgatggaatgattcagaagatctctcgctataccaaagtccgggaaagatgctactccaagggcacagagttcgtggacgccgaaacgggggagatctttcgccctgaggactacagccgggcggaatgggatgagattttcggcgttcacatccccaaaccttgggaaacctttagagccgagctggacgtgcgcatgggagatgaccccaagggcttcctcgatacacactctgacgtcgctctggaacttgattatccggagtacatttatgagaacctgcggcctatcttcgtgagcagaatgcccaatcataaagtgaccggggccgctcacgccgacacaattcgctcccctcggcattttaaggatgaaggaatcgttctcaccaaaacggccctgacagacctgaaacttgataaggacggcgagatcgatgggtactataacccccagtctgacctcctgctgtacgaagctctcaagaagcaactgcttctgtatggaaatgacgcgaaaaaggccttcgctcaggattttcacaaacctaaggccgacggcaccgaggggcccgtcgtgagaaaggtgaaaattcagaagaaacagaccatgggcgtcttcgtggatagcggaaacggcatcgccgagaatgggggaatggttcggattgacgtgtttcatgtcaacggcaagtactacttcgtgccggtttatacagctgatgtggtcaaaaaggtgctccctaatcgcgccgcgaccgctcacaagccctacggggaatggaaagttatggaggacaaggattttctgttctccctgtatagcagagaccttatccacattaaatctaagaaagatatccccatcaagatggtgaacggaggcatggaagggattaaggagacatacgcctattacatcggcgccgacatttccgctgccaatatccaaggaattgcgcatgatagccggtataaatttcgcggcctcgggatccagtctctggacgtcctggaaaagtgtcagattgacgtgctcggacacgtgtccgtcgttagaagcgagaaacggatgggcttctcctga

SEQ ID NO: 3972 - RNA, 3387 nt, synthetic construct
  misc_feature 1..3387: note = Cas9 variant
  source 1..3387: mol_type = other RNA
atgagcgacctggtgctcggcctggatatcgggattggatccgtcggcgttgggatccttaacaaggtgaccggagagattgtgcacaaaaatgccagaatcttccccgctgcccaggcggaaaacaatgtcgagcggcgcacaaacagacaaggccggcgcctgacgagacggaagaaacatcgcagagtgcggctcaatcacatttttgaagagtctgggctgatcaccgacttcacaaaggttagcatcaaccttaatccttaccagctgcgcgtgaaaggactcaccgatgaactgtccaacgaggagctgtttattgctctcaagaatatggtcaagcatagaggcatctcttatctggacgatgccagcgacgatggcaactcctctgtgggggactacgcccagattgttaaagaaaatagcaagcagcttgagacaaaaaccccgggacaaatccagctggaacggtatcagaagtacggccagctccgcggggatttcacaattgaggaggacggcaaaaagcacagactgatcaacgtgtttcccacctccgcttatcgggccgaagcccttcgcattctgcaaacgcagcaggagttcaatcctcagatcaccgatgaatttatcaacagctacctccaaattctgacaggaaagagaaaatattaccatgggcccggaaatgagaagtctcggaccgactacggcagatatacaaccaaaaaggattccgaagacgagtacatcacgctggacaacattttcggcatcctcattgggaaatgcacattttatcctgaggaataccgcgctgcgaaggccagctataccgctcaggagttcaacctgcttaatgatctgaacaatctcacagtccccaccgaaaccaaaaagctgtctgaggaacagaagaaccaaatcatcacatacgtgaaaaatgagaaggccatgggacctgctaaactttttaagtatattgccaaactgctcgcgtgtgacgtggccgatatcaagggctaccggattgacaagtccgataaaccggagatccacacgttcgaggcttacagaaagatgaaaaccctggagacaattgacgtcgaacagatggagcgcgaaaagctggataaactcgcctatgttctgacccttaacacagagcgggaggggatccaggaagctatcgagcacgaatttagcgacggaaccttctctcaggagcaagtggatgagctggtgcagttcagaaagtccaatagctccatttttggcaaggggtggcataacttctctgtcaaactcatgatggaactgatccccgagctttacgccacgagcgaagaacagatgacaattctgacccgcctcggaaagcagaaacggacctccagctctaataagacaaaatatatcgacgaaaagagactgaccgaggagatttacaaccctgtggttgccaagtccgtgcgccaagctatcaaaattgtcaatgcggccatcaaggaatatggcgattttgacaacatcgtgattgagatggctcgggaaatgaatgaggacgatgagaaaaaggccatcaaaaagattcaggaagccaacaaaagcgagaaggacgctgccatgagaaaggcggctaatcagtacaacggcaaagccgaactgccccactctgttttccatgggcacaagcagctcgccacaaaaatccgcctgtggcaccaacagggagagcggtgcctttatacgggcaagaccattagcatccatgatctgatcaacaatcctaaccagtttgaaattgaccacatcctccccctgtccattacattcgatgactctctggctaataaagtgcttgtctacgccaccgctaaccaggagaaggggcaaagaacaccgtaccaggccctcgatagcatggacgatgcgtggtcctttcgggaactgaaggccttcgtgcgcgagagcaaaaccctgtctaataagaaaaaggagtatctcctgacggaagaggacatctccaaatttgatgtcagaaagaagttcattgaacggaaccttgtggacaccagatacgctagccgcgttgtgctgaatgccctccaggagcattttcgggctagaaaaatcgatacaaaggtctctgtggttcgcggacaattcacctcccagctgagacggcactggggcatcgacaaaacacgcgacacctatcatcaccacgccgtggatgcgctgattatcgccgctagctcccagcttaacctctggaagaaacagaagaatacgctggtctcttacagcgaggaccaactgctcgatattgaaacaggggagctgatctccgacgatgaatataaggagtctgtgtttaaagccccttaccagcatttcgtggacacccttaagagcaaagagttcgaagattccattctgtttagctatcaggttgactctaagttcaacagaaaaatctccgatgctacaatctacgccacccggcaggccaaggtcggcaaagacaagaaggatgagacctacgtgctcggaaaaattaaggacatctatagccaagctggctacgatgcgtttattaaaatctatcagaaggacaaatctaagttcctgatgtaccgccacgacccccagacatttgaaaaggtgattgagcctatcctggaaaattatcccaacaaagagatgaatgaaaaggggaaagaggtcccctgtaaccctttccttaagtacaaagaggaacatggagattatattagaaagtactccaagaaaggcaatgggccggagatcaagagcctcaaatactatgactctaagctgggaaaccacatcgatattacgcccaaaaacagcaataacaaggtggttctgcagtccgtgagcccttggcgggccgacgtctactttaataagaccacaggcaaatatgaaatcctcgggctgaagtacgctgatcttcaattcgagaaaggcaccggaacatataagatttctcaggaaaaatacaacgacatcaagaagaaagagggcgtggattccgacagcgagtttaagttcaccctgtataaaaatgatctcctgctgattaaggacacggaaacaaaagagcagcaactttttcgcttcctctccagatctatgcccaacaagaaacactacgttgaactgaagccttacagcaaggataaatttgagaagaatgagaccctgatcgaaatcctcgggcccaccgacaaatccggacggtgcattaagggcctggccaaatctaaccttagcatcttcaaggtgcgcacagacattctggggaatcagcatatcattaagaacgagggagataaaccgaagctcgacttctga

SEQ ID NO: 3973 - RNA, 3387 nt, synthetic construct
  misc_feature 1..3387: note = Cas9 variant
  source 1..3387: mol_type = other RNA
atgaccaagatcctgggcctcgacctggggacaaacagcattggatgggccgtggtcgatgagaaaaaggagaaaatccttggcatggggtccagaattttccccgagggagttgtgaatatcggcgaaggggagggacgggaaacgtctaagaacgctagccgcaccgacgccagaggcacacggcgccagtttttcagacggcgcctgagaaaacggtacctcctgcgcgagcttgcgaagaagggcctgtgccctattaattataccctcgtgaaagagtggaacgaagctcaaatctttaagaataaacagctgcaggagtggttcaagctgaacccgtacgaactcagatccaaagccatccaggagaagatttctctggaggaacttgggcggatcttttatcacttcattcaacgcagaggatttcagagcaattcccggtctgccggcgtcgataacatcgaaaagagcgtgattttcaaaggggacacaaagaccggaaaaatcggcatttccgaaacactggagagcatcaagaataccaaaacgctcgggtcttacctgcataccatctatcccaagcagaacaaaccttactccggacacaaggaacgcattagaaatcggtatacaaccagacagatgtacatctacgagtttgagacaatttgggaatatcaaaagcagttctacagcgagctttctaacgaactgaaaaccgttctcggcggccgcaagaaagatgggtataaggaggacggaatcctgtttcatcagcggcccctgagatcccagaaacacctcgtgggctactgtagcttcgaacctaagaagacgaaatgccaaattaatacaatcccctttgagctgttccgcatctatcagtgggtcaacaccgtggattgtaatgagaaggttacatctgaagaccgggggaaaatggtggagcttctgctctccaaggaaaaagtcagcttcaaggagattagaaaggtgatcaacaaatccgatggatactatcagtttaactacaagaatgacgataaaattgtgggctcttacaccatcagcaacctgtccaataagaaattctttgggaagaagtggttcgactttagcgataaagaacaagaggacatttggcatgtcctttctttctttgacgatcgcgacaagctgaaacagtatgctatcaagtactggggattcaacgaggaaaaagccgttaagatctccaaatttaatctcaaggagggctatagcaacctgtctcggaaggctattcacaatatcctgcctttcctcaaactgggctttatgtacgatgtggccgtggggcttggaggcgtcaagaacgcgctggccgacaaatggattgaaaatgagcagttcatcctcgataacgtgccgagcgttgtgagatccaattttaaagggggatatattgagcccctgaaacagatgcttaagtacgagttcgacgtctctgataagcaactgctcaaactgtatcaccatagctccgctatcgaaaccacagaactgctcaagaaactgcctattaacagcgaggccgacaaggaaatccagtctatcaaaaatcccgtggttattacggctcttttcgagatccgcaagctggtgaacgagattatcgatacctacggcaagtttgacgaaattaaagtcgagctcgcccgggatctgaaggcgtccaaaagcaagagatacgacacacgccgggaacagctgagacttgagaaagaaaatgaccggatcaagatcgagctcgagaacctggggcagcgcattaaccacatcaccattctgaagtataaactctgggaagagtgcgataagagatgtcctttcacaggcaaaaatatcgaagtgaacgagctgttttctggagaagtccaaattgagcatatcttcccctggtcccggagccttaatgactcctttatgaacaagaccctgtgcttcgccgatgagaatagagctaaaggcaacaagacgccgtacgaattttattctgagcagggggaacagaaatgggaggagatcaagattcaggccctcagctgtttcaagaataaacctaactaccccaatgcttatcaaaagtttaaacagttcgtgaagaaaaagcacgacgaagattttatctcccgccagctgaacgacacacggtacatttctaaggaggccaaaaattatctgagcaagatctgcaacaatgttcaggtggcccctggacaaatgaccgctacccttagacacaaatggggcctcaacacaattctgaataaggatgacgataccaaaacacgcgacgatcatagacaccatgcgatcgacgccctggtcatggcttgttccacgcggagccacctccaggaactgtctaagcgcaacagataccagaaggattacgagttcaaagactttcccatgccctggcaattcttccggcaggacgccgaaaagtccgtggagcagatccttgttagccataaaaagctgaacaccattctcacagtgcgcacccacaaaacaaagaagaatggggtcgtgtataaaaacatcggagtggccgctagaggccagctgcacaaggagaccgtttttgggaaacggacggcccctgatggcattgaagcgtaccatgtccgcaagccgatcgagtctctgtccacccacaaacatattaataaggtggtggacgaaacaatcagacttctcattctgaagcaagtcaacaaactgggaggcttcgtgaaggggaaaatccccgagggaaccttttataatacagatgaaaacggcaataagcagcctcagatcttcctccccaacaaaaatgggaaccctgttcccattaagaaaatccggctgcgcgagaatattggaggcgctgagcagcttaagagcaccgtgaaccaacacgtcaatccgagatctaaccaccatgtgctgatctacaaggactttgatgacaatctcaaagaaaaggttgtgacgttctggacagccgtcgagcggaaaaagcagaaacaggccgtgtttcagctgcctgaaaacgggaaggagattgttaccacactgcaaatcaacgatatgttccttctcggcctgaaggacgatgaaatcaattgggagcaccccaaatttaccctgctcaaggagcatctgtatagagtgcagaaattcaccagcggagactactattttcgcaagcacattgaatccaaccttaatggcgagctggggaaggcttaccagtacatcaagggattcggcgaagggaagacaggatggaaaacgttcaaccctattaagatcaaagtcagcgtgtctggcaagattgagaaagtgtga

SEQ ID NO: 3974 - RNA, 3390 nt, synthetic construct
  misc_feature 1..3390: note = Cas9 variant
  source 1..3390: mol_type = other RNA
atgaacggcctggtgctcgggctggacatcggaattgccagcgtcggcgctgggatccttaagaaagataccggagagattatccacgccaattccagactgttccccgcggctacagccgacaacaatgttctccggcgctctagcagacaggcccggcgctccacgagacggaagcgccatagagctgtgcggctgcacgatctttttgaagactacggcctgctcaccgatttctctaaagtgagcattaacctgaatccttataagctgcgcgtcgaggggatggacatccaactcacaaccgaagaactgtttatcgcccttaaaaacattatcaagagacggggaatttcctacctggatgacgcttctgaagatggcgtgacagttagctccgactatggcaaggccgtggaggagaatcgcaaactcctgagcgaacagaccccggggcagatccagcttgagagattcgaaaagtacggacaagtccggggcgattttacagtggaggagaacggggaaaaacgcagactgattaatgttttctctacctccacgtatcggaaggaggcggaaagaatcctccgcaaacagcaggagtttaacaataagattaccgacgatttcatcgacgactacctgacaatcctgaccggaaagcggaaatattaccatggccccgggaacaagaaaagcagaacagattacggacgctataccacgaagaaagactctgaaggcaagtacattacactcgataatatctttggcgtgctgattgggaaatgcaccttctatcctgacgagtaccgggcctccaaggctagctatacagcccaggagtttaaccttctgaatgatctcaacaacctgaccgtccccaccgaaacaaagaaactttctgagaagcaaaagaagacgatcgtggaatacgctaaaaccgccaagacactgggagcgtccaccctcctgaagtatattgccaaaatggtggacgctagcgtcgatcagatccacggctacagagttgacgtgaataagaaacctgagatgcatacattcgatgtgtaccgcaagatgcagtccctggaaacctttaacgtcaatgagatgccccgggaggtgctcgacgaactggcccacatccttacgctgaacacagagagagaagggattgaggaagctatcaataccaaactcaagggaaccttcaaccaggatcaagttctggagcttgtgcagttccgcaagaataactctagcctgttttccaaaggctggcacaatttcagcctcaagctgatgatggagctgattcctgaactctatgccacatctgaggaacagatgaccatcctgacacggcttgggaaacaaaagtccaaagagattagcaagagaacgaagtacatcgacgagaaagaaatcaccgaggaaatttataacccggtcgtggccaagtctgttcgccaggctatcaaaattatcaatgaggcgacaaagcagtacggaatttttgaccatatcgtgattgaaatggcccggctgaccaacgaggaggatgctaaaaaggactatatcaaaagacagaaggccaatctcgatgaaaagaacgccgctatggagaaagccgcgttccaatacaatggcaagaaagaactgcccgacagcatctttcacggccataaggagctggctacaaaaattcggctttggcaccagcagggggaaaagtgtctctataccggaaagaacatccctatttccgatctgatccagaaccaatacaaatacgagattgaccacatcctgcccctctctctgagcttcgatgactcccttagcaataaggtcctggtgctcgccacggccaaccaggagaaaggccagcgcaccccttttcaggctctggatagaatggacgatgcctggtcttatcgggagttcaagtcctacgtcaaagacagcaagctgcttgggaataagaaaaaggattatctcctgacagaggaagacatctctaaaattgaggtgaagcaaaaatttatcgaaagaaacctggttgacacccgctactccagccgggtggtcctcaatgctctgcaggatttctataagaaccatcactttgacacaaccatttccgtggttagaggacagttcacgtctcagcttcgcagaaagtggggcctggagaaaagccgggagacataccatcaccatgccgtggatgcgctcatcattgccgcttcctctcaactgcgcctgtggaagaaacagaataacccccttatcttttataaggaagggcagttcgtcgacagcgagaccggcgaaatcctctccctgaatgatgacgagtacaaagagctggtgttcaaggccccgtacgatcactttgtggacacactcagaagcaaaaccttcgaagattctattctgttttcctatcaagttgacagcaagtacaaccggaagatctctgatgctaccatttatgccacacgcaaagcgaaacttgacaaagataagtccaaagagacgtacgtcctgagcaagatcaaggacatttattctcaggccggatacgacgctttcatcaaaatctataataaggataaaagcaagtttctcatgtaccacaaagactcccagaccttcgaaaaggtgattgaggaaatcctgagaacataccctagcaaggagtttaacgataaaaataaggaggtgccctgcaaccctttcgaaaaatatcggcaggagaatggccccattcgcaagtactctaaaaaggggaacggacccgaaatcaagtccctgaaatattacgacaagaacattcctgagagctttatcaatattaccccgtccaactctaaaaataaggtcatccttagacaactcaacccctggcggacagatgtgtatttcaatcatcagaccgaaaaatacgagctgctgggcctcaagtatgccgacctgcagtttgagaagaaaacggggacatacagcatcaccattgataagtacaacgaaatcaaagagaaggaaggagttggcgagcagtccgagttcaaatttaccctttataagaatgacctgctcctgattaaagatacaaagaacaatgaaaagcaaatcttccgcttcctgtctagaaccatgcctaacgtgaaacactacgtcgagcttaagccctataataaagctaagtttgacgggaaccagcctctgattacaatcttcggcaatgtggccaaaggaggccagtgtctcaaggggctgaacaagcccaatatcagcatttacaaaatcaagacggatgttctcggaaacaaatattttattaagaaagaaggcgacaagccgaagctgaaattctga

SEQ ID NO: 3975 - RNA, 3390 nt, synthetic construct
  misc_feature 1..3390: note = Cas9 variant
  source 1..3390: mol_type = other RNA
atggccgacagaatcagcctgggcctcgatattggggtggcttccgtcggattctctgttctggacatcgataagggcaaagtgattgagcttgggagccggctgtttaacgccaccgtggcggaaggaaatcaggaccgcagatccatgcggggcgctcgcagactcctgaaccggaataagcaacgcagacaggatacagggaaacttttccagaagtttggactgctcgacaacttcaataaagataacttttacgacacgttcaatcagaactggaatccctatgagctgcgggtcaagggcctgaccgaacacctcacaaagaaagagctggccgaatctctttaccaaatcgtgaagcatcgcggcattagctatgccctgaaagatgctgacgccgatgaagggggaaccgactactccgcttctctcaagatcaacagccaggagctggccgagaaaacccctgcgcagatccagcttcaaagactgaatgattatggcaaggttcggggacaggtggtcattggggacgacccggataaccagaaggtgctcctgaatgtttttcccacatccgcctacgagaaagaagctaagcagatcattgccacacaaaaacagttctatcctgagatcctgaccgacgagtttacgaaggaatactgcaaaattctcacccgcaagagagattacttcgtgggccccgggaacgagaaaagccggacagactatggaatctacaagaccgatggccgcacactggacaatctttttgaggaactgattggccacgataagatctatcctgacgaactcagagcttctgccgcgtcctacaccgcccagctgttcaacgtccttaacgatctgaataacctccggatcctgagctatgaggacgggaaactgacgaaggaggataaagaaaagattatcgctgagattaaatctaatacaaccacaatcaacatgctcaatgtgattaagaaggtggccggatgttccaaagaagacatcaagggctttagagtcaacgagaaagacaagcccgaaatcagctctatggctgtttaccgcaaagtgcataaggatctgcttaaggtgggggtcgacatttccgattggcctgtggagttcatcgacaaactgagcttcattctcaccctgaataccgagaacggagaaatccggaagcaacttaataacagactggttccggagtttgatttcctcaatgacgatctgattcagctgatcatcgacaacaaagattcctttgaaattaagacaaataacaaatggcaccgcttctctctcaagacgatgaataagctgatgcccgagatgcttgaacggcctgtggagcagatgaccctgctcaacgagatgggcctggtcaaaaaggacaaaaagagatttgaaaacaataaatatctgccctacaaggagatcgccaaagatattttcaaccctgtggccagcaagtccgttcgcgaagctcttaagatcgtgaatgcggtcctcaaaaagtacgggcatattgactatctggtgatcgagatgccccgggataaaaacctgaaggaggaacaggacaatattaaagagtttcaaaacaagaataagaaagccaaggacgctgccttcgaagcctttgtcaaaagcgtgggatctgagcagagagttaaggaagctctctccaaaaaccgcaagctgcagatgaagatgcggctttggtaccagcaacaggagatcgatccgtataatggcgagacaatcgacgccaccgatctgattaacaatcctgacaaattcgaaatcgatcacattatcccccagagcatttcttttgacgatagcatcaacaataagacactctgcttcgcgtccatgaaccaggtgaaaggccaaaagaccccttacgagtttatgctggaagggcacggacagggctatgacaaattcaaggctacggtcctggataataagaacttcgacagaaacaaacgcaagaattacctttttgaggaaaacgtgtctgatatcgagacacggaaaagattcctcagccggaatctggttgacacccgctattccagcagagtggtcctgaactctctccaggactttttccatgagaagtccgccgataccaaagtgacagtgattcgggggaagtttaccagcaatatgagaaaacactggcatatcgacaagacacgcgaaacgttccaccaccatgccattgatgcttctatcattgccgctaccccctttctgcggatgtggaagaaaggaggcacaatcttccccgttaaggtcggggaggaatccatcgacattgagaccggcgaaatccttgatgacaaaaagtttgataaagtgatgtacgaggagccttacaacggattcgtgagcgaaattatgaatgccgacgatagaatcaagttttcccaccaggtcgacaagaaaatgaaccgcaaggtgtctgatgcgacaatttatagcaccagaacgggcaaactggccaaggacaaaaaggatgctgagtacatcgttgccaaggtgaaagacatctattccgtcgacgggttcaagaaatttaagaaagtgtacgataaggacaagtctaaattcctcctgtataagtacgatccgcggaccttcagcgaactggagcgcattatctccgactgtcccgataaagttgagaaggtgcaaacaaatggaaaagtcaaggctgtggacgttagcccttttgaaatgtatagacggtaccatggcatgattaagaaatactctaagaaagggaacggacccgccatcaagcagcttaaatatctcgataagaaactgggctcccacattgacatcacccctgcgaatgccaacgggaagcatgtgattctgcagagcctcaagccctggcgcacagatgtctacctgaatcacgagaccggcgaatatgagatcatgggaatcaaatactctgaccttaagttcaacaaaaatgtgggctatgggattaagaaagataagtacctggaaatcaagaaaaacgaggaggtgtccgaaaagagcgagtttatgttctctctctatagaaaagaccgggtccgcattcaaaacatgaagacgggagaaagcgttgagctgctgttttggtccagaaatttcagcaacaaaaagtacgctgaacttaagccgatctttaaattcgtgacagaggatgacgactggcctgtgtacggccacgccaagacccagattctcaaacggctggtccccaaggattgcaaaatctggaaggtgaatacaaccatcctgggggacccttattacctcgagaaggaatctgataaccccaaagacattctggattga

SEQ ID NO: 3976 - RNA, 3390 nt, synthetic construct
  misc_feature 1..3390: note = Cas9 variant
  source 1..3390: mol_type = other RNA
atgaccaacggcaagatcctggggctcgacattggaatcgccagcgtgggcgtcgggattatcgaggctaaaacaggaaaggttgtgcacgccaattccagactgttctctgcggctaacgccgaaaataacgccgagcggcgcggctttagagggagccggcgccttaatagacggaaaaagcatcgcgtgaaaagagtccgggatctgttcgaaaagtacggaattgtgacggactttcgcaacctcaatctgaacccctatgagcttagagttaagggcctgaccgaacagctcacaaatgaggagctgttcgctgccctgcggaccatctccaaacgcagaggcatctcttacctcgatgacgctgaagatgacagcacagggtccaccgattatgccaagtctattgacgagaaccggcgcctgcttaaaacaaagacccctggacaaatccagctggaaagactcgagaaatacggccagctgcgggggaattttacggtgtatgatgagaacggagaagcgcacagacttattaatgtcttcagcacctccgactacgagaaggaagcccgcaagatcctggagacacaggctgattataacaaaaagattaccgccgaatttatcgacgattacgtggagattctcacacaaaaacggaagtactatcatggcccggggaatgagaaaagcagaaccgactacggacgcttccggacggacggcacaaccctggaaaacatctttggcatcctgattgggaagtgctctttctatcccgatgagtacagagcttccaaagccagctatacagcgcaggaatacaactttctcaatgacctgaacaatcttaaggttcctaccgagaccggaaagctgtctacagaacagaaagaggccctcgtggagttcgctaagtccacggccaccctgggccccgctaaacttctgaaggaaatcgccaaaattctcgattgtaaggtcgacgagatcaaggggtatcgcgaagatgacaaaggaaagcctgatctgcacacatttgagccctaccggaaactgaagttcaacctcgacagcgtgaatattgatgacctgtctagagaagtgcttgataaactggccgacatcctcaccctgaacacagagcgcgagggcatcgaagacgctattaagcggaatcttcctaaccagttcaccgaggaacaaatctccgagattatcaatgtcagaaagagccagtccacggcgtttaacaaagggtggcattctttcagcgccaagctgatgaatgagctcattccggaactgtacgctacatccgatgagcagatgaccatcctgacccgcctcgaaaaatttaaggttaaaaagaaaagctctaaaaacatcaagacaattgacgagaaagaaatcaccgatgagatttataatcccgtggtggccaagtccgtccggcagacaatcaaaattatcaacgccgctgtgaagaaatacggagacttcgataagattgttatcgagatgcctagagacaagaatgccgatgacgaaaagaagtttatcgataaacggaacaaggagaacaaaaaggaaaaggacgatgcgctgaaacgcgctgcctatctttacaatggcacggacaagctgcccgatgaggtgttccacgaaaacaaacaactcgagaccaagattagactgtggtatcagcagggcgagcggtgcctgtacagcgggaaacctatccccattcaagaacttgtccacaattctaacaattttgagatcgaccatattctcccgctgagcctgtccttcgacgattctctcgccaacaaggtgctggtttatagctggacaaatcaggaaaagggacagagaaccccttaccaggtgatcgactccatggatgctgcctggagctttcgcgagatgaaagactacgtccttaagcaaaaaggcctggggaagaaaaagcgggattatctcctgacaaccgaaaacatcgacaagattgaggtgaaaaagaaattcatcgagagaaatctggtcgatacgcgctacgcttctagagtggttcttaactccctccagagcgccctgcgggaactgggaaaggacaccaaagtgtctgtcgtgcgcggccagtttacatcccagctcagacggaagtggaaaattgataagagccgcgagacctatcaccatcacgcggttgacgccctgatcattgctgcctcctctcaacttaagctgtgggaaaaacaggataatcccatgttcgtggactacgggaacaatcaggtcgtggataagcagacaggcgagatcctcagcgtgtccgacgacgagtataaagaactggtttttcaacctccctaccagggattcgtcaacaccatctctagcaagggcttcgaggatgaaattctgttttcctatcaggtggacagcaaatacaatagaaaggtgtctgatgctacgatctactccacacggaaggccaaaattgggaaggacaaaaaggaggaaacctatgtccttggaaaaatcaaggatatttacagccagaacggcttcgacacatttgtgaagaaatataacaaggataaaacccaattcctcatgtaccagaaggaccccctgacctgggagaatgttatcgaggtgatcctgcgcgattatcctacaacgaaaaagtctgaagacgggaagaacgatgtcaaatgtaatccgtttgaggaatacagacgggagaacggactcatttgcaagtattccaaaaagggcaaagggacccccatcaagagcctgaagtactacgacaaaaagctgggcaattgtattgacatcacacctcaggaatctaaaaaccgcgtggttcttagacaaattagcccctggcgggcggatatctatttcaatcctgagaccctcaagtacgagctgatgggactgaaatattccgaccttagctttgaaaagggcacagggaaataccacatttctcaggagaagtatgatgccatcaaggaaaaagagggagtgggcaaggactccgagttcaaatttaccctctacagaaacgatctgatcctgattaaggacacgctcaataactgcgaacgcatgctgcggttcgggagcaaaaatgatacatccaagcattatgtcgagcttaagcccctggaaaaaggaacctttgactctgaggaagagatcctcccggtgctgggcaaggttgctaaaagcgggcagttcattaagggcctgaacaaacctaatatctccatttacaaggtgagaaccgatgtccttggaaacaagtactttgtgaaaaaggagggcgacaaacccaagctggatttcaaaaataacaagaagtga

SEQ ID NO: 3977 - RNA, 3390 nt, synthetic construct
  misc_feature 1..3390: note = Cas9 variant
  source 1..3390: mol_type = other RNA
atgagcaacggcaagatcctggggctcgacattggagtggcctccgtcggcgttgggatcattgattctaaaaccggaaatgtgatccacgctaacagcagactgttctccgccgcgaatgctgagaacaatgccgaacggcgcggctttagaggggcccggcgccttacaagacggaagaaacatcgcgtgaagagagtccgggacctgttcgagaaatacgatatttctacggactttcgcaacctcaatctgaacccctatgaacttagagtgaagggactgaccgagcagctcacaaatgaggaactgttcgctgccctgcggaccatcgctaagcgcagaggcatcagctacctcgatgacgccgaggatgactccacaggctctagcgattatgcgaaatccattgacgaaaaccggcgcctgcttaagaccaaaacacctgggcaaatccagctggagagactcgaaaagtacggacagctgcggggcaattttaccgtttatgatgagaacggggaggcccacagacttattaatgtgttcagcacgtctgactacaaaaacgaagctcgcaagatcctggagacccagtccaattataacaagcaaattacagatgaatttatcgaggactacattgaaatcctcacccagaaacggaagtactatcatggaccgggcaacgagaaaagcagaacagactacgggcgcttccggaccgatggaacgacactggagaatatctttggcattctgatcggcaagtgctctttctatcccgaagagtacagagcctccaaagctagctataccgcccaggaatttaacttcctcaatgacctgaacaatcttaaggtccctacagagaccgggaaactgtctaccgaacagaaggagtacctcgtggattttgcgaagaaatccaaggccctgggagctagcaaacttctgaaggagattgccaaaatcgttgactgttccgtggatgacattaagggctatcgcgtcgataacaaggacaaacccgatctccacacattcgaaccttaccggaagctgaaattcaatctgtctagcatcgacatcgatgagctctccagagaaacgctggacaaacttgctgacattctgaccctcaacacagagcgcgaagggatcgaggatgccattaagcggaatctgcccagccaatttaccgaggaacagatctctgagattgtgcagatcagaaagaaccagtccagcgccttcaataagggatggcattcttttagcgctaaacttatgaacgaactgatccctgagctctacgtgacatccgaggaacaaatgaccattctgacgcgcctggagaagttcaaagtcaataagaaatctagcaagaacacaaagaccatcgacgaaaaagagattaccgatgaaatctataatccggttgtggcgaagtccgtgcggcagacaattaaaatcattaacgccgctgtcaagaaatacggcgactttgataagatcgtgatcgagatgcccagagacaaaaacgccgaggatgaaaagaagttcattgacaaaaagcagaaagagaataagaaagaaaaggatgacagcctcaagcgggccgcttttctgtataacgggaccgataatcttcctgacggagttttccacggcaacaaagagctgaagacaaaaatccgcctctggtaccaacagggcgaaagatgcctgtattctgggaagctgatttccatccacgatcttgtgcataatagcaacaaatttgagattgaccacatcctccccctgtctctgtccttcgacgatagcctcgccaataaggtcctggtgtacgcgtggacgaaccaggagaagggacagaaaaccccttatcaagttatcgactccatggatacagcttggtcttttcgggaaatgaaggactacgtgcttaaacagaagggcctggggaaaaagaagtgtgagtacctcctgaccacagaaaatattgataaaatcgaggtcaagaaaaagttcattgaaagaaacctggtggacacccgctatgccagccgggtcgtgcttaattccctccagacggccctgaaagagctgggaaaggataccaaagtttctgtggtcagaggccagtttacaagccaactccgcagaaagtggaacatcgacaagtcccgggagacctaccatcaccacgctgtggatgccctgattatcgctgccagctctcagcttaaactgtggcagaagcaggaaaatcccatgttcgagtcctatggggaaaaccaagttgtgaataaagagacaggcgagatcctcagcatttctgacgataagtacaaagaactggtcttccagccgccttatcagggatttgtgaacaccatctccagcaagggcttcgaggacgaaattctgttttcttaccaggtggatagcaagttcaaccgcaaagtttccgacgcgacgatctatagcacaagaaaggccaaacttgggaaggacaaaaaggatgagacctacgtcctcggaaagattaaagacatctactctcaagatggctttgacacattcatcaagcggtataaaaaggataaaacccagtttctgatgtaccagaaggaccccctgacctgggaaaatgtgattgaggtgatcctccgcgattatccttccgagaagctgagcgaagacgggaaaaagacagtcaaatgcaaccccttcgaggaatacagacgggagaatggacttatttgtaagtattccaaaaagggcaacgggacgcccatcaagtctctgaaatactatgataagaaactcggcaattgcattgacatcacccctgaaaagagcaaaaaccgcgtggttctgagacaaatttccccgtggcgggctgatatctactttaatctggagacacttaagtacgagctcatgggactgaaatattctgacctgagcttcgaaaagggcaccgggaagtaccatatctcccaggagaaatatgacgccattcgcgaaaaggagggaatcggcaaaaagtctgaatttaaattcacactctacagaaacgatctgattcttatcaaggacaccctgaataactgtgagcggatgctcagatttgggagcaagaatgatacgtccaaacactatgtggagctgaagcccctggaaaaaggaacattcgacagcgaggaagagattcttcctgtcctgggcaaggtggctaaatctgggcagttcatcaagggcctcaacaagcccaatatctccatttacaaagttcgcaccgatgtgctgggaaacaagtttttcatcaaaaaggagggcgacaaacctaagctcgattttaagaataacaacaaatga

SEQ ID NO: 3978 - RNA, 3390 nt, synthetic construct
  misc_feature 1..3390: note = Cas9 variant
  source 1..3390: mol_type = other RNA
atgagcaacggcaagatcctggggctcgacattggagtggcctccgtcggcgttgggatcattgatgctaaaaccggaaatgtgatccacgccaactctagactgttcagcgcggctaatgccgagaacaatgccgaacggcgcggctttagaggggctcggcgccttacaagacggaagaaacatcgcgtgaagagagtccgggacctgttcgagaaatacgatatttccacggactttcgcaacctcaatctgaacccctatgaacttagagtgaagggactgaccgagcagctcacaaatgaggaactgttcgccgctctgcggaccatcgccaagcgcagaggcatctcttacctcgatgacgcggaggatgacagcacaggctcctctgattatgccaaaagcattgacgaaaaccggcgcctgcttaagaccaaaacacctgggcaaatccagctggagagactcgaaaagtacggacagctgcggggcaattttaccgtttatgatgagaacggggaggctcacagacttattaatgtgttctccacgagcgactacaaaaacgaagcccgcaagatcctggagacccagtctaattataacaagcaaattacagatgaatttatcgaggactacattgaaatcctcacccagaaacggaagtactatcatggaccgggcaacgagaaatccagaacagactacgggcgcttccggaccgatggaacgacactggagaatatctttggcattctgatcggcaagtgcagcttctatcccgaagagtacagagcttctaaagcctcctataccgcgcaggaatttaacttcctcaatgacctgaacaatcttaaggtccctacagagaccgggaaactgagcaccgaacagaaggagtacctcgtggattttgccaagaaatctaaggctctgggagcctccaaacttctgaaggagattgctaaaatcgttgactgtagcgtggatgacattaagggctatcgcgtcgataacaaggacaaacccgatctccacacattcgaaccttaccggaagctgaaattcaatctgtcctctatcgacatcgatgagctcagcagagaaacgctggacaaacttgccgacattctgaccctcaacacagagcgcgaagggatcgaggataccattaagcggaatctgccctcccaatttacagaggaacagatcagcgagattgtgcagatcagaaagaaccagtcttccgccttcaataagggatggcatagcttttctgctaaacttatgaacgaactgatccctgagctctacgtgaccagcgaggaacaaatgacgattctgacacgcctggagaagttcaaagtcaataagaaatcctctaagaacaccaagaccatcgacgaaaaagagattacagatgaaatctataatccggttgtggccaagagcgtgcggcagaccattaaaatcattaacgcggctgtcaagaaatacggcgactttgataagatcgtgatcgagatgcccagagacaaaaacgccgaggatgaaaagaagttcattgacaaaaaggagaaagaaaataagaaagagaaggatgactccctcaagcgggccgcttttctgtataacgggacagataatcttcctgacggagttttccacggcaacaaagaactgaagacgaaaatccgcctctggtaccagcaaggcgagagatgcctgtatagcgggaagctgatttctatccacgatcttgtgcataattccaacaaatttgagattgaccacatcctccccctgagcctgtctttcgacgattccctcgccaataaggtcctggtgtacgcgtggaccaaccaggaaaagggacagaaaacaccttatcaggttatcgacagcatggatgctgcctggtcctttcgggagatgaaggactacgtgcttaaacaaaagggcattgggaaaaagaagagagaatacctgctcaccacagagaatatcgataaaattgaagtcaagaaaaagttcatcgagcgcaacctggtggacacccggtatgcctctagagtcgtgctgaatagccttcagacggctctcaaagagctgggaaaggataccaaagtttccgtggtccgcggccagtttacatctcagctgagacggaagtggaagattgacaaaagccgcgaaacctaccatcaccacgccgtggatgctctcatcatcgccgcgtccgggcaactgaaactttggcagaagcatgagaacctgatgttcgaaaattatggcgagaaccaggttgtgaataaggagacaggagaaattctcagcatctctgacgatgagtacaaagaactggtcttccagcccccgtatcaaggctttgtgaacaccatttccagcaagacgttcgaggacgaaatcctgttttcttaccaggtggattccaagttcaacagaaaagttagcgacgccacaatttattctacccggaaggctaaacttgggaaggacaaaaaggaggagacatacgtcctcggaaagatcaaagatatctacacccaggacggctttgataccttcattaagcgctataaaaaggacaaaacacagtttctgatgtaccaaaaggatcctctgacgtgggaaaatgtgatcgaggtgattctcagagactatcccagcgaaaagctgtccgaggatgggaaaaagaccgtcaaatgtaaccctttcgaagagtaccggcgcgagaatggacttatctgcaagtatagcaaaaagggcaacgggacacccattaagtctctgaaatactatgacaagaaactcggcaattgtatcgatattacccccgaaaagtccaaaaacagagtggttctgcggcagatcagcccttggcgcgccgacatctactttaatctggagacacttaagtacgaactcatgggactgaaatattccgatctgtctttcgagaagggcaccgggaagtaccacattagccaggaaaaatatgacgctatcagagagaaggagggaattggcaaaaagtccgaatttaaattcacgctctaccggaacgacctgatccttattaaggatacactgaataactgcgagagaatgctccgctttgggtctaagaatgacaccagcaaacattatgtggaactgaagccgctggagaaaggaaccttcgattccgaggaagagatccttcccgtcctgggcaaggtggccaaatctgggcaattcatcaagggcctcaacaagcctaatattagcatctacaaagttcggacagacgtgctgggaaacaagtttttcattaaaaaggaaggcgataaacccaagctcgactttaagaataacaacaaatga

SEQ ID NO: 3979 - RNA, 3393 nt, synthetic construct
  misc_feature 1..3393: note = Cas9 variant
  source 1..3393: mol_type = other RNA
atgaacaagatcctgggcctcgacctggggaccaatagcattggatgggcccttatcgagaacaatattatcctgggcatggggtccagagtgttccccgaaggagtcgttaacctcggcgagggggaaggaagagagacatctaaaaatgctagccgcacggaagccagaggcgtgcggcgccagatttttagacggcgcctgagaaagcggtaccttctgaaagagctcgcgaagcacaacctgtgccctatctccccgaccctgatcaaagattggaatggcacagacattttcaagaacgagctcatcattcaatggtttcagctgaatccctatgaacttcgcgctaaggccatccaggaggaaattaccctgatcgagctcgggagaattttctaccatatgatccagcggcgcggatttctgtctaacagcagatccgccggcgctgatgtgaaagagacatctaccatcttcaagggggacgccaaaattggaaagatcggcattagcgatacacttaaatccatcgaacaaaataagaccctggggagctttctccactctattcagcctaaggagaacgaacccttctccggagagctggaacggatccgcaatagatatacgacccggcagatgtacatcgacgagtttgagacaatttgggagttccagaaacaatatcatagcgagctgaactctaatctcaagaccatcctgggcggccgcaaaaaggataactacaaagaagacggggtcctttttcaccagagacctctgcggtcccagaagcatctcgtgggattctgtagctttgagcccaaaaagacaaagtgcaaactgtctgctattcctttcgaacttttcagaatctatcagtgggttaacaccctgtcctacgatgtgaatggcgtccgccaaaagattacgcaggaggagcggaaaaagatcatcgacctcctgctgagcaaagaaaagccgtcctttaaggagattagaaaagccatcgggaagctcgatggatcttaccagttcaactataaagacgatgacaagattgtgggcagccacacaatctccaatctgagcaacaaaaagtttttcgggaataagtggtttgacttctctgaaaaagagcaagaaaacatttggcacatcctttcctttttcgatgaccgcgagaagctgaaagagtacgcgattaagaattggagctttgatgaagaacgggccgttaaaatctctaagttcaacctcaaggacggatatagcaatctgtccagaaaagctatccttaacattctgccctttctccagaagggcttcatgtacgatgtggccgtcggcctggctggggtgaaaaataccctgtctgtgaactgggaagaacatgagcagtttgtcctcgacaatgttcctgaaatcgtgcgcagcaacctgaagggaggctatattgagccccttaaaaatatgctgaagaacgagttcaactgtaatgataaacagctcgagaagctgtaccaccattccagcgccatcgaaacagagaacattctggaccggcttcctgtgaatctccacgcggatagagagatccaaaagatcaaaaaccccgtcgtgattaccgccctgttcgaaatccgcaagctggttaatgaggtgattgacacctatgggaaaccgaacgaaatcaaggtcgagctcgctcgggatctgaaagcctctaagtccaatagacttgaagctcggaagcgccagaaagacctggagaagcagaacgacagagtgaaactcgagctggaaaatctgaaccagcggagcaatcacattaacatccttaagtacaaactctgggaggaatgcaatcatacatgtccttttacgggacaaatcattaccatctctcagctgttcacaggcgaggttcagattgaacacatctttccctggtccagaagcctgaacgattccttcaataacaagaccctctgctttgccgacgagaaccgcgccaaggggaataaaacaccttacgagctgtattctgaacagggcgatcaaaagtgggaggctattaaacttcaggcgctgagctgtttcaagaccaaagccaactaccccaattgctataacaagtttaagcatttcgtgaaaaagaaacacgacgaagattttatctcccggcagctcaatgacacgagatacatctctaaggaggctaaaaactatctgagcaagatttgttccaatgtcctggtggcccccggacagatgacagccacccttcgccatcactggggcctcaacagcatcctgaatctggaggatgacaccaaaacaagagatgaccaccggcatcacgctattgatgccctcgtcatggcgtgctctacccgctcccatctgcaagaacttagcaagagaaaccggtacaataagaactatgacctgaaagatttccctgacccgtggcagaattttcgccaggacgctgagaacgccgtggcccaaatcctcgtttctcacaagaaatccaagagcctgctgacagtgagaacgcacaaaaccattaagaagggggtcgaacataaaaatatcggagtggctgcccggggccagcttcacaaggagtctgtttacgggctccgcaaagctcccaacagcaacaaggccttccatattagaaaacctctggaatccctgacaaccgagaagcagctcgagaagatcgtggatgacagcatccggctgcttattctgaaacgcatcaatattatcggaggctttattaaggggaaaatccccaaggaaacattcttcgtcgtggatgagaacggcatcaaacagcctcaaatttttctccccaatagaaacggaaatccggtgcctatcaagaaggttcggattagagaaaacatcggcggggcggagaaactgaaggaaaataccaaccagtacgtcaatccccgctctaaccaccatgtgattgtgtatgaggactccaatggaggcctgaaagatgacgtcgtgacgttctggaccgccgttgagcggaagagacaggggcaggatgtgtttaaacttcctaacgacggagaaaagatcgtcagcacactgcaaatcaatgatatgttcctcctgggcctcaacgacgatgacattatcaccctgacatccaaggagcttaaaaagcacctgtttaaagtgcagaccctctctagctccttctacgaatttcgcctgtctacggatagcacacagaataagaacaccaattccacagttttccggcggattcagtcttttgggatgggcaaaaccggatggaaggctttcaaccccatcaaagtgaagctgaacagcattggcgaggtcaagatcatttga

SEQ ID NO: 3980 - RNA, 3393 nt, synthetic construct
  misc_feature 1..3393: note = Cas9 variant
  source 1..3393: mol_type = other RNA
atgaccaacggcaagatcctggggctcgacattggaatcgccagcgtgggcgtcgggattatcgaggctaaaacaggaaaggttgtgcacgccaattccagactgttctctgcggctaacgccgaaaataacgccgagcggcgcggctttagagggagccggcgccttaatagacggaaaaagcatcgcgtgaaaagagtccgggatctgttcgaaaagtacggaattgtgacggactttcgcaacctcaatctgaacccctatgagcttagagttaagggcctgaccgaacagctcacaaatgaggagctgttcgctgccctgcggaccatctccaaacgcagaggcatctcttacctcgatgacgctgaagatgacagcacagggtccaccgattatgccaagtctattgacgagaaccggcgcctgcttaaaacaaagacccctggacaaatccagctggaaagactcgagaaatacggccagctgcgggggaattttacggtgtatgatgagaacggagaagcgcacagacttattaatgtcttcagcacctccgactacgagaaggaagcccgcaagatcctggagacacaggctgattataacaaaaagattaccgccgaatttatcgacgattacgtggagattctcacacaaaaacggaagtactatcatggcccggggaatgagaaaagcagaaccgactacggacgcttccggacggacggcacaaccctggaaaacatctttggcatcctgattgggaagtgctctttctatcccgatgagtacagagcttccaaagccagctatacagcgcaggaatacaactttctcaatgacctgaacaatcttaaggttcctaccgagaccggaaagctgtctacagaacagaaagaggccctcgtggagttcgctaagtccacggccaccctgggccccgctaaacttctgaaggaaatcgccaaaattctcgattgtaaggtcgacgagatcaaggggtatcgcgaagatgacaaaggaaagcctgatctgcacacatttgagccctaccggaaactgaagttcaacctcgacagcgtgaatattgatgacctgtctagagaagtgcttgataaactggccgacatcctcaccctgaacacagagcgcgagggcatcgaagacgctattaagcggaatcttcctaaccagttcaccgaggaacaaatctccgagattatcaatgtcagaaagagccagtccacggcgtttaacaaagggtggcattctttcagcgccaagctgatgaatgagctcattccggaactgtacgctacatccgatgagcagatgaccatcctgacccgcctcgaaaaatttaaggttaaaaagaaaagctctaaaaacatcaagacaattgacgagaaagaaatcaccgatgagatttataatcccgtggtggccaagtccgtccggcagacaatcaaaattatcaacgccgctgtgaagaaatacggagacttcgataagattgttatcgagatgcctagagacaagaatgccgatgacgaaaagaagtttatcgataaacggaacaaggagaacaaaaaggaaaaggacgatgcgctgaaacgcgctgcctatctttacaatggcacggacaagctgcccgatgaggtgttccacggcaacaaacaactcgaaaccaagattagactgtggtatcagcagggggagcggtgcctgtacagcggaaaacctatccccattcaagagcttgtccacaattctaacaattttgaaatcgaccatattctcccgctgagcctgtccttcgacgattctctcgccaacaaggtgctggtttatagctggacaaatcaggagaagggccagagaaccccttaccaggtgatcgactccatggatgctgcctggagctttcgcgaaatgaaagactacgtccttaagcaaaaagggctgggaaagaaaaagcgggattatctcctgacaaccgagaacatcgacaagattgaagtgaaaaagaaattcatcgagagaaatctggtcgatacgcgctacgcttctagagtggttcttaactccctccagagcgccctgcgggagctgggcaaggacaccaaagtgtctgtcgtgcgcgggcagtttacatcccagctcagacggaagtggaaaattgataagagccgcgaaacctatcaccatcacgcggttgacgccctgatcattgctgcctcctctcaacttaagctgtgggagaaacaggataatcccatgttcgtggactacggcaacaatcaggtcgtggataagcagacaggagaaatcctcagcgtgtccgacaacgagtataaagagctggtttttcaacctccctaccagggcttcgtcaataccatctctagcaaggggttcgaagacgagattctgttttcctatcaggtggatagcaaatacaacagaaaggtgtctgacgctacgatctactccacacggaaggccaaaattggaaaggataaaaaggaagagacctatgtccttggcaaaatcaaggacatttacagccagaacgggttcgatacatttgtgaagaaatataataaggacaaaacccaattcctcatgtaccagaaggatcccctgacctgggaaaacgttatcgaggtgatcctgggagactatcctacaacgaaaaagtctgaggatggcaagaatgacgtcaaatgtaacccgtttgaagagtaccgcagagaaaatgggctcatttgcaagtattccaaaaagggcaaaggaacccccatcaagagcctgaagtactacgataaaaagctgggcaactgtattgacatcacacctgaggaatctcggaataaagtgattcttcagagcatcaacccctggcgcgcggacgtttatttcaatcctgagaccctcaagtacgagctgatggggctgaaatattccgatcttagctttgaaaagggaacaggcaactaccacatttctcaagagaaatatgacgccatcaaggaaaaggaggggatcggcaaaaagtccgagttcaaatttaccctctacagaaatgatctgattctgatcaaggacattgctagcggagaacaggagatctatcggttcctctccagaacgatgcccaacgtgaatcattacgtcgaactgaaaccgtacgataaggagaagtttgacaacgtgcaggaacttgttgaggccctgggggaggctgataaagtgggccgctgcattaagggactcaataaacctaacatctctatctataaggtccggacagacgtgctgggcaacaaatacttcgtgaagaaggaaggggataaacccaagctggactttaaaaataacaagaaatga

SEQ ID NO: 3981 - RNA, 3393 nt, synthetic construct
  misc_feature 1..3393: note = Cas9 variant
  source 1..3393: mol_type = other RNA
atgaccaacggcaagatcctggggctcgacattggaatcgccagcgtgggcgtcgggattatcgaggctaaaacaggaaaggttgtgcacgccaattccagactgttctctgcggctaacgccgaaaataacgccgagcggcgcggctttagagggagccggcgccttaatagacggaaaaagcatcgcgtgaaaagagtccgggatctgttcgaaaagtacgagattgtgacggactttcgcaacctcaatctgaacccctatgaacttagagttaagggactgaccgagcagctcacaaatgaggaactgttcgctgccctgcggaccatctccaaacgcagaggcatctcttacctcgatgacgctgaggatgacagcacaggctccaccgattatgccaagtctattgacgaaaaccggcgcctgcttaaaacaaagacccctgggcaaatccagctggagagactcgagaaatacggacagctgcggggcaattttacggtgtatgatgaaaacggggaggcgcacagacttattaatgtcttcagcacctccgactacgaaaaggaggcccgcaagatcctggaaacacaggctgattataacaaaaagattaccgccgagtttatcgacgattacgtggagattctcacacaaaaacggaagtactatcatggaccgggcaatgagaaaagcagaaccgactacgggcgcttccggacggacggaacaaccctggaaaacatctttggcatcctgattggcaagtgctctttctatcccgatgaatacagagcttccaaagccagctatacagcgcaggagtacaactttctcaatgacctgaacaatcttaaggttcctaccgaaaccgggaagctgtctacagagcagaaagaggccctcgtggagttcgctaagtccacggccaccctgggacccgctaaacttctgaaggaaatcgccaaaattctcgattgtaaggtcgacgaaatcaagggctatcgcgaggatgacaaagggaagcctgatctgcacacatttgaaccctaccggaaactgaagttcaacctcgacagcgtgaatattgatgacctgtctagagaggtgcttgataaactggccgacatcctcaccctgaacacagagcgcgaaggaatcgaggacgctattcggcataatcttcctaaccagttcaccgaaggccaaatctccgagattatcaaggtcagaaagagccagtccacggcgtttaataaagggtggcactctttcagcgccaagctgatgaacgagctcattccggaactgtacgctacatccgatgagcagatgaccatcctgacccgcctcgaaaaatttaaggttaataaaaagagctctaagaacacaaaaaccatcgacgagaaggaagtgacagatgagatttataatcccgtggtcgccaaatccgtgcggcagacgatcaagattatcaacgccgctgttaaaaagtacggagacttcgataaaattgtgatcgagatgcctagagacaagaatgccgatgacgaaaagaaatttattgataagcggaacaaagagaacaagaaagaaaaggacgatgcgctgaagcgcgctgcctatctttacaatggcaccgacaaactgcccgatgaggtcttccacggcaacaagcaactcgaaacaaaaatcagactgtggtatcagcagggggagcggtgcctgtacagcggaaagcctatccccattcaagagcttgtgcataattctaacaattttgaaatcgaccacattctcccgctgagcctgtccttcgacgattctctcgccaacaaagttctggtgtatgcttggaccaatcaggagaagggccagaagacaccttaccaggtcatcgacagcatggatgccgcttggtcctttagagaaatgaaagactacgtgcttaagcaaaaagggctgggaaagaaaaagcgcgattatctcctgaccacggagaacattgacaagatcgaagtcaaaaagaaattcatcgagcggaatctggtggataccagatacgccagccgcgttgtgcttaactctctccagtccgcgctgagagagctgggcaaggacacaaaaattagcgtcatccgggggcagtttacctctcagctccgcagaaagtggaaaattgataagtcccgggaaacatatcatcaccacgccgtggacgctctgatcattgccgctagctcccaacttaagctgtgggagaaacaggataatcccatgttcgttgactacggcaacaatcaggtggtcgataagcagaccggagaaatcctctctgtgagcgacgacgagtataaagagctggtgtttcaacctccctaccagggcttcgttaacatgatctcctctaaggggttcgaagatgagattctgtttagctatcaggtcgactccaaatacaatcgcaaggtgagcgatgccacgatctactctacaagaaaggcgaaaattggaaaggacaaaaaggaagagacctatgtgcttggcaaaatcaaggatatttactcccagaacgggttcgacacatttatcaagaaatataacaaggataaaacccaattcctcatgtaccagaaggaccccctgacctgggaaaatgtcatcgaggtgattctgcgggattatcctacaacgaaaaagagcgaggacggaaagaacgatgttaaatgtaatccgtttgaagagtaccgcagagaaaacggcctcgtgtgcaagtattctaaaaaggggaaaggcacccccatcaagtccctgaagtactacgacaaaaagctgggaaattgtattgacatcacacctgagggcagcaaaaacgaagtcgtgcttcagtctctcaatccctggcgggccgatgtttatttcaaccctgagaccctgaagtacgagctgcttgggctcaaatatagcgacctgtcctttgaaaagggaacaggcaaataccatattagccaagagaagtatgatgtgatcaaggaaaaagaggggattggaaagaaatctgagttcaagtttaccctgtaccgcaatgacctcatcctgatcaaagatacggcttccggcgaacaggagatttatagattccttagccggacaatgcccaacgtcaagcactacgccgaactgaagccgtacgacaaagagaagtttgataatgtgcaggaactcgttgaggctctgggggaggccgacaaagtgggcagatgcatcaagggactgaacaaatccaatctttctatttataaggtccgcaccgatgtgctgggcaacaagtacttcgtgaaaaaggaaggggacaaacctaagctcgattttaaaaataacaagaagtga

SEQ ID NO: 3982 - RNA, 3393 nt, synthetic construct
  misc_feature 1..3393: note = Cas9 variant
  source 1..3393: mol_type = other RNA
atgaccaacggcaagatcctggggctcgacattggaatcgccagcgtgggcgtcgggattatcgaggctaaaacaggaaaggttgtgcacgccaattccagactgttctctgcggctaacgccgaaaataacgccgagcggcgcggctttagagggagccggcgccttaatagacggaaaaagcatcgcgtgaaaagagtccgggatctgttcgaaaagtacggaattgtgacggactttcgcaacctcaatctgaacccctatgagcttagagttaagggcctgaccgaacagctcacaaatgaggagctgttcgctgccctgcggaccatctccaaacgcagaggcatctcttacctcgatgacgctgaagatgacagcacagggtccaccgattatgccaagtctattgacgagaaccggcgcctgcttaaaacaaagacccctggacaaatccagctggaaagactcgagaaatacggccagctgcgggggaattttacggtgtatgatgagaacggagaagcgcacagacttattaatgtcttcagcacctccgactacgagaaggaagcccgcaagatcctggagacacaggctgattataacaaaaagattaccgccgaatttatcgacgattacgtggagattctcacacaaaaacggaagtactatcatggcccggggaatgagaaaagcagaaccgactacggacgcttccggacggacggcacaaccctggaaaacatctttggcatcctgattgggaagtgcaacttctatcccgatgagtacagagcttctaaagcctcctatacagcgcaggaatacaattttctcaacgacctgaataaccttaaggttcctaccgagaccggaaagctgagcacagaacagaaagagtctctcgtggagttcgccaagaatacggctatcctgggccccgccaaacttctgaaggaaattgctaaaatcctcgattgtaaggtcgacgagattaaggggtatcgcgaagatgacaaaggaaagcctgatctgcacacctttgagccctaccggaaactgaagttcaacctcgactccgtgaatatcgattacctgagcagagaagtgcttgacaaactggccgatatcctcacactgaacaccgagcgcgagggcattgaagacgccatcaagcggaatcttcctaaccagttcacagaggaacaaatttctgagatcattaatgtcagaaagtcccagagcaccgcttttaacaaagggtggcattccttctctgcgaagctgatgaatgagctcatcccggaactgtatgccacgagcgacgagcagatgacaatcctgacccgcctcgaaaaatttaaggttaaaaagaagtccagcaaaaacattaagaccatcgatgagaaagaaattacagacgagatctacaatcccgtggtggctaagtctgtccggcagaccattaaaatcattaacgccgccgtgaagaaatatggagatttcgacaagatcgttatcgagatgcctagagataagaacgctgacgatgaaaagaagtttattaataaacggaacaaggagaataaaaaggaaaaggacgatgccctgaaacgcgcggcttacctttataacggcacagacaagctgcccgatgaggtgttccacggcaataaacaactcgaaacgaagatcagactgtggtaccagcagggggagcggtgcctgtattccggaaaacctattcccatccaagagcttgtccacaacagcaataactttgaaattgaccatatcctcccgctgtctctgagcttcgatgactccctcgccaataaggtgctggtttactcttggaccaaccaggagaagggccagaaaacaccttaccaggtgatcgacagcatggatgccgcttggtcctttagagaaatgaaggagtatgtccttaaacaaaaggggctgggcaaaaagaagcgcgactacctcctgaccacagaaaatattgataaaatcgaggtgaagaaaaagttcattgagcggaacctggtcgacaccagatatgccagccgcgtggttcttaattctctccagtccgctctgagagaactgggaaaagatacgaaggtgagcgtcgtgcgggggcagtttacctctcagctccgcagaaaatggaagatcgacaagtcccgggagacataccaccatcacgccgttgatgcgctgattatcgccgctagctcccaacttaaactgtgggaaaagcaggacaaccccatgttcgtggattatggcaataaccaggtcgtggacaaacagaccggagagatcctctctgtgagcgataacgagtacaaggaactggtttttcaacctccctatcagggcttcgtcaatacaatttcctctaaagggttcgaggacgaaatcctgtttagctaccaggtggattccaagtacaaccgcaaggtgagcgacgccaccatttattctacgagaaaagctaagatcggaaaagacaagaaagaggaaacatacgtccttggcaagattaaggatatctattcccagaatgggttcgacacctttgtgaaaaagtacaacaaagataagacacaattcctcatgtatcagaaagaccccctgacctgggagaatgttatcgaggtgattctgggagattaccctaccacaaagaaaagcgaagacggcaaaaacgatgtcaagtgtaatccgtttgaggaatatcggcgcgagaacgggctcatctgcaaatactctaagaaaggcaagggaacgcccattaagtccctgaaatactatgacaagaaacttggcaattgtatcgatattacccctgaagagagcagaaacaaggtgatcctgcagtctattaatccctggcgggccgacgtttacttcaaccctgagacactcaaatatgaactgatggggctgaagtacagcgatctttcctttgagaaaggaaccggcaattatcacatcagccaagaaaagtacgacgcgatcaaggagaaagaagggattggaaagaaatctgagttcaagtttacactctatcgcaacgacctgatcctgattaaagatatcgcctccggcgagcaggaaatttacagattcctcagccggaccatgcccaatgtgaaccattacgtcgagctgaagccgtatgacaaggaaaaatttgataacgtgcaggagcttgttgaggctctgggggaagccgacaaggtgggcagatgcatcaaatccctcaataagcctaacatctctatttacaaagtccgcacggatgtgctgggaaataagtatttcgtgaagaaagagggcgacaagcccaaactggattttaagaacaataaaaagtga

SEQ ID NO: 3983 - RNA, 3393 nt, synthetic construct
  misc_feature 1..3393: note = Cas9 variant
  source 1..3393: mol_type = other RNA
atgagcaacggcaagatcctggggctcgacattggagtggcctccgtcggcgttgggatcattgatgctaaaaccggaaaggtgatccacgcctctagcagactgttctccgcggctaatgccgagaacaatgccgaacggcgcggctttagaggggctcggcgccttacaagacggaaaaagcatcgcattaaaagagtgcgggacctgttcgagaagtacgaaatcgtcacggatttttctaacctcaatctgaacccctatgagcttcgcgtgaagggactgaccgaacagctcacaaatgaggagctgttcgccgctctgagaaccatcgccaaacggcgcggcattagctacctcgacgatgcggaagacgattccacaggctctagcgactatgccaagtccatcgaggaaaacagacggctgcttaaaaatatgacccctgggcaaattcagctggagcgcctcgagaagtacggacagctgagaggcaactttacagtttatgatgaaaatggggaggctcaccggcttatcaacgtgttcagcacctctgactacaaaaatgaagccagaaagattctggagacgcagtccaactataataagcaaatcaccgatgaatttattgaggactacatcgagatcctcacacagaaacgcaagtactatcatggaccgggcaacgaaaagagccggaccgattacgggagatatcgcacagacggaaccacgctggagaacattttcggcatcctgattggcaagtgcacattttaccccgacgaatatcggacctctaaggcttcctacacagcccaggagtataatttcctcaacgatctgaataaccttaaggtccctaccgaaaccgggaaactgagcacagagcagaagcactacctcgtggactttgcgaagtcttccaaagccctgggagttgctaaacttctgaaagagatcgccaagattgtggaatgtagcgtcgatgacatcaaaggctacagagaggataataaggggaagcccgacctccatacgttcgaaccttatcgcaaactgaagtttaacctgtccctcatcgatattgacgagctgtctcgggaaacccttgataaactggctgacatcctcacactgaataccgagagagagggaattgaagatgccatcaagcgcaaccttcccaatcaattcacagaggaacagattgtggagctggtgaacgtccggaaaaatcagagctccgccttcaacaagggctggcacagcttttctgttaagctcatgaatgagctgatccctgaactgtacgcttccagcgaggaacagatgaccatcctcacgagactggagaaattcaaggtgaacaaaaagtctagcgaaaatacaaaaaccattaacgagaaggagatcaccgacgaaatttataacccggtggtcgcgaagtccgtgtctcaaacagttaaaatcattaatgccgctgtgaagaaatacggggactttgataagatcgtcattgagatgccccgcgacaaaaacgccgatgacgaaaagaaattcatcgataagaagcagaaagagaatgccaaggaagtggaggacgctcttaaacgggccgcgtatctgtacaacggaaccgataagctccctgacggcgtttttcacggcaataaacagctgaagacaaagatcagactgtggtatcaacagggggagcggtgcctttacagcggaaaacccatttccatccaggatctcgtgcataacagcaataacttcgaaattgaccacatcctgcctctgtctctctcctttgatgacagcctggctaataaggtccttgtgtacgcctggacgaaccaggagaaaggccaaaagaccccctatcaggtcattgattctatggacgccgcttggtccttccgcgaaatgaaagactacgtgctgaatcagaaggggatcggaaagaaaaagagagagtatctcctgacaaccgaaaacatcgataaaattgaggttaagaaaaagtttatcgagcggaatctggtggacacaagatacgccagccgcgtcgtgcttaactccattcaggctgccctcaaggaactggataaagacaccaaggtttctgtgatccggggccaattcacgagccagctgagacgcaaatggaagattgataaatccagagagacctatcatcaccacgcggtcgacgccctcatcatcgctgcctctagccagctgaaactttggcagaaacaagaaaatccgatgtttgtggattacggggagaaccaggtggttaacaaggagacaggcgaaattctgtccgtcagcgacgatgactataaggagctcgtgttccagcctccctaccagggatttgtgaataccatctcttccaaggctttcgaagatgagattctgttcagctaccaagtcgactctaagtataaccggaaagtgtccgatgccacaatctacagcacccgcaaggcgaaactgggcaaggacaagaaagaagagacgtatgttcttgggaagattaaagacatctactctcaggatggatttgacgccttcatcaagagatataaaaaggataagacacagtttctcatgtaccaaaaagaccctgtgacctgggagaatgtcattgaagtgatcctgcgggattatcccagcgagaagctgtccgaagacggcaaaaagaacgttaaatgtaatcccttcgaggaataccgcagagagaacgggctcatttgcaagtacagcaagaaaggaaagggcacacctatcaaatctctgaagtattacgataaaaagctggggaattgtattgacatcaccccgaagggctccaaaaacgaggtggtccttcagagcctcaatccctggcgggctgatctgtattttaaccctgacaccctgaagtacgaacttatgggactcaaatattccgatctgtctttcgagaagggcacagggaaataccatattagccaggaacgctatgacgagatcaaggtgaaagaaggaatcggcaaaaattccgagtttaagttcacgctgtacagaaacgacctcattctgatcaaagataccgagtctggggaagaggaactttaccggtttctgagccgcacaatgcccaatgttaagcactatgtggagctcaaaccttacgacaaggagagatatgatggaggccaggaactgatgaaagtcttcgggaacgtggccaatggcggacaatgcctgaagtcccttaacaagtctaacctgagcatttacaaagtgcggaccgacgtcctcggcaataagtttttcatcaaaaaggagggggataaacccaagctggactttaagaacaataaaaagtga

SEQ ID NO: 3984 - RNA, 3393 nt, synthetic construct
  misc_feature 1..3393: note = Cas9 variant
  source 1..3393: mol_type = other RNA
atgaccaacggcaagatcctggggctcgacattggaatcgccagcgtgggcgtcgggattatcgaggctaaaacaggaaaggttgtgcacgccaattccagactgttctctgcggctaacgccgaaaataacgccgagcggcgcggctttagagggagccggcgccttaatagacggaaaaagcatcgcgtgaaaagagtccgggatctgttcgaaaagtacggaattgtgacggactttcgcaacctcaatctgaacccctatgagcttagagttaagggcctgaccgaacagctcaaaaatgaggagctgttcgctgccctgcggacaatctccaagcgcagaggcatctcttacctcgatgacgctgaagatgacagcaccgggtccacagattatgccaaatctattgacgagaaccggcgcctgcttaagaataaaacccctggacaaatccagctggaaagactcgagaagtacggccagctgcgggggaactttacagtgtatgatgagaatggagaagcgcacagacttattaacgtcttcagcacctccgactacgagaaggaagcccgcaaaatcctggagacgcaggctgattataataagaaaattaccgccgaatttatcgacgattacgtggagattctcacacaaaagcggaaatactatcatggcccggggaacgaaaagagcagaaccgactacggacgcttccggacagacggcaccacgctggaaaacatctttggcatcctgattgggaaatgcaatttctatcccgatgagtacagagcttctaaggcctcctatacagcgcaggaatacaactttctcaatgacctgaacaatcttaaggttagcaccgagacaggaaaactgtctaccgaacagaaggagtccctcgtggagttcgccaaaaacaccgctacactgggccctgccaagctgctgaaagaaatcgctaagattctcgattgtaaggtcgacgagatcaaagggtatcgcgaagatgacaagggaaaacccgatctgcacacgtttgagccttaccggaagctgaaattcaatctcgaaagcattaacatcgacgatctgtctagagaggtgatcgacaaacttgccgatattctgaccctcaatacagagcgcgaaggcatcgaggacgccattaagcggaacctgcccaatcagttcaccgaggagcaaatctccgagattatcaaggtgagaaagagccagtccacagcttttaacaaagggtggcattctttcagcgcgaaacttatgaatgaactgatccctgagctctacgccacctccgacgaacagatgacgattctgacacgcctggagaagtttaaggtcaacaagaaaagctctaagaataccaaaaccatcgatgaaaaggaggttacagacgagatttataacccggtggtggctaaatccgtccggcagaccatcaagattatcaacgccgccgtgaaaaagtacggagatttcgacaagattgttatcgaaatgcccagagataaaaatgctgacgatgagaagaaatttatcgacaagcggaacaaagaaaataagaaggagaaagatgacgccctcaagcgcgcggcttatctgtacaacagctctgataaacttcctgacgaagtgttccacggcaataagcaactggagacaaaaattagactctggtatcagcagggcgagcggtgcctgtacagcgggaagcccatctccattcaagaactggtccacaactctaataactttgagatcgatcatattcttcctctcagcctgtccttcgacgacagcctggccaataaggtgctcgtttatgcctggacgaaccaggaaaaaggacagaagaccccctaccaggtgatcgattctatggacgctgcctggtcctttagagagatgaaagattacgtcctgaagcaaaaaggccttgggaagaagaaacgcgactatctgctcacaaccgaaaatatcgataagattgaggtgaaaaagaaattcatcgagcggaacctggtcgacacaagatacgctagccgcgtggttcttaattctcttcagtccgccctcagagaactgggaaaggataccaaagtgagcgtcgtgcggggccagtttacgtcccagctgcgcagaaagtggaagattgacaaatctcgggagacctatcaccatcacgcggttgatgccctcatcattgctgccagctcccaactgaaactttgggaaaagcaggacaacccgatgttcgtggattacgggaagaatcaggtcgtggacaaacagacaggcgagatcctgtctgtgagcgatgacgagtataaggaactcgtttttcaacctccctaccagggattcgtcaacaccatctccagcaagggcttcgaggacgaaattctgttttcttatcaggtggattccaaatacaaccgcaaggtgagcgacgctacaatctactctaccagaaaagccaagattgggaaagataagaaggaggaaacgtatgtcctgggaaaaatcaaggacatttactcccagaatggcttcgatacatttatcaaaaagtataacaaagacaagacccaattccttatgtaccagaaggatagcctcacatgggagaatgtgatcgaggttattctgcgggactatcctaccaccaaaaagtctgaagatgggaaaaacgacgtgaagtgtaatccctttgaggaataccgcagagagaacggactgatctgcaaatatagcaagaagggcaaagggacacccattaagtccctcaaatactacgataagaaactgggcaattgtatcgacattacgcctgaagagagccggaacaaggtcatccttcagtctattaatccgtggcgcgcggacgtgtatttcaaccccgagaccctgaaatacgaactcatgggactgaagtattccgatctgagctttgagaagggcacagggaattaccacatctcccaagaaaaatatgacgccatcaaggagaaagaaggaattggcaagaaatctgagttcaagtttaccctttacagaaacgatctcatcctgattaaggacatcgctagcggggagcaggaaatttatcggttcctgtccagaacaatgcctaatgttaaccattacgtggagctcaaaccctacgataaggaaaaatttgacaatgtccaggagctggtggaggcccttggagaagctgataaggttggccgctgcatcaaagggctgaacaagcctaacatctctatttataaggtgcggaccgacgtcctcggcaataaatacttcgtgaagaaaaagggagataaacccaagctggactttaagaacaataaaaagtga

SEQ ID NO: 3985 - RNA, 3393 nt, synthetic construct
  misc_feature 1..3393: note = Cas9 variant
  source 1..3393: mol_type = other RNA
atgaccaacggcaagatcctggggctcgacattggaatcgccagcgtgggcgtcgggattatcgaggctaaaacaggaaaggttgtgcacgccaattccagactgttctctgcggctaacgccgaaaataacgccgagcggcgcggctttagagggagccggcgccttaatagacggaaaaagcatcgcgtgaaaagagtccgggatctgttcgaaaagtacggaattgtgacggactttcgcaacctcaatctgaacccctatgagcttagagttaagggcctgaccgaacagctcacaaatgaggagctgttcgctgccctgcggaccatctccaaacgcagaggcatctcttacctcgatgacgctgaagatgacagcacagggtccaccgattatgccaagtctattgacgagaaccggcgcctgcttaaaacaaagacccctggacaaatccagctggaaagactcgagaaatacggccagctgcgggggaattttacggtgtatgatgagaacggagaagcgcacagacttattaatgtcttcagcacctccgactacgagaaggaagcccgcaagatcctggagacacaggctgattataacaaaaagattaccgccgaatttatcgacgattacgtggagattctcacacaaaaacggaagtactatcatggcccggggaatgagaaaagcagaaccgactacggacgcttccggacggacggcacaaccctggaaaacatctttggcatcctgattgggaagtgctctttctatcccgatgagtacagagcttccaaagccagctatacagcgcaggaatacaactttctcaatgacctgaacaatcttaaggttcctaccgagaccggaaagctgtctacagaacagaaagaggccctcgtggagttcgctaagtccacggccaccctgggccccgctaaacttctgaaggaaatcgccaaaattctcgattgtaaggtcgacgagatcaaggggtatcgcgaagatgacaaaggaaagcctgatctgcacacatttgagccctaccggaaactgaagttcaacctcgacagcgtgaatattgattacctgtctagagaagtgcttgacaaactggccggcatcctcaccctgaacacagagcgcgaggggatcgaagatgctattaagcggaatcttcctaaccagttcaccgaggaacaaatctccgagattatcaatgtcagaaagagccagtccacggcgtttaacaaaggatggcattctttcagcgccaagctgatgaatgagctcattccggaactgtatgctacatccgacgagcagatgaccatcctgacccgcctcgaaaaatttaaggttaaaaagaaaagctctaaaaacatcaagacaattgacgagaaagaaatcaccgatgagatttacaatcccgtggtggccaagtccgtccggcagacaatcaaaattatcaacgccgctgtgaagaaatatggcgacttcgataagattgttatcgagatgcctagagacaagaatgccgatgacgaaaagaagtttatcaacaaacggaacaaggagaataaaaaggaaaaggatgacgcgctgaaacgcgctgcctacctttataacggcacggataagctgcccgacgaggtgttccacgggaataaacaactcgaaaccaagattagactgtggtaccagcagggagagcggtgcctgtatagcggcaaacctatccccattcaagagcttgtccacaactctaataactttgaaatcgatcatattctcccgctgagcctgtccttcgacgattctctcgccaataaggtgctggtttacagctggacaaaccaggagaaggggcagaaaaccccttaccaggtgatcgactccatggacgctgcctggagctttagagaaatgaaggagtatgtccttaaacaaaagggactgggcaaaaagaagcgcgattacctcctgacaaccgaaaatatcgacaaaattgaggtgaagaaaaagttcatcgagcggaacctggtcgatacgagatatgcttctcgcgtggttcttaattccctccagagcgccctgagagaactggggaaagacaccaaggtgtctgtcgtgcggggccagtttacatcccagctccgcagaaaatggaagattgataagagccgggagacctaccaccatcacgcggttgacgccctgatcattgctgcctcctctcaacttaaactgtgggaaaagcaggataaccccatgttcgtggactatggaaataaccaggtcgtggataaacagacaggcgagatcctcagcgtgtccgacaatgagtacaaggaactggtttttcaacctccctatcaggggttcgtcaacaccatctctagcaaaggattcgaggatgaaattctgttttcctaccaggtggacagcaagtacaaccgcaaggtgtctgatgctacgatctattccacaagaaaagccaagattggcaaagacaagaaagaggaaacctacgtccttgggaagatcaaggacatttatagccagaatggattcgatacatttgtgaaaaagtacaacaaagacaagacccaattcctcatgtatcagaaagatcccctgacctgggagaatgttatcgaggtgatcctgggcgactaccctacaacgaagaagtctgaagatgggaaaaacgacgtcaagtgtaatccgtttgaggaatatcggcgcgagaacggcctcatttgcaaatactccaagaaaggaaagggcacccccatcaagagcctgaaatactatgataagaaacttgggaattgtattgacatcacacctgaagagtctagaaacaaggtgattctgcagagcatcaatccctggcgggcggatgtttacttcaaccctgagaccctcaaatatgaactgatgggactgaagtactccgaccttagctttgagaaaggcacagggaattatcacatttctcaagaaaagtacgatgccatcaaggagaaagaaggaatcggcaagaaatccgagttcaagtttaccctctatcgcaacgacctgattctgatcaaagacattgctagcggggagcaggaaatctacagattcctctcccggacgatgcccaatgtgaaccattacgtcgagctgaagccgtatgataaggaaaaatttgacaatgtgcaggagcttgttgaggccctgggcgaagctgataaggtgggaagatgcattaaaggcctcaacaagcctaacatctctatctacaaagtccgcacagacgtgctggggaataagtatttcgtgaagaaagagggagataagcccaaactggactttaagaacaataaaaagtga

SEQ ID NO: 3986 - RNA, 3396 nt, synthetic construct
  misc_feature 1..3396: note = Cas9 variant
  source 1..3396: mol_type = other RNA
atggcccagcacgtgttcggcctggacatcgggattgctagcgtcggatgggccatcctcggcgagcaaagaattatcgatctgggggttcggtgctttgacaaggcggaaaccgctaaagagggagatccccttaacctgacacgcagacaggcccggctcctgcgcagacggctttaccgcagagcctggcggctgacgcagctctcccgcctgctgaagagaaaaggcctcattgctgacgccaagctgttcgctaaagccccttcttatggggatagcgcgtgggaacttcggcgccagggactggacagactcctgaccccgcttgagtgggcccgggtgatctaccatcaatgtaagcaccgcggctttcattggacatccaaggctgaagaggccaaagctgattctgacgccgagggcgggagagtgaagcagggactggcgcacaccaaagccctcatgcaggctaagaattatcggagcgccgctgaaatggtcctggccgagttccccgatgcccagagaaacaaacgcggccaatacgacaaggctctgtcccgggtgctcctgggggaagaacttgcgctgctctttgccacacagagacgcctgggaaatcctcatgcttctgatttctttgagaagctgatcctgggcgacggggatcggaaaagcggactcttctggcagcagaagcccgccctgtccggcgccgacctgctcaaaatgctgggcaagtgcacctttgaaaaaggggagtatagagctcctaaggccagcttctctgttgaacgccacgtgtggcttacacggctgaacaatctcagaattgtcgtggacggacgctcccggcccctgaacgaggcggaaagacaagctgcccttctgctcccttaccagaccgagacgagcaaatataagaccctgaagaatgcctttatcaaagctggcctgtggggagatggggttcgcttcggcgggctcgcctacccgtctcaggctcaaattgacgccgagaagacaaaagatcccgaagaccagtttctggtgaaacttcctgcgtggcacgagctgcggaaggccttcaaggctgccggacatgaagctctctggcagcagatctccacccccgccctggatggcgaccctacactgcttgatcaaattgcgaccgtcctcagcgtgtacaaggacggcgccgaggtggtccagcagctgagacagctggctctccccgaaccggccgcttctatcgccgttctggagaaaatttccttcgataagtttagctccctttctctgaaagccctccggcgcatcgtgcctctgatgcaaagcgggctgagatatgacgaggctgtggcgcagatccccgaatacggacaccattcccagcggattgagcctggcgccgctaagcacctttatctccctcccttctacgaagcccagagaaaatatgccgggaagggagatcacatcggcagcatgcaatttcgcgacgacgctgatattccccggaacccggtcgtgctgagagccctgaatcaggcgcgcaaggttgtgaacgctctcatcagagagtacgggtctcccattgccgtcaatatcgaaatggcccgggacctgtcccgccctcttgatgagagaaacaaagtgaagcgggctcaggaggagttccgcgacagaaatgatcgggcccgcagcgagtttgaaagagacttcggctataaacccaaggcggctgcctttgagaaatggatgctgtaccgggagcagctcggacaatgtgcctactctcagcagcctctggatatccaacgcgttctggacgatcataactatgctcaggtggaccacgcccttccctacagcagatcctatgatgactctaagaataacaaggtcctcgtgctgacgcatgaaaaccagaataaaggcaaccggacagctttcgagtacctgaccagctttccggatggggaagacggagagagatggcgcacattcgtcgcctgggtgcagggcaataaggcgtatcggatggccaaaagaaaccgcctcctgcggaagaattacggggttgacgaatccaaaggatttattgatagaaaccttaatgacacccgctatatctgcaagttctttaaaaactacgtggaggagcaccttcaactcgctgcccgggctgatggcgacaccgccagacgctgtgtcgtggttaatgggcagctgacagccttcctgcgggctagatggggccttacgaaggtgcggggagatagcgaccgccatcacgcgctcgatgccgctgtcgtggccgcctgcacccacggcatggtgaaggctctggccgactactctagacggaaagaaatttccttcctgcaggaggggtttcctgatcccgaaacaggagagatcctcaaccctgcggctttcgaccgcgccagacagcattttcccgaaccttggacccacttcgcccatgagctgaaggctcggctttttacagatgacctggccgcgctcagagaggatatgcaacgcctgggcagctataccacggaagacctggggcggcttagaacactgttcgtttctcgcgctccccagcggagatccggaggcgccgtccacaaagagaccatttacgcccagccggaaagcctcaagcagcaagggggcgtgatcgagaaaatcctgctcacctccctgaaacttcaggactttgataagctgctcaatcctgaatctaacgaccacttcgtggagccccatcgcaatgagcggctgtatgctgccattagacagcgcctggaacaatttggaggcagagctgataaggccttcgggcccgacaacctttttcacaagcctgataaaaataaccagccgacaggacccgtcgtgcggagcatcaagctggttcgcggcaaacagaccgggattcctatcagaggaggcctcgcgaagaacgactccatgctgcgggtggatattttcacaaaggccgggaaatttcatctcgtccccgtgtacgttcaccatcgcgtgacgggcctgcctaatagagctatcgtcgccttcaaggacgaggatgaatggacccttattgacgagtctttcgcttttctgttcagcgtgtatcccaacgattacgttaaagtgacactcaagaaagagcagcaatccggatattacagcggcgccgaccggtctaccggggccatgaatctgtgggctcacgacagagcggcctccgtcggaaaggatggcctgatccgcgggatcggagtgaagacagctcttagcgtggaaaaatttaacgtcgacgttctgggccggatttacctcgcccctcccgagaccagatctggcctggcctga

SEQ ID NO: 3987 - RNA, 3399 nt, synthetic construct
  misc_feature 1..3399: note = Cas9 variant
  source 1..3399: mol_type = other RNA
atggcccagtacgtgttcggcctggacatcgggattgctagcgtcggatgggccgttctcgatgcgcaaagaatcgtggacctgggcgtgcggtgctttgataaggctgagaccgccaaagaaggggacccccttaacctgacacgcagacaggcccggctcctgcgcagacggctttatcgcagagcttggcggctgacgcagctcgcccgcctgttcaagagagagggactgattgatgacgctaaactctttgccaaggcgccttcctggaccgaaaatgcctgggagctgcggcttcgcggcctggatcacctcctgacaccgcttgaatgggctagagtcatctaccatctgtgtaaacaccgggggttccattggacctctaaggccgaggaggctaaggccgaaagcgacgcggagggaggccgcgtgaaacagggcctcgcccacacaaaggctctgatgcaagttaaaaactatagatccaccgccgaaatggtgctggctgagtttcccggggcccagcggaataagagaggacagtacgataaagccctctctcgcgtcctgcttggcgaggaactggctctcctgttcgcgacacagcggagacttgggaaccctcatgccagcgagcactttgaacaactgattctcggacacggcgaccgcaagtccgggctgttctggcagcagaagcccgctctgtctggagccgatctcctgaaaatgcttggcaagtgcacctttgagaaaacggaatatcgggcccctaaggctagcttctccgccgagagacatgtgtggctgacccgcctcaataacctgcggatcgttgtggacggcagagcgcgcccccttaatgatgctgagcggcaggccgccctgctcctgccttaccaaacagaaacctttaaatataagacactgaaagctgccttcgtcaaggtggggctctggggagacggcgtgagatttgggggactggcttacccgagccaggcccaggcggaggccgaaaaggctaaagaccccgaggatcaattccttgtcaagctgcctgcctggcacgaactccgcaaggctttcaaagccgcgggccatgaggccctgtggcagcagatctctatgcccgctctggaggaagaccctacccttctcgatcagattgccacggttctgtccgtgtacaaagacgggacagaggtggtccaacagctgcggcagctcgctctgcccgaaccggatgccagcatcgccgtgcttgagaagattagatttgacaagttctcttccctgagcctcaaagctctgcggcgcatcgttcctctgatgcagggaggccttagatatgatgaagcggtggcccaaattcccgagtacggccaccactctcagcggatcgaccctggggctaccagacatctctatctgcctcccttttacgaggcccagcgcaagtatgccggaaaaggcgatcggattgggtccatgcagttcagagaagacgctgatgtcccccgcaacccggtggttctgagagccctcaatcaagcgcggaaggtggtcaacgctctgatccgcgagtacggaagccccgtggccgtcaatatcgaaatggccagagacctttcccggcctctggacgagcgcaacaaagtgaagagagctcaggaggaatttcgggatcgcaatgacaaggccagatctgagttcgaacgggattttggctataaacccaagggggcggttttcgagaaatggatgctctaccgcgaacagctgggccagtgtgcttacagccaacagcctctggacattcagagagtgcttgatgaccccaactatgcccaagtcgatcacgccctcccgtactcccggagctatgacgattctaagaataacaaagtgctggttctgacaagagagaaccagaataagggaaaccgcaccccttttgagtacctcacctccttccccggcggggaagacggagagcggtggagagcttttgtggcctgggtccagggcaataaggcttatcgcatggccaaacggaacagactgcttcgcaagaattacgggacagatgaaagccggggattcatcgacagaaacctgaatgatacgcgctatatttgcaaatttttcaagaactacgtggaggaacatctccagctggcggcccggaccgacggcgacacagctagacggtgtgtggttgtcaatgggcaactgaccgccttccttcgcgctagatggggcctcgccaaagtgcggggagattctgaccgccaccatgccctggatgctgcggtggtcgccgcttgcacacacggcatggtgaaggccctggccgactacagcagacggaaagagatcgcttttctccaggaggggttccctgatcccgaaaccggagagattctgaaccttgccgcgtttgacagagctcgcgaacacttccctgagccctggccgcattttgcccacgaactgaaggccagactcttcatcgatgacctggttgctctgcgggaggatatgcagcatcttggctcctatgcccaggacgatctggaccgcctccggacgctgtttgtgtctagagcgcctcaacgccggaatgggggagctgtccacaagggcacaatctacgcccagcccgagaacctcaaacagcaggggagcaccattgaaaagatcctgcttaccggcctgaaactccaagatttcgacaagctgctgaatcccgagtccagcgaccactttgtggaacctcatagaaacgagcgcctttatgccgctattagacggcgcctggaggagttcggaggcaaagccgataaggcttttgggccggacaagcccttctacaaacctgataagaatggacagcccacaggccctatcgttagatctattaaactcgtgcgggggaagcagaccggaatccccatccgcggcgggctggccaaaaacgactccatgctcagagtcgatgtgtttacaaaggcgggcaagttccacctggttcctgtgtatgtccatcaccgggtgacgggacttcccgacagagccattgtggctttcaaagatgaagaagagtggaccctgatcgacgaaagctacgcctttctcttctctgtctatccgaacgattttgtttgtgtgcaacagcgcggcaagcctctgattgaggggtactacgctggactggaccgggccaatggcaacatcaatgtgtgggcccatgatagagctgcgtccgtcgggaaagacggacttattcgcggcatcggcgtgaagacagccctgagcctcgagaaactgaacgttgacgtgctcgggcggatttatcccgctcctcccgaaaccagacggggactggcctga

SEQ ID NO: 3988 - RNA, 3399 nt, synthetic construct
  misc_feature 1..3399: note = Cas9 variant
  source 1..3399: mol_type = other RNA
atgaagaaaatcctgggcgtggacctcgggattaccagcttcggatacgccatcctgcaggagacaggcaaggatctttatagatgcctggacaactccgtcgttatgcggaataacccctacgatgaaaaatctggggagagctcccaatctattcgcagcacgcagaagtccatgagacggctcatcgaaaaacgcaagaagcggattagatgtgtggctcagaccatggagcgctatggaatcctggactactctgaaacaatgaaaatcaatgatcctaagaacaatccgattaaaaacagatggcagcttcgggccgtggacgcgtggaagcgccccctgagccctcaagagctctttgctatcttcgcccacatggccaaacatagaggctataagtccattgctaccgaggatctgatctacgaactggagctcgaactggggcttaatgaccccgagaaggagagcgagaaaaaggccgatgagcggcgccaggtctataacgctctgagacacctcgaagaactgcggaaaaagtacggaggcgaaacaattgcccagaccatccatcgcgcggtggaggccggcgaccttagatcttaccggaatcacgatgactatgagaaaatgattagacgcgaagatatcgaggaagagatcgaaaaggttctgctccggcaggctgagctgggggccctgggactccctgaggaacaagtgtccgagctgattgacgaacttaaagcgtgcatcacagaccaggagatgcccaccattgatgaaagcctgtttggcaagtgtacgttctacaaggacgagctcgccgcgcctgcctattcttacctgtatgatctttacagactgtataaaaagctcgctgacctgaacatcgatgggtacgaggtcacccaggaagaccgcgagaaagtgattgaatgggttgagaagaaaatcgcccagggaaagaatctgaagaaaatcacacataaggatctccggaaaattctgggccttgctccggagcaaaagatctttggggtggaagacgagagaattgtcaaaggaaagaaggaaccccgcaccttcgtgccctttttctttctggccgatatcgccaaattcaaggagctctttgcttccattcagaaacaccctgacgcgctgcagatcttccgggaacttgccgagatcctgcaaagaagcaagacacctcaggaggctctcgatcgcctgcgggccctgatggccggcaaaggcattgacaccgacgatagagaactcctggagctttttaagaacaagcgctctgggacgcgggaactgtcccacagatacatcctcgaggctctgcccctgttccttgaaggatatgacgagaaagaggtgcagcggattctcggcttcgatgaccgcgaagattacagcagatatccgaagtccctgcggcatctgcacctcagagaggggaatctgtttgaaaaagaggaaaaccctatcaataaccatgccgtcaagtctcttgcgagctgggctctgggactcattgccgacctgtcctggcgctacggccccttcgatgagatcattctggagacaacccgggacgcccttcctgagaaaatcagaaaggaaatcgataaagctatgcgcgaaagagagaaggccctcgacaagattatcgggaaatataagaaagagtttcccagcattgataagcggctggctcgcaaaatccagctgtgggaaagacaaaagggactcgacctgtactctggcaaggttattaacctttcccagctgctcgatggcagcgccgacatcgagcacatcgtgccccagtctcttgggggactgagcacagactataataccattgtgaccctgaaatccgtcaacgcggccaagggcaatcggctccctggggattggctggctggaaacccggactaccgcgaaagaatcggcatgctgtctgagaaagggctcattgattggaagaaacggaagaatctgcttgcccagagcctggacgaaatctacacagagaacacgcactccaagggcattcgcgctaccagctatctcgaggccctggtggcgcaagttctgaaaagatactatcccttccctgatcccgaacttcggaagaatggaatcggcgtgcgcatgatccctgggaaagtcacatctaagaccagatccctcctgggaattaaaagcaagtctcgggagacaaactttcatcacgccgaagacgctctgatcctctccaccctgacgagaggctggcagaatcgccttcatcggatgctgagagataactacggaaagagcgaggccgaactcaaagagctgtggaagaaatatatgccccacattgaggggctgacacttgctgactacatcgatgaagccttccgccggtttatgtccaagggcgaggaatctctgttctatagagacatgtttgataccattcgcagcatctcctactgggtggacaaaaagccgctctctgccagctcccataaagagaccgtttacagctctcggcacgaagtgcctacactgagaaagaatatcctcgaggctttcgattccctgaacgtcattaaggaccgccacaaacttaccacagaggaatttatgaagcggtatgacaaagagatcagacagaagctgtggctccatcggattgggaatacgaacgatgaaagctaccgcgcggtggaggagagagccacccagatcgctcaaattctgacacggtatcagctgatggacgcccagaatgataaagaaatcgacgagaagttccagcaagcccttaaggaactgattacctctcccatcgaggtcacaggcaaactcctgcgcaagatgagatttgtgtacgataaactcaacgctatgcagatcgaccggggactggttgaaaccgataagaacatgcttggcattcacatctccaaagggcctaatgagaagctgattttcagacgcatggacgtgaacaatgcccatgagctccagaaggaacggagcggaatcctgtgctatctgaacgagatgcttttcatttttaataaaaagggcctgatccactacgggtgtctcagatcttatctggaaaaaggacaaggcagcaagtacatcgctctcttcaacccccgctttcctgctaatcccaaagcccagccgtccaagttcacgagcgattctaagattaaacaggtcgggatcggctccgccaccggaattatcaaggctcacctggaccttgatggccatgtgcggagctacgaggtttttgggacactgcctgaaggatccattgagtggttcaaagaggaatctggctatgggagagtggaggacgacccccaccattga

SEQ ID NO: 3989 - RNA, 3402 nt, synthetic construct
  misc_feature 1..3402: note = Cas9 variant
  source 1..3402: mol_type = other RNA
atggacctgaactacagaatcggcctcgatattgggatcgccagcgtgggatgggctgtcctggagaataactccaaggacgaacccgttcggattgtggatcttggcgtgcgcctgttcgaggccgcggaagtccctaaaaccggggctgccctcgccgagccgagacgggaagctcgcacaacgagacggcgcctgagacggcgcaagcacagacttgagcggatgaaatggctgctccaggagtatggactgatccaaaccgaagagtttatgaagcgctaccattctgccggcctgcccgacgtgtatagactccggtacgaagggctggagcgcaaacttaaggatgaggaactggctcagattctcatccacatcggaaagcatagaggcttccggagcacaagaaaagccgagctgaaggacaaaaatgataaggaaaccggcgcggttctttccgccacacgcgagaacgaaaaactgatggaggagcacgggtatcggaccgctggagaaatgatttacaaggacgataagtttagaacaggctgcacctggaaagaggaagggtatcgcctcacgcctcggaataaggagggagactacaaaaacaccatgctgagagccctgctcgaagatgaggtgaaggtcatcttcgactgtcagcgcaaatttggcaatcagaaggcttctgaggaactggagaaagcctaccttgcgattatgacaagccaacggtccttcgatatggggcccggaaagcagcctgacggctctgccagcccctatgctatggaaggctttggggacagagtgggactgtgcgccctcgagcctcgcgaaaagcaggagccgcgggctcccaaagccgcctacacctccgagctgttcgttgcgcttcagaagatcaaccatctgagaattacagagaaaaatggcaaggggcgcggactcaccagcgaggaacgggagagactgtctgatctgctccacaaaaagaaggagctgacgtatggcgctgtgcggaaagaacttcaactggacctccgctacagatttaacacactgaattattccagcaagaaaatgaccgaggaagagaagatcaaagatgccgaaaaggctaagttcgtctctatggtgtcccactacgagtatcggaaaagaatgagcgggatgcttgagcagctgtctcctgaagaacaggccgacctcatggatgaagtgggaaagattctgacactgtacaaaaacgacgatacccgctcccgggagtttcagaagctcggcctggacagcgaaatcaccgaggagcttctggaactcaatcccagaggcttccaacatgtctccctgaaagccatgaagaagctgatgccttaccttaaagaggggctcacatatgataaggcttgtgccgaagcgggatacgactttcagggctctgttcagaaagagcgcagcagactgctgaaggggaaagaaatcacggatattatcaacgacattaataaccccgtggtgaagcggtccgtcagccaaaccgtgaaagttatcaacgctattatccagaagtatggatctccgcaggccgtgaatatcgagctcgcccgcgagatgtccagaaactacgacgaacggcgcaagatggagaaacagatgaaggatagacaaagcgaaaatgagcgggctaaaaaggagattcaggaactgggcaacgccttccctacagggcaggacatccttaaatatcgcctgtggcacgatcaggacggcatttgcatgtactctgctaagagaatccccctcgccgagctgttcaccggagcgtatgatattgaccatatcctgccttacagcatcacatttgatgactcctaccggaataaggtccttgtgacctctgaagagaaccgccaaaaaggcaatcggattccctatgaatacttcgggagcgattccgagagatggagcaagtttgagacgctcgttaactctagaatccgcgactatcggaaacagcagaatctgctgaagcagtccttcacagaagaggaaagaaaagagtttaagcaacgcaacctcaatgataccaagtacattacccgggtgatctataacatgattagagaaaatctggcccttgctccctacaacagccctggcaaaaagaaacaggtcttcgccgtgaatggaggggtcacagcttatctgcgcaagcggtggggaatgtctgccaaagacagatccatcgatacccaccacgcgcgcgacgccgtggttattgcttgttgcacagacggcatgatccagaagatcagccggaacattcaggggagagagctcctgtacgcccggggctttacggctgtggatgtcgagaccggagaaaagttcacacgcgacgattttaccagagaccaatgggatgagatcttcggcgtgcaggttccgaaaccctgggaatactttaacgaggaactggacattcggcttggggagaatcctgtggagttcatcgaaacacattccgatgtctctcgcaagctcgactatcccgcctggttttacgagaacaatattatcagacctgtgttcgtgagccggatgcccaacagaaaagttaccggagccgctcacgcggatacgatccgctccccgcggcattatcaggaaaccggctctgtcctgacaaagaccgccctgattgacctcaaactgaataagaaaacaggggagatcgagaactactataagcctgaaagcgatacccttctgtacaatgctctcaaggagagactggaactgtatggaggcgacgggaaaaaggccttcgaggaacccttttacaaacctaaggccgatggctcccgcggaaaccttgtgcggaaagtgaagacgtacgacaagctcacactgggcgtctatgtgaatagccaacacgggattgctgccaacgcgaatggatctatggttagagtggacgtcttccgcgtgtccggcaaatactattttgttcccgtgtacatcgctgatgtcgtgcggaagagactgcctatgaaagccgttgtgcaggggaagcagtatattgactggaaagagatggaggataaggacttcatctttagcctctacacccgcgatctgatctctttcaagtccaaaaacggaaagaaagtcacatgtgtggacggcaccagcaaggccgtgaatgaagagattgtctattactacggggctaacatctctaccgccagcttttccggcaaaagccataatggatctttcgaatttacatcccttggcattcaggggctggagtatctcaagaagtaccaagttgatgtgctgggaaacgtgagcgaagtcaaaagagagaagcggatgggcttccgctga

SEQ ID NO: 3990 - RNA, 3402 nt, synthetic construct
  misc_feature 1..3402: note = Cas9 variant
  source 1..3402: mol_type = other RNA
atgggcgggttcgaggtggacagaaagatcagcctgggactcgatattggcgtctcctctgttgggtacagcgtgatcgacgtggataccggaaaagtcctggaacttggctcccggctgattaacgggaagatcggaacagagaatcaggcccgcagagaaatgcggggcacgcgcagactcattaaccggaaaaagcaacgcagaaaagacaccgtgaagctgtttaatgagttcaaacttatcgattctaaaaaggacgaacactattttgatcatttcgctaacaatagcgacccctacgagctgcgggttaaaggcctctccgagaagctgtctctgagcgaaatcgccgatgggctctatcacattgtgaaacgcagaggaatctcctacgacctgaaggatgcggacgaggaaagcgagggctctgagtatgaaaacgggcttaagattaataactccgagctgaaaaatcagacccctgctcagatccagctcaagcggctgaacgaatacggagccattcgcggcaaagtcgtgatcgatgaggaaaagattcttctgaatgtttttccgacaaaagcctatctcgacgaggctaagagaatcatcgagaaacaacgggagttctaccccgggattctgacagaggaatttgaggaaaagtactgccagatcctgacccgcaagagagactatttcgtgggacctggcagcgagaaatctcggacagattacggcatttataaggaggacgggagaaccctcaacaatctgtttgaagaacttatcggacatgataaaatttaccccgaggaactgcgcgcctccggcgctagcttcacggcccagctctttaacgtcctgaatgaccttaacaacctgcacatctcttcctatgaagatcagaagctcaccacagagaataaagagcaaatcattagcgaactgaagtccaccacatctaacgtgaatatgatgaagctgatccagaaaattgcggggtgtgaggaaagcgacatctccggataccggaccgataagaactataaacctgagattagctctatgagaatctaccgcaaggtgcataaaaagctcctggagtccgaaatcgacattacgaattggcccgatgacttcatcaacaaacttagctttattctgacactcaataccgagaacggcgaaatccggaatcagctgaagaacagacttcagcctgagtacgatttcctgacagacgaactcattcaaaccatcattgacaataaggagtctttcgatatcaaaagcaacaataagtggcaccgcttttccatcaaaaccatggagctgctgattccggaaatgatcaagcggcccgtcgagcagatgacactcattaacgaaatggggctgatcaaaaattctggaaagaagttcagcaactataagtaccttccttataagaaaattgccgaggacatctacaaccccgttgcttccaagagcgtgagagaagccctgaaaatcgtgaatgctattctcaaggagtatggccacatcgagtacattgtcgtggaaatgcctcgcgataagaacgaggacgaagccaaagatcagatcgagaagtttcaaaaagcgaatggccggctgaaggacgccgctctggaagagttcacggaggccattggggataaatctaccgttgacaagaaacttggagtgcatagatccaagctcctgtttaagatccgcctgtggtatcagcagcggggcatggatctctacgaagggaaacccatcagcgctgtcgacctgcttaacaatccggattctttccagattgaccacatcattcctcaatccgtgagctttgatgactccttcaacaataagacactgtgcaactctggactcaatcagatcaaagacaagaagaccccctttgagtacatgaacgaaggctatgggcagggcttcgatagcatgaaagccatggttatgaagaatcctagaattgaccataacaaacggaagaattacctgttttccgagaacgtgtctgatatcgagacacgcaaaagattcatcagccggaatctggtcgacaccagatatgcctcccgcgtggtccttaacaacctccaggaatttttcaaggagaaggaaagcgatacgaaaatttctatcattcggggaaagttcacatccaatctgagaaaacactggaagatcaacaaaaatcgcgacacctaccaccatcacgctattgatgcgaccatcattgccgctacaccctttctgaacatctggaagaaaggcagctctatcttcccctccaatgtggagagcgaagactttttcgatattaagaccgggaagatcattggaaacgacgagtttaataaatatgcctacgatgagccttataacggcttctacaatgaactcagaaacgccacagaccggatcaagttttctcatcaaattgataaaaagatgaatcgcaaagttagcgactccacgatctacagcaccagagtggctaagtctccgaagaacaaaaaggagtccgaatatatcgtcgccaaaattaagaatatctacgacgcggatgagtatgctaaattcaagcggatttacgacaaggataaaacaaagtttctgcttaacaaatatgacccccgcagcttcaatcacctggaaaagatcatgaacacctaccctgattccattgagagaacaatgtctaacaataaagtgaaggttgtgcggatcagcccctttgagctctatcgccaggaccatgggcctgtcaagaaatactccaagaaaaacaatggacccgaaatcaagcagctgaaatacctggataagaaggtgggctctagcattgacgtgaccccggataacgccaaaaataagcacgttatccttaaatccctcaagccttggagaacggacatttatctgaaccacgagaccggggaatacgagatcatgggcattaaatattctgatctgaagttcaataaaggagaaggctacgggatcaagaaggccaaatatctcgagattaagcatcgggagaaagtcagcgacgactccgaatttatgttcacactgtacaagaaaaaccgcatcaaggtggagaatatggaaaccgatgagagcgtggagatgcttttctggtctagaacaatggactcccagaagggatatgctgaactgaaacccatctacaagtacaaaaccgaggatgacaactggcctatttatggcaatgccaagaaacaaatcattaagaagctcatccccaaaaactgtaagatttggaaagtcaatacggatgtgctggggaaccctttttacgttgaaaaggagggagaatatcccaaagacgtgctggattga

SEQ ID NO: 3991 - RNA, 3405 nt, synthetic construct
  misc_feature 1..3405: note = Cas9 variant
  source 1..3405: mol_type = other RNA
atgaacggcctggtgctcgggctggacatcggaattgccagcgtcggcgttgggatccttgagaaaaattccggaaaaattgtgcacgcttctagcagaatcttccccgccgcgaccgctgataacaatgtggaacggcgcaagaacagacaggcccggcgcctgcatagacggaaaaagcaccgcggcgccagactcaaagacctgtttgagtactatgggcttctgacagatttctccaaggtctctattaatctcaacccttaccggctgcgcgtggacggactggatcaacagctcacgaatgaggaactgtttatcgctcttaagaacatcgttaaaagacggggcattagctatctggacgatgcctccgaagacggcgggaccgtgtctagcgattacggaaaggctgtcgaggagaatcgcaaactcctggccgaacagacaccgggccagatccaacttgagagattcgaaaagtatgggcagctgcggggagactttaccgtggttgagaactccgagaaatgccgcctcattaatgtgttcagcacatctgcgtacaagaaggaagccgagagaatcctgcggaaacagcaggaatttaacaatcaaattaccgatgagttcatcgaagactatctgaagattctcacaggcaaaagaaagtactaccatgggcccggaaacgagaaatcccgcaccgattatggccggtttagaacggacggcgctaccctggacaatatcttcgggatccttattggaaagtgtacattttaccctaacgagtatcgcgccagcaaggcttcttacaccgcccaggagttcaacctgctcaatgatctgaacaatcttacagtccccaccgaaacgaagaagctgtccgaggaacagaaaaagacaatcattgaatatgcgaaaagcgccaagaccctcggcgcttctacactgctgaaatacatcgccaagatgattgacgcttccgtggatcagatccgggggtatagagtggacgtcaacaataagcctgagatgcacacctttgaggtttaccgcaaaatgcaaagcctcgaaaccatctccgtgggagagctgtctcggaacattcttgatgaactggcccatatcctcacactgaatacggagagagaaggcattgaggaggccatcaacaccaaacttcgcgacagcttctcccaggatcaggtgctggaactcgtccaattccggaaaaataacagctctctgttttccaaggggtggcacaatttcagcctgaaactcatgatggagctgattcccgaactttacgagacatctgaggaacagatgaccatcctgacaagactcggaaagcaaaagagcaaagagacctccaagcgcacgaaatatatcgacgaaaaggaggtgacagaagagatttacaaccctgttgtggctaaatctgtccggcaggcgatcaagattatcaatgaggccaccaagaaacacggcatttttgataacatcgtgattgaaatggctagagagaataacgaagaggacgccaagaaagattatatcaagcggcagaaagccaaccaggacgaaaagtacgctgccatggagaaagcggctttccagtataatggcaagaaggagctgccggacaacatctttcatgggcacaaagaactggccaccaagattcgcctttggcatcagcaaggagagaaatgcctctacacaggcaagagcatccccatttccgatctgatccacaatcagtataaatacgaaattgaccacatcctgcctctcagcctgtctttcgatgactcccttagcaacaaggttctggtgctcgccaccgctaatcaggagaaggggcagagaacaccctttcaagccctggattctatggacgatgcttggtcctaccgggagttcaaaagctatgtcaaggaatccaaactgcttggaaacaagaaaaaggagtacctcctgacggaagaggacatctctaagattgaagtgaaacagaagtttatcgagagaaatctggtcgatacccgctatagctcccgggtggttctcaacgccctgcaggacttctacaaaaatcataactttgatacaaccatttctgtggtcagaggccagttcacaagccaacttcgcagaaagtgggggctggagaaatcccgggaaacctatcaccatcacgcggtggacgccctcatcattgctgccagctctcagctgcgcctgtggaagaagcagaataaccctcttatcgcttacaaagagggccaatttgttgattcccagacgggagaaatcattagcctcaccgacgacgagtataaggaactggtgttcaaagccccctacgatcatttcgtcgacacactgtcttccaagacctttgaggatagcatcctcttctcttaccaggtggacagcaaatttaatagaaagatttccgatgcgacaatctatgccacccggaaagctaagctggacaaggagaaaaaggaatacacgtatacacttggcaaaattaaggatatctacagcctggggaccaaaacaccgtctaagaccggattctataagtttctcgacctgtacaacaaagataagtcccagttcctgatgtttcaaaaagaccgcaagacctgggatgaggtgatcgaaaagattatggagcagtatagacctttcaaggaatacgacaaggccggcaaacttgttgattttaatcccttcgagaagtaccggcaggagaacgggcctatccgcaaatatagcaagaaaggaaacggccccgaaattaagtccctcaagtactatgacatcctgctggggaaacacaagaatattacacccgagggctctagaaacacggtcgctctcctgagccttaatccttggcggaccgacgtgtactataacatggaaaccaaaaagtacgagtttctgggactcaaatatgccgatctgccgttcgaagagggcggggcctacggaatctccacagagacatacaatgaactgcgcgagaaggaaggcattgggaagaactctgagtttaaattcaccctttataagaatgacctgatcctcatcaaagatacggagacaaactgtcagcaattctttagattctggagccggaccggaaaggacaatcccaaatcctttgaaaagcacaaaattgagctgaagccttacgaaaaggctaaattcgagaagggcgaggaactcgaggtgctggggaaagtgcccccttctagcaaccagtttcagaagaatatgcagatcgaaaacctttccatttataaagtcaagaccgatgttctgggcaataagcatttcatcaaaaaggagggagacaaacccaagctcaaattttga

SEQ ID NO: 3992 - RNA, 3405 nt, synthetic construct
  misc_feature 1..3405: note = Cas9 variant
  source 1..3405: mol_type = other RNA
atgaacggcctggtgctcgggctggacatcggaattgccagcgtcggcgttgggatccttgagaaaaattccggaaaaattatccacgctaactctagactgttccccgccgcgaccgctgataataacgtggaacggcgcaagaatagacaggcccggcgcctcaacagacggaaaaagcatcgcggcgtgagatttcaagacctgttcgaggattacgggcttctgacagactttagcaaagtctccattaatctcaacccttatcggctgcgcgtggatggactgaatcagcagctcacgaacgaggagctgttcatcgcccttaagaatatcgttaagagacggggcatttcttacctggacgatgctagcgaagacggcggggccgtgtcctctgattatggaaaagctgtcgaggagaaccgcaagctcctggccgaacagaccccgggccaaatccagcttgagagatttgaaaaatacgggcaagtgcggggagacttcacagttgtggagaatggcgagaagctgcgcctcattaacgtctttagcacctccgcgtataaaaaggaagccgagagaatcctgcggaagcagcaggagttcaataaccagattacagatgagtttatcgaagactacctgaaaattctcaccgggaagagaaaatattaccacggacccggcaacgaaaagagccgcacagattacggccggttcagaaccgacgggacgaccctggacaatatctttggaatccttattggcaaatgcacattctatcctgaggaataccgcgcttctaaggcctcctataccgctcaggagtttaacctgctcaatgatctgaacaatcttacagtgcccaccgaaacgaaaaagctgagcgaggaacagaagaaagtgatcgtcgagtacgccaaggaggcgaaaacactcggggcctctaccctgctgaagtatattgctaaaatgatcgacgcctccgttgatcaaattcggggatacagagtggacgtgaacaataagcctgaaatgcatacattcgaggtctatcgcaagatgcagagcctcgaaaccatctctgtgggcgagctgtcccggaacgttcttgatgaactggctcacatcctcaccctgaatacagagagagaggggatggaagaggccattaacacgaaacttaaggacagcttctcccaggatcaagtgctggaactcgtccagtttcgcaaaaataactctagcctgttctccaagggatggcataattttagcctgaaactcatgatggagctgatccccgagctttacgaaacctctgaggaacagatgacaattctgacccggctcggcaagcagaagtccaaagagacaagcaagagaaccaaatacatcgacgaaaaggagctgacggaggaaatttataaccctgtggttgccaaatctgtgcgccaagctatcaagatcattaatgaggcgacaaagaaacacggcatcttcgataacattgtcatcgaaatggcccgggagaacaatgaagaggacgctaagaaagattacattaagagacagaaagccaaccaggacgagaagaatgccgctatggaaaaagccgcgtttcagtataacgggaagaaggagctgccggacaatatcttccacggacataaagaacttgctaccaagattcggctctggcaccaacagggcgagaaatgtctgtacaccgggaagacaatccccatcagcgatctgattcataaccagtataaatacgaaatcgaccacattctccctctgtccctttcttttgatgacagcctgtccaataaggtgctcgtcctggccaccgccaaccaggagaagggacaacgcacacccttccaggctctggatagcatggacgatgcctggtcttatagagagtttaaatcctacgtgaaggaaagcaaacttctcggcaataagaaaaaggagtacctgctgacggaagaggacatctctaagattgaggttaaacagaagttcatcgaacggaacctcatcgataccagatattccagccgcgtggtcctgaatgcccttcaggacttttacaaagctcacaagttcgatacaaccatttccgtggttcgggggcaatttacatctcagctgagacgcaaatggggcctcgaaaagagcagagaaacctatcatcaccatgcggtggacgccctgatcattgctgcctcctctcagctgcggctttggaagaaacaaaacaatagcctcatctcctacaaggagggacagttcgtcgatagcgaaacgggcgagattatctctctgaccgacgacgagtataaagaactggtgttcaaggctccttacgatcactttgtggacacactccgctccaaaaagttcgaggatagcatcctgttttcttatcaggttgactccaaattcaacagaaagattagcgatgccaccatctacgcgacacggaaggccaaacttgacaaggaaaagaaggagtacacctatacgctggggaaaattaaggatatctactctctcggaacaaaggctcccagcaaaaccggcttttataagttcctggacctgtacaataaagataagtcccagtttcttatgttccaaaaagaccgcaagacatgggatgaagtcattgagaagatcatggagcagtatagaccgtttaaagaatacgacaagaccgggaaactcgtggatttcaacccttttgagaagtatcggcaggaaaacggacccatccgcaaatacagcaagaagggcaatgggcctgagattaaatctctgaagtactatgacatcctgctcggcaaacataagaacattacccccgaaggatccagaaatacagtggccctgcttagcctgaacccctggcggacggacgtctactataatatggagaccaaaaagtacgagttcctcggcctgaagtatgctgatctgccttttgaagaagggggagcctacggcatctccacagaaacctataacgagcttcgcgagaaagaagggattggaaagaactctgagttcaaattcacactgtacaagaatgacctcatcctgattaaagataccgaaacgaattgccagcaaatctttagattctggagccggacaggcaaggacaacccgaaatcctttgagaagcacaagatcgaactcaaaccctacgagaaggccagattcgagaaaggggaggagctgaaggtgcttggcaaagttcctccctctagcaatcagctgcagaagaacatgcagattgaaaatctctccatctataaggtgaaaaccgatgtcctgggaaacaagcactttattaaaaaggagggcgacgaacctaaactgaagttctga

SEQ ID NO: 3993 - RNA, 3405 nt, synthetic construct
  misc_feature 1..3405: note = Cas9 variant
  source 1..3405: mol_type = other RNA
atgaacggcctggtgctcgggctggacatcggaattgccagcgtcggcgttgggatccttgagaaaaattccggaaaaattatccacgaaaactctagactgttccccgctgccaccgcggataataacgtggagcggcgcaagaatagacaggctcggcgcctcaacagacggaaaaagcatcgcggcgtgagatttcaagacctgttcgaagattacgggcttctgacagactttagcaaagtctccattaatctcaacccttatcggctgcgcgtggatggactgaatcagcagctcacgaacgaggaactgttcatcgcccttaagaatatcgttaagagacggggcatttcttacctggacgatgccagcgaggacggcgggaccgtgccgtccgattatggaaaagctgtcaaggagaaccgcaaactcctggccgaaaagacacccggccagatccaacttgagagatttgaaaaatacgggcagctgcggggagacttcaccgtggaggagaatggcgaaaagtgccgcctcattaacgtgttttctacaagcgcttataagaaagaggccgaaagaatcctgcggaagcagcaggagttcaataaccaaattaccaacgaatttatcgaggattacctgaaaattctcacagggaagagaaaatattaccacggacctggcaatgagaagtcccgcaccgactacggccggttcagaacggatgggaccacactggacaacatctttggaatccttattggcaaatgtaccttctatcccgaagagtaccgcgttagcaaggcgtcttatacagcccaggaatttaatatcctgaacgacctcaataacctgaccgtccctacggagacaaagaaactttccgaagaacagaagaaagatattgtggagtacgctaaggaaaccaaaacactgggggccagcaccctcctgaagtatatcgctaagatgattgacgcctctgtggatcagatccggggatacagagtcgacgttaataacaaacccgagatgcataccttcgaagtgtatcgcaagatgcaatccctggagacaatcagcgtgggcgaactctctcggaatgtcctggatgagcttgcgcacattctgacgctcaacaccgagagagaagggatcgaggaagccattaatacaaaactgatgggagtgttctcccaggaccaggttcttgagctggtgcaatttcgcaagaacaatagctccctcttctctaaaggctggcataactttagcctgaagctgatgatggagctcatccctgaactgtacgagacctccgaggagcagatgacaattcttacccggctgggcaagcagaaaagcaaggaaacgtctaaaagaacaaagtacatcgatgagaaagaggtcaccgaagagatctataatccggtggttgctaagtccgtgcgccaggccattaagatcattaacgaagctaccaaaaagtacgggatcttcgacaacattgtcatcgagatggcccgggaaaataacgaggaggatgccaaaaaggactatattaaaagacaaaaggctaatcaggatgaaaagaacgcggccatggagaaggctgcctttcagtacaatggaaagaaagaactccccgacagcatcttccacggccacaaggagctggccacaaaaatccggctgtggcatcagcaaggggaaaagtgcctttataccggcaaaaacattcctatctctgacctcattcacaatcagtacaagtatgagatcgatcatattctgcccctgagcctctcctttgacgattctctgagcaacaaggtgcttgtcctggctacagccaatcaggagaaaggacagcgcacgcctttccaagcgctcgactccatggatgacgcttggagctacagagaatttaagtcttacgtgaaagattccaagctgctgagcaacaaaaagaaggactatcttctcaccgaggaagatatctctaaaatcgaggttaagcagaaattcattgagcggaatctggtggacacaagatactccagccgcgtcgtgctgaacgccctccaggatttttataaggcccacaaattcgacaccacaatctccgttgtgcgggggcagtttacctctcaactgagacgcaagtggggccttgaaaagagcagagagacgtaccaccatcacgctgtcgatgccctgattatcgctgcctcctctcagctccggctgtggaaaaagcagaataaccccctgattacctataaagaaggacaattcgtggacagcgagacaggcgaaatcatctcccttaccgacgatgagtacaaggagctcgtgttcaaagcgccgtatgaccattttgttgatacactgcgcagcaagaccttcgaagactctattctgttttcctaccaggtcgatagcaaattcaatagaaagatctctgacgccacgatttacgctacacggaaggccaaactcgataaggagaaaaaggaatatacctacacactggggaaaatcaaggacatttattcccttggaaccaagacccctagcaaaacaggcttttacaagttcctggatctctataacaaagacaagtctcagtttctgatgttccagaaagatcgcaagacgtgggacgaggtgatcgaaaagatcatggagcaatacagaccctttaaagagtatgataagaccgggaaactggtggacttcaacccttttgaaaagtaccggcaggagaatggacccatttgtaaatacagcaagaagggcaacgggcccgaaatcaaatcccttaagtattacgacattctcctgggcaaacacaagaatatcacacctgagggaagccgcaacaccgtcgctctgctctctctgaatccgtggagaacagatgtgtattacaacatggaaaccaaaaagtatgagttccttggcctgaagtacgccgacctcccctttgagaaagggggagcgtatggcatttccacggaaacatacaataagctgcgggagaaagaagggatcggaaagaacagcgagttcaaattcaccctgtacaagaatgatcttattctgatcaaagacaccgagacaaactgccagcagatctttcgcttctggtccagaaccggcaaggataatcctaagtcttttgaaaaacataagattgagctcaaaccctatgaaaaggcccggttcgagaaaggggaggaactggaggttctcggcaaggtgcctcccagctccaaccaatttcagaagaatatgcagatcgaaaacctgtctatttacaaagtcaagacagacgtgcttggcaaaaagcacatcattaaaaaggagggagatgaaccgaagctgaaattctga

SEQ ID NO: 3994 - RNA, 3405 nt, synthetic construct
  misc_feature 1..3405: note = Cas9 variant
  source 1..3405: mol_type = other RNA
atgaagtacatcgagagcgtgtccattggcttcgacatcggggtcggatctgttggctatgccgtgattaacagcaaaaccaagcagatcctggaatccggggtgtctatttttcccgctgccgtcgcgcagaaaaatgtggagagacgggaaagccgccagtccagacggctccgcagacggcgcgttaacagactgaatgatcttaagaaactgctcaagaagaacggattcatcccttctccgaataaaaacccctacgagatccgggtgcgcggcctggaacaccagcttagcagagacgagattgctatcgccgtcctgcatattgccaagcggcgcgggatctcctatagcctcgatgacgtggttgatgagaatgtgacagactttaaaggaaagattgctaaaaaccaggaagccctgaagaataagacgcctggcgagatccaatacgaaagactgctcaaatatggcaaggtccgggggaccgtgacaaactacgtggagtatgatgagcagcccgaatacttcctgaatgtctttcctaactctgcttacgttgacgaggccaaacgcattcttacctgccagaagcagtattaccccgaaatcacagatgacctgatcgagaatattgtgaaaatcatttccagaaagcgggcgtattacatcggacctggcaacgagaaaagcagaaccgattatgggatttaccgcacaaatggagaaaccctcgagaacatcttcgaaatcctgattggcaaggactctgtgaacccggatgagcttcgggcccccgctaattccctgacggcccaagtctataacctcctgaatgacctgaccaacatcagatacaatgggagcgaacgcctcacacctgagcagaagcaggacattctgtctgaacttctgaccacagagaaaaccgtgcagatgctcaacgttatcgctaagaaagtgaatgtcaagaaagaggaaatttccggatttcggacgaagaaggatgacaaacccgatttccacacactggaggtgtacagaaaggttcgcaaacatatgcttaacaagggcatcgacatcaatgaatggcctaccgagtgttttgatgaactggccttcatttttaacctcaatacagagatcggcgagattcggaacagaatcagcgaaaaagtggtccccaagtatgacttcattaccaatcaaatcgtggatgacctgctggaggatccgaagatttttgcgatctccacctctcagaaatggcaccgcttcagcatcaagacaatgaacgtcctcattcctgaactgcttaatgggtacaacgagcagatgacgatcctgacccggatgggactcctggaggactccaaaaacgattatagcaatattgacaagatcgacattaaaaacgtgacagaaaatatctacaaccccgttgtgagaaagtctatcaagaaatgccttaagattttcaatgagctgtataaaaagtaccctaacatctccgatgtcgtgattgaactcccccgcgaggacaatcccgaagatgcccggaaactgatcaagaaaatgcaaaaggagaacctggttgagaaggacaccagcctcgaggcttttagaaaagaagccaatctgtctgaaaacggccttattgatttcctgcggaaggggaaaaatcgcgctctcaagatcagactgtggtatcagcaggagggaaaatgtctgtacacaggcgaacctatccttgccgaggacctctgcaagaacgaggccaattacgatattgaccatatcattccgatcagcgtgtcctttgatgactctattaacaataaggtcctgtgtagctcccacttcaaccggtttgaaaaagagaagaaaacccccttcgaatattttagcaacaagtcttcccacctggggagatacagcaatttcgatgagtttcgcgcttctgtgaacgcgaataaacggatctccgacgtgaagagaaagaacctcctgagcaaagaacttctgtccgatctcgacacgcgcaagaaattcatcgccagaaatctggttgacacacggtatgcttctcgcgtcgtgtttaacgagctgacccagttctttgccagcaagaaagccgataccaaggtggctgtcattagaggaaagttcacatcccaacttcggcgcgcctggcagctcaataaatctagagacacctaccatcaccatgcggtggatgctgccctgatcggcgttacacctttcctgaagatttggcggagcggcaaaacgatctatccccgcaagatgaccgaggcccagacagactttgaactcaacgagattaccacaaatgatgagttcaaagaatcctactatcagctgccttgcccccaatttcttgactacctgacccagatgcaggagaacctcaagatcaatttcgaagtggataaaaagatgaacagaaagattagcgacgctatgatctactcttcccggaaaaagaaactgagcaaggataaaaaggagaaggaatattctctggggacgatcaatgacatttactccgatgccggatatagcaaatttaagaacatctacaaaaaggacaaagagaagttccttatgtatcacctcgatcacaagtcttttgaaattctggaggacatcattagccagtacccggacaaagaggaatatatcgattccgagggcaaggtcaaacaacgcgctgtgagccctttcgaaatctacagacggaagtacgggtatattagaaaatactctaagaagaataacggacccatcattaaaaacatgaagtattacaatgagaacctgcctaaaatctatattgacatcacccccaagcagtccatcgataaaaaggtttacctcacaaatattagcccttggcgcaccgacgtgtattacaaccggtcccaaaattcttaccatatcatgggcattaagtatagcgatctgagatacatcgacgggaaatatggcattcccaagaacgtctacgaaaagatcaaacttcgcgagaaaattccgtccgagtctgaattttgtttcagcctgtataagaatgatcgggtgaaaatcatcgaccctaacaagaatgaggaaattgagctcagatttaactcccgcacactgccctctgttctgaattacgtggagttcaagcccctttttcaggaaagctataactccctcaccctgctgcctgtcttcagcaaaacgacatctgagggacggatcattaagaaattcaccagagaagataatatcgtgtacaaggtgaacacagacgagctcggcaatccgtactatattctgaaagaatcccaaaaccccaagaatatcatcgataacagcaacaagaccgagtga

SEQ ID NO: 3995 - RNA, 3405 nt, synthetic construct
  misc_feature 1..3405: note = Cas9 variant
  source 1..3405: mol_type = other RNA
atgaacggcctggtgctcgggctggacatcggaattgccagcgagggcgtcgggatccttgaaaagaactccggaaaaattatccacgctaattctagactgttccccgccgcgaccgctgataataacgttgagcggcgcaagaatagacaggcccggcgcctcaacagacggaaaaagcatcgcggcgtgagatttcaagacctgttcgaagattacgggcttctgacagactttagcaaagtgtccattaatctcaacccttatcggctgcgcgtcgatggactgaatcagcagctcacgaacgaggaactgttcatcgcccttaagaatatcgtgaagagacggggcatttcttacctggacgatgctagcgaggacggcggggccgtttcctctgattatggaaaagctgtggaggaaaaccgcaagctcctggccgagcagaccccgggccaaatccagcttgaaagatttgagaaatacgggcaggtccggggagacttcacagtggttgagaatggcgaaaagctgcgcctcattaacgtgtttagcacctccgcgtataaaaaggaggccgaaagaatcctgcggaagcagcaagagttcaataaccagattacagatgaatttatcgaggactacctgaaaattctcaccgggaagagaaaatattaccacggacccggcaacgaaaagagccgcacagattacggccggttcagaaccgacgggacgaccctggacaatatctttggaatccttattggcaaatgcacattctatcctgaagagtaccgcgcttctaaggcctcctataccgctcaggaatttaacctgctcaatgatctgaacaatcttacagtccccaccgagacgaaaaagctgagcgaggagcagaagaaagtgatcgtggagtacgccaaggaagcgaaaacactcggggcctctaccctgctgaagtatattgctaaaatgatcgacgcctccgtcgatcaaattcggggatacagagttgacgtgaacaataagcctgagatgcatacattcgaagtgtatcgcaagatgcagagcctcgagaccatctctgtcggcgaactgtcccggaacgtgcttgatgagctggctcacatcctcaccctgaatacagagagagaagggatggaggaagccattaacacgaaacttaaggacagcttctcccaggatcaagttctggagctcgtgcagtttcgcaaaaataactctagcctgttctccaagggatggcataattttagcctgaaactcatgatggagctgatccccgaactttacgagacctctgaggaacagatgacaattctgacccggctcggcaagcagaagtccaaagaaacaagcaagagaaccaaatacatcgacgagaaggagctgacggaagagatttataaccctgtcgtggccaaatctgttcgccaagctatcaagatcattaatgaagcgacaaagaaacacggcatcttcgataacattgtgatcgagatggcccgggaaaacaatgaggaggacgctaagaaagattacattaagagacagaaagccaaccaggacgaaaagaatgccgctatggagaaagccgcgtttcagtataacgggaagaaggaactgccggacaatatcttccacggacataaagagcttgctaccaagattcggctctggcaccaacagggcgaaaaatgtctgtacaccgggaagacaatccccatcagcgatctgatttataaccagtacaaatatgagatcgaccatattctccctctgtccctttcttttgatgacagcctgtccaataaggtcctcgccctggccaccgctaaccaggagaagggacaacgcacacccttccaggccctggatagcatggacgatgcttggtcttacagagaatttaaatcctacgtgaaggaccttaaaagcctctctaataagaaaaaggattatctgctgacggaggaagacatctccaagattgaggtcaaacagaagttcatcgagcggaacctcgtggataccagatacagctcccgcgttgtgctgaatgcccttcaggacttttataaatctcaccaattcgatacaaccatcagcgtcgtgcggggccagtttacatcccagctgagacgcaagtgggggctcgaaaaatctagagagacctaccaccatcacgcggttgacgccctgattatcgctgccagctcccaactgcggctttggaagaagcagaacaatcctctcattacgtataaagaaggccagttcgtggacagccagaccggagagatcatttctctgacagatgacgaatacaaggagctggtcttcaaagctccctatgatcattttgtggacaccctctccagcaagacattcgaggattctatcctgttttcctaccaagtggacagcaaattcaaccgcaagatctctgatgccaccatttacgcgacgagaaaagccaaacttgacaaggaaaagaaggagtatacatacaccctgggcaaaatcaaggatatttatagcctcgggacaaaaaccccgtccaagaccggattttacaagttcctggacctgtataataaagataagagccagtttcttatgttccagaaagaccggaagacatgggatgaagttatcgagaaaattatggaacagtaccgcccttttaaggagtatgacaagacgggcaaactcgtcgacttcaacccctttgagaagtacagacaagaaaacgagcctatccggaaatactctaagaaagggaatggacccgaaatcaagtccctgaagtattacgatattctgctcggcaaacacaagaacatcacccccgaggggagccgcaatacagtggctctgctttccctgaacccttggagaaccgacgtgtattacaatatggaaaccaaaaagtatgagttcctcggcctgaaatacgccgatctgccgtttgaggaaggaggcgcttatgggatttctacagagacgtacaacgaacttcgggagaaggagggaatcggcaagaatagcgagttcaaattcacactgtacaagaacgacctcattctgatcaaagataccgaaaccaattgccagcagatttttcgcttctggtccagaacagggaaggacaaccccaaatcttttgaaaagcataaaatcgagctcaagccttatgaaaaggcccggttcgagaaaggagaggaactggaggtccttggcaaggtgccccctagctccaatcagctgcagaaaaacatgcaaatcgaaaatctctctatttacaaggttaaaaccgatgtgctggggaacaagcactttatcaagaaagagggcgacaagcccaaactgaagttctga

SEQ ID NO: 3996 - RNA, 3408 nt, synthetic construct
  misc_feature 1..3408: note = Cas9 variant
  source 1..3408: mol_type = other RNA
atgagcgacctggtgctcggcctggatatcgggattggatccgtcggcgttgggatccttaacaaggtgaccggagagattatccacaaaaattctagaattttccccgccgctcaggccgaaaacaatctggagcggcgcacaaacagacaaggccggcgcctcacgagacggaagaaacatcgcagagtgcggctgaatcacctttttgaagagagcgggctgatcaccgacttcacaaaggtctccatcaacctcaatccttaccagctgcgcgtgaaaggactgaccgcggaactctctaacgaggagctgtttattgctcttaagaatatggttaagcatagaggcatcagctatctggatgacgcctccgatgacggcaactctagcgtgggggattacgcccagattgtcaaagaaaattccaagcagctcgagacaaaaaccccgggacaaatccagctggaacggtatcagaagtacggccagcttcgcggggacttcacagtggaggaggatggaagaaaacaccggctgattaacgtttttcccaccagcgcttatcatgccgaagctctccgcatcctgcaaacgcagcaggagttcaatcctcagattaccgacgaatttatcaactcttacctggagatcctcacaggcaagagaaagtattaccacgggcccggaaatgaaaaatcccggaccgattacggcaagtatacaaccaaaaaggacgcccaaggccagtacattacgctgaacaacatcttcgggattcttatcggaaaatgcacattttatcctgaggagtacagagcggccaaggctagctataccgcccaggagttcaatctgctcaacgatctgaataaccttacagtgcccaccgagaccaaaaagctgtctgaagaacaaaagtaccagattatcacatatgtcaaaaatgaaaaggctatgggccctgccaaactctttaagtacatcgcgaaactgctggcctgtgacattgctgacatcaaggggtaccgcattgataagtccgacaaagccgagatccacacgttcgaggcttatcggaagatgaaaaccctcgaaacaattgatatcgagcagatcgaaagagagaagctggacaaacttgcctacgtgctgaccctcaacacagaacgcgagggcattcaggaggccctggatcatgaatttgctgacggaaccttcagccaagaacaggtggatgaacttgtccagttccggaaggccaattcttccatctttgggaagggatggcacagcttctccgttaaactgatgatggagctcattccggagctgtatgcgacgtctgaggagcagatgacaatcctgaccagactcggcaagcaaaagaccacaagctccagcaacaagaccaaatacattgacgaaaagcagctgacagaggaaatctataatcccgtggtggctaagtctgtccgccaggccattaaaatcgtgaacgccgctatcaagaaatacggcgattttgacaatattgttatcgagatggcccgggagacgaacgaagatgacgagaagaaagcgattcagaagatccaaaaagctaataaggccgaaaaggacgccgctatgagaaaagccgctaaccagtataatgggaaggccgagcttcctcattccgtgttccacggacacaaacagctggcgaccaagattcgcctctggcatcagcaaggcgaacggtgcctgtacacagggaaaaccatcagcatccacgatctgattaacaaccccaatcagtttgagatcgaccatattcttcctctctctatcacattcgatgacagcctggccaacaaggtcctggtgtacgctaccgccaatcaggagaagggacaaagaacgccctatcaggctctcgattccatggacgatgcctggtcttttcgcgaactgaaagcgttcgttcgggagagcaaggccctttccaacaaaaagaaagaatacctgctcaccgaggaagacattagcaagtttgatgtgagaaagaaattcatcgagcggaatctggtcgacacacgctatgcttctagagtggtcctgaacgcccttcaggagcactttaaggctcataaaatcgataccaaggtgtccgttgtgcggggccagttcacaagccaactcagacgccactgggggattgacaaaacccgggatacgtaccaccatcacgccgtcgacgccctgatcattgctgcgtcttcccagctgaatctctggaagaagcagaaaaacacactggtgagctattccgaagaccagcttctggatatcgagaccggcgaactcatttctgacgatgagtacaaggagagcgtttttaaagccccgtatcaacatttcgtggacacactgaagtccaaagagttcgaagattctatcctgtttagctaccaggtcgactccaagttcaatagaaaaatcagcgatgctaccatttacgccacccgccaggccaaggtgggaaaggacaaaaaggatgaaacatatgtgcttggcaaaatcaaggacatttacgctctcgggacgaaaaccccttctaagacaggattttataagttcctggatctgtacaacaaagacaagtcccagtttctcgtttatcaaaaagatagaaagacctgggacgaggtcatcgagaaaattatggaacagtaccggcccttcaaggagagcgacaagaatggcaaagaagtggattttaaccctttcgagaagtatcgcatcgaaaatgggcccattagaaaatactctcggaagggaaacggccccgagatcaaatccctgaagtactatgccagcaaacttgggaatcacatcgacattacacctaaagattctaacaacaaggtggtcctgcagagcgtgtccccgtggcgcgcggacgtttactttaataaaaccacgggcagctatgaaatcctcggactgaagtacgctgatctgcaattcgagaaaggcacagggacctatagaatttctgaggaaaagtacaacgacatcaagaaaaaggagggagtggattccgacagcgaatttaaattcaccctttataagaatgatctcctgctgattaaagacacagagaccaaggaacagcggctctttcgcttcctgtccagatctatgcccaacaaaaagcactacgtcgagcttaagccttacagcaaagataagttcgagaaaaatgaatccctgatcgagatcctcggctctgccgacaagagcgggcggtgtattaaaggactggccaagtccaacctgtctatctttaaggtgcgcacagacgttcttggcaatcagcatattatcaaaaacgaaggggataagcccaaactggacttctga

SEQ ID NO: 3997 - RNA, 3408 nt, synthetic construct
  misc_feature 1..3408: note = Cas9 variant
  source 1..3408: mol_type = other RNA
atgggcgtgatcttcctgtacgagaacattgtcaagccctttcctagcagatatgacaaagccatcatgaagcggctcaaagggcgccagaccatgggatacattctgtcccttgatatcggcattgcttcttgcgggtatagcgttctggaaacagacgccctcggagtgccgtacaagatcaaaacgcttaattccatcattttcaccagagcggagaaccccaagacaggcgcttctctggccgaacctcggcgcaagtatagaggggcccggcgcagaaaacggcgcaccagctttagaaagcaccggacacgccaactgttcatcacctccggactcctgtctaaacaggatattgctagatacctgaatcagcaggagccccatgacgatatctgggaactccgggtgaagggcctggacgagcctcttacaaacctgcaactctttcaggtcctgtattacttcgtgacccaccgcggctttaaaagcaatagaaaggccgagcttaaggataaagacattgggcccgttctgaactccatcaatgctttcaaggaagagatgcagagccatgattaccggacgattggagaactctatgccaacgaccctagatttcgcgatcggaaacacaataaggactacaccaacggcttcctggggacaatccagagatcttggctggtggatgagatcaaaatgctcctgaccaatcaacagtcctttggaaacacacagcttaccagcgagttcattgaactgtatctcaatatctttacgtctcagcgcaacttcgacgacggcccggcgtccgggccctacagcggagatctgattgacaagatggtcggccctgatacattcaatcggtctagaaaacgcgcccccagagctacctatacatttcaatacttctcctttcttagcaagctgaactccctcagaatcgccccttctattagcgctcccttcgagaccctgaccgtggaccagcgcgccctgatcacaaagcggctctggggcccggatgttaaatccgcggacctgaagtttaaacagatcagaatggtgcttagcctgcctgaaacggcccgcttcaacctcgtcaattatgggaacacccccgagaaggctctggaaattgaggataaaacaacctttatctctattaagcctcttcgggagatcgaaaaggccctgacaggaaccacgctccccgtgtcccatgaccaactggatgctattgccagaatcctgacagtgtacaaaagcgactctaatcggaagaccgccttccacaaccagaccgtcctcagcgatgaggttatcgaacagctgcttcccctgaatttttccaaattcggccacctctctgtggagacaatgcaggaaattatcccttacctggagcaagggatggtgtatagcgacgctgcgaccgccgctggatacgactttcgcaacaatcagattgatatggagtatatcagagacaacgtcacaaatccggtggttcggagagccgtgtccgtcgccaacaagctggtgaaagctgttgtgcgccggtacggcaagcccgatagcattcatatcgaacttgccagagacctctctcagaatttccaggagcgcagacaagatgaagtccggcagcagaagaacgcgcgcgacaatgagaaaattgctaagagactggaagaactggggatccctgtgaacggagtcaatatcacgaaaatgaagctctatgatgagcagcacggcattgacctgtacgatctttccaccaacgccagcatggccgtgacagacatcttttctgatgaccggtatgaaattgatcatatcattccctactccgttagcttcgacgactcctacaccaacaaagtgctggtctctgctaaggccaatcgcgagaagagagatcggatccctatggaagtgttcggcaacgacagcgagcgcagacggcaatttgagaatcgcgttaacacaaatatcaccaacctccggaaaaagcggaatctgctgaaagaaacgttctccgatgaggacaaggctaaatggaagtctagaaacattaatgatacccgctatcttaaccggatcctcatgaattacctgagccagaacgtggaatttacagacgtcctgtccgatgccaaacacgtgattgcgctcaatggggccgtgaccgctaagatcagaagccgctggggaattacaaaggttcgggccgctggcgacctgcaccatgccgtcgatgcggtggtgatcgggtgtgtcaccgacgcccttatccaggctgtgacgagatatgccaaataccaggagcgccgggataacaaggctgccgccgaacaagacctggctgagaataaccccgaggaactcgatgcgaaacagttcagaaaggtttttaacgactatccgctgccttggcccgagttccgcgaggagctgatgggacgggtgtcttccgaccctagccagattatggccggcagacaatggtctcactacacagctgaagagatctccgagcttaaacagccctttgtcgtgcgggttcctaatcatcgcattgtggggcccgccaccctcgatacagtctatggccagccgaaccctgacgatggactgatcacccagagagtgcggattaccgacctgaagccccaaaagaataaagatggcgaagacatcatcaaggccggggctaacgtttacgagctcgccgcggatggaggcaataaactggtgtacgaaagcattcttgacgctctgcaggtcgccgggggagatggcaagaaagccttccccacagggcgcctcctggtgagatctcctatccaggacattccggtggagcgggtcagagttacgagcaaggctaccctggtggtgcccgtcggccctaagtccgtggccgcgaacggaagcatggttcgcatcgatgtgtataaaacacccaagaaatacgtctttgtgcctatttatgttcgggacaccgtgaaggctgaacttcccgacagagccgtcgcccctgtgaaaccctactctcagtggtatcaactccagccgaaggatcagttcctgttttccctgttcgctaatgacctcatccgctttaagcaccctcggggcgttagcacaaaagagattctgaccgatgggtcccaggagaagggaaaaagaacggacgtggtcggctacttcacaggggccgatatcgctaccgcctctatcgcgattgaaggacccgaccgcagcttctccgcccggggcatcgggtttgcttctcttaagaacgtggagaaactgaccgtgaattatttcggcgaactccatagcgtccacgagacacaacctatgcagtttagaggacagcgcggctga

SEQ ID NO: 3998 - RNA, 3411 nt, synthetic construct
  misc_feature 1..3411: note = Cas9 variant
  source 1..3411: mol_type = other RNA
atgaacggcctggtgctcgggctggacatcggaattgccagcgtcggcgttgggatccttgagaaggataccggaaaaattatccacgcttcctctagactgttccccgccgcgacagctgacaataacgtggaacggcgcagcaatagacagggccggcgcctcaacagacggaagaaacatcgctccgtgagactgcaagatctttttgagtcttacgggctgctcacggacttcagcaagctgtccattaatctgaacccttatcagctccgggtccagggaatggaaaatcagctgaccaacgaggaactttttatcgccctgaaaaatatcgtgaagcgcagaggcatttcttacctcgatgacgccagcgaggatggcgggacagtttccagcgactatggaaaggctgtggaggaaaaccggcgcctgcttaccgagaaaacaccgggccaaatccagctggaaagattcgagaagtacgggcagctccggggagattttaccgtcgaggaaaatggcgagaaacgcagactgattaacgtgttctctacatccgcctatcggaaggaagctgagagaatcctgcgcaaacagcaagaatttaataacaagattaccgacgagttcatcgaggattacctcacgattctgaccgggaagcggaaatattaccacggacccggcaatgaaaagagcagaacagactacggccgctttcggaccgatgggacaacccttgacaacatcttcggaatcctgattggcaaatgcacgttttatcctgaggaatacagagcctctaaggcgtcctatacagcccaggagttcaacctcctgaatgaccttaacaatctgaccgttcccacagaaaccaaaaagctcagcgaggagcagaaaaagaccatcattgaatacgctaagtctgccaaaacactgggggcttccacgctgctcaagtatatcgccaaaatgattgatgcgagcgtggaccagatccgcggataccgggtcgatgtgaacaataagcctgagatgcatacctttgaagtgtatagaaaaatgcaatccctggagacaatcaaggtcgaagaacttccccgcaaggttctggacgagctcgcccacattctgacccttaacacagaacgggagggcatcgaagaggctattaattctaaactgaaggataccttcaacagagaccaggtgctcgagctggtgcagttccgcaaaaataacagctccctgtttagcaaggggtggcataatttctctctcaaactgatgatggaacttatccctgagctgtacgaaacgtccgaggaacaaatgacaattctcacccggctgggaaagcagagaagcaaggagacctctaaacggacaaagtacatcgatgagaaagaactgaccgaggaaatctataacccggtcgtggccaagagcgttcgccaggctattaaaatcattaatgaggccacaaagaagtacggcatctttgacaacattgtgatcgaaatggccagagagaataacgaggaagatgctaaaaagaactatattaaacagcaaaaggcgaatcaggacgagaaaaacgccgctatggaaaaggccgccttccagtacaatggcaaaaaggagcttcccgataacatctttcacgggcacatggaactcgctacgaagatccggctgtggcatcagcaaggagagaaatgtctgtataccggcaagaatattcagatctccgacctcattcacaaccagtacaaatatgagatcgaccatattctgcctctttctctgagcttcgatgactccctcagcaataaggtcctggtgctggccacagcgaaccaggaaaaagggcaaagaaccccctttcaggctcttgattctatggacgatgcctggtcctaccgcgagttcaagagctacgttaaggaatctaaactcctgggaaataagaaaaaggactatctgctcacagaggaggatatctccaaaatcgaagtgaagcagaagtttattgagaaaaacctggtcgacacccggtacagctccagagtggtccttaatgccctgcaggatttctataagaaacaccaatttgacacgaccatctctgtggttcgcggccagttcacaagccagctcagacggaagtggaaactggaaaagtcccgcgatacctaccaccatcacgctgtggacgccctgattatcgctgcctctagccaacttagactctggaagaaacataacaatcctctgatttcctataaggatgggcagtttgtcgacagcgagacaggcgaaatcgtgtctctgtccaacgaggagtacaaagaactcgttttcaaggcgccctatgaccacttcgtggataccctgcggagcaaaaagtttgaggactctatccttttctcctaccaggtcgatagcaaatacaatcgcaagatttctgacgccacgatctatgctacaagaaaggccaaactggataaggacaaaaaggaatacacctatacactcggaaaaattaaggatatctacgctctgggcaccaagaccccgagcaaaacagggttttataagttcctggacctttacaaaacggataagtcccagtttctcatgtatcaaaaagaccggaagacctgggatgaggtgattgaaaagatcatcgagcagtaccgccctttcaaagagtacgacaagaacggaaaagaagtggattttaaccccttcgagaagtatagaattgaaaatggccctatccggaaatacagccgcaaggggaacggatctgttattaagtccatgaaatattacgacaatctgctgggcaagtttgtcgacatcacacccagcgagtccaaaaaccccgtggccctcctgtctcttaatccttggagaaccgatgtgtattacaacccggaaacacggaagtatgagttcctggggctcaaatacgcggacctgtgctttggcaagggaggcagctacgggatttccgaggtcaagtataataaaatcagagaaaaggagggaattggcaaagaatctgagttcaagtttaccctgtacaaaaacgatcttatcctgatcaaggacacggagacaaattgtcagcagttcttccgcttttggagccggaccgggaaagataaccccaagtccttcgaaaagcataaaattgagctcaagccttatgaaaaagccaagtttgagaaaggagaggagctggaggtgctcggcaaggttcccccttctagcaatcaattccagaagaacatgcagatcgaaaatctgtccatttacaaagtgaagaccgacgtccttgggaacaaacactttatcaagaaagagggcgatgaacccaagctgaagttcaaaaagtga

SEQ ID NO: 3999 - RNA, 3411 nt, synthetic construct
  misc_feature 1..3411: note = Cas9 variant
  source 1..3411: mol_type = other RNA
atgaacggcctggtgctcgggctggacatcggaattgccagcgtcggcgttgggatccttaagaaagataccggagagattatccacacaaattccagactgttctctgctgccacggcggacagcaacattgaacggcgcagacatcggggcgggaagcgcctcaccagacggaaaaagcaccgctccatcagactgcatgatctttttgaggactctggactgctcacagatttcagcaaagtgtccatcaatctgaacccctaccagctgcgggtgcaaggcctcgacaatcagctgaccaacgaagaactttttattgctctgaagaatatcgtcaagcgcagaggcatttcttatctcgatgacgccagcgaagatgggggaacagtgtccagcgactacggcaaagccgttgaggagaaccggaagctgcttgctgaacagacccctgggcagatccaactggatcgcttcgagaaatatggacaggtgagaggcgactttacagtcgtggaaaatggggagaagcggcgcctcattaacgttttcaccacgtctgcctactccaaagaggctgaaagaatcctgcggaagcagcaggagtttaataagaaaattaccgatgagttcatcgagaactatctgacaatcctcaccggaaagagaaaatactatcacggcccgggcaatgaaaagagccgcacagactacgggcggtacaccacgaaaaaggaccccgagggaaaatatattacactggataacatctttggcattcttatcgggaagtgcaccttctaccctgacgagtatagagcctctaaggcgtcctacacagcccaagaatttaatctgctcaacgatctgaacaatcttaccgtgcccaccgagacgaaaaagctgagcgaggaacagaaaaagacaattatcaaatatgctaagaccgccaagacactcggagcttctaccctgctgaaatacatcgccaagctcattggcgcgtccgtcgaccagatccatgggtatcgcattgatcctaacaaaaagcccgaaatgcacacattcgagacctaccggaaaatgcagagcctggagacgatctccgtggaagagattcctagaaaggtgcttgacgaactggcccacatcctcacactgaataccgagcgcgaaggaatcgaggaggctattaacgccacccttaaggatacattttctcaagaccaggtcctggaactcgttcagttccggaaaaataacagctccctgttcagcaagggctggcataatttttctctgaaactcatgatggagctgatcccggaactttacgagacctccgaggaacaaatgacaattctgacgagactcggcaagcagaaaagcaaggagacctctaagcgcacaaaatatatcgatgaaaaggagctgaccgaagagatttacaaccccgtggtggctaaaagcgtccggcaggccatcaagattatcaatgaggccaccaaaaagtatgggatcttcgacaacattgtgatcgaaatggctagagagaataacgaagaggatgcgaaaaagggatacaatgaacgccagaaggccaacctggacgagaaaaagtccgctatggagaaagccgcctttcaatataatggcaagaaagaacttcctgacaacgttttccacgggcataaggagctcgctacaaagattcggctgtggcaccagcagggagaaaaatgtctgtacacgggcaagaacatccccatttctgatctcatccagaatcaatataaatacgagatcgaccacattctgcctcttagcctgtcctttgatgacagcctctctaacaaggtgctggtcctggccaccgcgaatcaggaaaaagggcagagaacacccttccaggctcttgattccatggacgatgcctggagctaccgggagtttaagtcttatgtgaaggacctcaaactgctgtccaacaagaaaaaggattacctcctgaccgaggaagacatcagcaaaattgaggttaagcaaaagttcatcgaacgcaatcttgtggatacaagatattcctctcgggtcgtgctgaacgccctccaggacttttacaaagagcatcagttcgataccacgattagcgtcgtgagaggccagtttacatcccaactgcgccggaagtggggactggagaaatctagagaaacctatcaccatcacgctgttgacgcccttatcatcgctgccagctcccagctccgcctgtggaagaaacagaataacccgctgattagctacaaggagggccaattcgtggaccaggaaacaggggagatcatttctctctccgatgacgaatataaagagctggtctttaaggcgccttacgatcatttcgtggacacccttaagagcaaaaagttcgaggattctatcctgttttcctaccaggttgacagcaaatataatagaaagatttctgatgccaccatctacgctacacggaaagccaagctcgacaaggagaaaaaggaatatacgtacaccctgggaaaaatcaaggatatttatgctctgggcagcgaaaaacttaagacagggttctacaagtttctccacctgtataaaaaggacaaatcccagttcctgatgtaccaaaaggatcgcaaaacctgggacgaggtgatcgaaaagattctcgagcagtacagaccctttaaggagaaagataagaacggaaaagaagtcgacttcaatccttttgagaagtatcggatcgaaaacggccccattcacaaatacagccgcaaggggaatggccccgtgatcaagtctctgaaatattacgacaagaacattcctgagtccttcatcaatatcacaccgagcaactccaaaaacaaggtgattcttagacagctgaatccctggcggaccgatgtttattttaaccatcagacggaaaaatacgagctcctgggactgaagtatgcccaccttcaattcgagaaaaagacaggcaattactctatcaccattgacaagtacaacgaaatcaaagagaaggaaggggtcagcgagcagtccgagtttaaattcaccctgcataagaatgatctcctgctcattaaagacacagaaaccaaggagcagcagctgtttcgcttcctttctagaacaaagcctaacgtgaaacactatgtggaactgaagccctacagccgggatgagttcgagaaaaatgaacgcctcatcgagatcctgggatccgtcgacaagtctggcagatttgtgaaagggctgggaaagagcaacctttccatttataaggttcggacggatgtgctgggcaatcaacacatcattaaaaaggaaggggaggaacctaaactcaagttctga

SEQ ID NO: 4000 - RNA, 3411 nt, synthetic construct
  misc_feature 1..3411: note = Cas9 variant
  source 1..3411: mol_type = other RNA
atgaacggcctggtgctcgggctggacatcggaattgccagcgtcggcgttgggatccttgagaaggataccggaaaaattatccacgcttcctctagactgttccccgccgcgacagctgacaataacgtggaacggcgcagcaatagacagggccggcgcctcaacagacggaagaaacatcgctccgtgagactgcaagatctttttgaggggtacggactgctcacggacttctctaaggtcagcatgaatctgaacccttatcagctgcgggtgcagggcatggaaaatcagctcaccaacgaggaactgtttgttgcccttaaaaatattgtgaagcgcagaggcatctcctacctggatgacgcctctgaggatgggggaacagtcagctccgactatggcaaggctgtggaggaaaaccggaaactcctggccgagaagaccccggggcaaatccagcttgaacgcttcgagaaatacggacagctgagaggcgattttacagttgaggaaaatggggagaagcaccggctcattaacgtgttcagcacctctgcttatcgcaaagaagccgagagaatcctgcggaagcagcaagaatttaattccaagattacagacgagttcatcgaggattacctgattatcctcaccggaaaaagaaagtattaccatggccccggcaacgaaaagagccgcacggactacgggcggtttagaaccgatggaacaaccctggacaatattttcggcatccttatcgggaagtgcacattttataccgaggaataccgcgcgtctaaagcctcctatacggctcaggagttcaacctgctcaacgacctgaataaccttacagtccctaccgaaacaaagaaactgagcgaggagcagaagaagctcattatcgaatacgccaaatctgctaagaccctgggagcctccaccctgctcaaatatattgcgaagatgatcgatgccagcgtggaccagattcggggctacagagtggatgtcaataacaaacccgagatgcacacatttgaagtttatcgcaagatgcaatccctggagacgatcaaggtggaggagcttcctcggaaagtgctggacgagctcgctcatatcctgacccttaatacagaaagagaggggattgaagaggccatcaactctaagctgaaagatattttcaatcgcgaccaggtcctcgagctggtgcagttccggaagaacaatagctccctgtttagcaaaggatggcacaacttctctatcaagctcatgatggaactgattcccgagctttacgaaacctccgaggaacaaatgacaatcctgaccagactcggcaagcagcgcagcaaagagacgtctaagcggacaaaatacatcgatgagaaggaactgaccgaggaaatttataatcctgttgtggctaaaagcgtcagacaggccatcaagattatcaacgaggccaccaagaaatacggcatttttgacaatatcgtgattgaaatggctcgggagaacaatgaggaagatgcgaagaaagactatatcaagcgccagaaagccaaccaagatgagaagaacgctgccatggaaaaagccgctttccagtacaatgggaagaaggagctgccggacaacatctttcacggacataaagaacttacaaccaagattagactctggcaccagcagggcgagaaatgtctgtatacagggaagaatatccccatttccgacctgatccataaccaatacaaatatgagattgatcacatcctccctctgtctcttagcttcgacgattccctgagcaataaggttctcgtgctggccacggcgaaccaggaaaagggacagcggaccccctttcaggctctggactctatggatgacgcctggtcctacagagagttcaaaagctacgtcaaggattctaaacttctctccaataagaaaaaggactatctgctgacagaagaggatatcagcaagattgaggtgaaacaaaagtttatcgaacgcaacctcgtcgacacccggtactcctctagagtggttctgaatgcccttcaggatttctataaaagccaccagctggacacaaccatttccgtggtccgcggccagtttacgtctcaactcagacggaagtgggggatcgagaaaagccgcgaaacctaccatcaccatgctgtggatgccctgattatcgctgcctccagccagctgagactttggaagaagcactctaaccctctcatcgcgtataaagagggccagttcgttgactccgaaacaggagagattgtgagcctgtctgacgaggaatacaaggagctggtctttaaagccccctatgatcatttcgtggacaccctccggtccaagaaattcgaagatagcatcctgttttcttaccaagtggacagcaagtacaatcgcaaaatttccgatgctacaatctatgccaccagaaaggctaaacttgacaaagagaagaaagaatacacgtatacactgggcaagattaaagatatctacgccctcgggaccaagacaccgagcaagaccggattctataaatttctggacctgtacaagaccgataaatctcagttccttatgtatcagaaggaccggaaaacatgggatgaggttatcgagaagattatcgaacagtaccgcccttttaaggagtacgacaaaaacggcaaggaagtcgatttcaatccctttgagaaatatagaattgggaacggacctatccggaagtactccaaaaagggcaatgggcccgaaattaagagcctcaaatattacgacatcctgctgggcaagcacaaaaacattacgcccgacggatcccgcaacaccgtggcgctcctgtctcttaatccttggagaacagatgtgtattacaacagcgagaccaagaaatatgagttcctgggcctcaagtacgccgacctgtgctttgaagaagggggagcttacggcatctccgaagtcaagtataaaaagatccgggagaaagaggggattggaaagaactctgagttcaaatttacactgtacaagaatgatcttatcctgattaaagacaccgaaacgaattgtcaacagttctttagattctggagccgcacaggcaaggataacccgaagtccttcgaaaaacacaagatcgagctcaaaccctatgaaaaggccaaatttgagaagggggaggaactgaaggtgctcggcaaagttcctccctctagcaatcagttccagaagaacatgcaaattgagaatctgtccatctacaaagtgaagaccgacatccttggaaacaaacattttattaagaaggaaggcgatgagcctaaactgaagttcaaaaagtga

SEQ ID NO: 4001 - RNA, 3420 nt, synthetic construct
  misc_feature 1..3420: note = Cas9 variant
  source 1..3420: mol_type = other RNA
atgagcgacctggtgctcggcctggatatcgggattggatccgtcggcgttgggatccttaacaaggtgaccggagagattatccacaaaaattctagaattttccccgccgctcaggccgaaaacaatctggagcggcgcacaaacagacaaggccggcgcctcacgagacggaagaaacatcgcagagtgcggctgaatcacctttttgaagagagcgggctgatcaccgacttcacaaaggtctccatcaacctcaatccttaccagctgcgcgtgaaaggactgaccgcggaactctctaacgaggagctgtttattgctcttaagaatatggttaagcatagaggcatcagctatctggatgacgcctccgatgacggcaactctagcgtgggggattacgcccagattgtcaaagaaaattccaagcagctcgagacaaaaaccccgggacaaatccagctggaacggtatcagaagtacggccagcttcgcggggacttcacagtggaggaggatggaagaaaacaccggctgattaacgtttttcccaccagcgcttatcatgccgaagctctccgcatcctgcaaacgcagcaggagttcaatcctcagattaccgacgaatttatcaactcttacctggagatcctcacaggcaagagaaagtattaccacgggcccggaaatgaaaaatcccggaccgattacggcaagtatacaaccaaaaaggacgcccaaggccagtacattacgctgaacaacatcttcgggattcttatcggaaaatgcacattttatcctgaggagtacagagcggccaaggctagctataccgcccaggaatttaatctgctcaacgatctgaataaccttacagtgcccaccgagaccaaaaagctgtctgaggaacaaaagtaccagattatcacatatgtcaaaaatgaaaaggctatgggccctgccaaactctttaagtacatcgcgaaactgctgtcctgtgacgtggccgacattaaggggtaccgcatcgataagagcgacaaagctgagattcacacgttcgaggcctatcggaagatgaaaaccctcgaaacactggatgtgaagaaaatggctagagaggaacttgacaagctggcctacgtcctcaccctgaacacagagcgcgaaggaatccaggaggcccttgatcatgagtttgctgacggcaccttctctcaggaacaagttgatgagctggtgcagttccggaaggctaattccagcatttttgggaaaggatggcactccttctctgtgaagctcatgatggaactgatcccggagctgtatgccacgagcgaggaacagatgacaatcctcaccagactgggcaaacagaagaccacatccagctctaacaaaaccaagtacattgacgagaagcaacttacagaagagatctataatcccgtcgtggctaaatccgttcgccaggccattaagatcgtgaacgccgctattaaaaagtacggcgattttgacaatatcgtcattgaaatggcccgggagacgaacgaggatgacgagaaaaaggcgatccagaaaatccagaaggctaataaggccgaaaaagacgccgctatgagaaaggccgctaaccaatataatgggaaagccgaactgcctcatagcgtgttccacggacacaagcagctcgcgaccaaaattcgcctgtggcatcagcagggcgagcggtgcctgtacacagggaagaccatctctattcacgatcttatcaacaaccccaatcaatttgaaattgaccatatcctccctctgagcatcacattcgatgactccctggccaacaaggttctcgtgtacgctaccgccaatcaggagaaaggacagagaacgccctatcaagctctggattctatggacgatgcctggagctttcgcgagcttaaggcgttcgtccgggaatccaaagccctgagcaacaagaaaaaggagtacctcctgaccgaagaggacatttctaagtttgatgtgcggaaaaagttcatcgaaagaaatctggtcgacacacgctatgcttccagagtggttcttaacgccctccaggagcactttcggacccataaaattgatacaaaggtgagcgtcgtgagaggccagttcacctctcagctgcgccggcactgggggatcgagaaaacgagagacacataccaccatcacgctgttgatgccctgattatcgccgcttccagccaactcaatctgtggaagaagcagaaaaacacccttgtgtcctattctgaagaccagctgctcgacatcgagacaggcgaactgattagcgatgacgagtacaaggagtccgtctttaaagcgccgtatcagcatttcgtggataccctgaagtctaaagagttcgaagacagcatccttttctcctaccaagtggatagcaagttcaatcgcaaaatttctgacgccaccatctacgctacaagaaaggccaagctcgataaagaaaagaaagagtatacgtacaccctgggaaagattaaagacatctatgccctgggcacaaagaccccttccaagacagggttttacaaattcctcgatctgtataagaaagacaagagccagtttcttatgtaccagaaagatcggcgcacctgggacgaagttatcgagaagattctggagcagtatagacccttcaaggaaaaagataagaacggaaaagaggtcgactttaatcctttcgaaaagtaccggatcgagaacggccccattcgcaaatactctagaaaggggaatggacccgaaatcaagtccctcaaatattacgacaacctgctgggccggtttgtggatattacgcctagcgagtctaagaatccggtggcgcttctcagcctgaacccctggcgcacagacgtctattacaacaccgagaccagaaaatatgagttcctggggctcaagtacgccgatctgtgttttgaaaaaggcggatcctatggcatcagcaaggtgaagtacaataaaattcgggaaaaggaggggatcggcaaaaactctgagttcaagtttacactttacaaaaatgacctgatcctcattaaggataccgaaacaaaccgccaacagatcttcagattctggtcccggacgggaaaagacaatcctaagagctttgagaagcacaaactggaactgaagccctatgagaaaaccagattcgaaaagggggaggagcttaaagttctgggaaaggtgcctccctcctctaaccgcctccagaagaatatgcaaattgaaaacctgagcatctacaaagtccggacagatgtgctcggcaatcagcacattatcaagaacgagggggacaaaccgaagctggatttttga

SEQ ID NO: 4002 - RNA, 3420 nt, synthetic construct
  misc_feature 1..3420: note = Cas9 variant
  source 1..3420: mol_type = other RNA
atgaactactataatggcttcatcattaccgagaacgccatggctagcaagcacgaaaatctgggggccctcacatttggactggacatcggcattgcgtccgtggggtgggctgtccttggagagaacagaatcattgatctgggcgttcggtgcttcgacaaagccgaaacggccaaggagggggaatctctcaatctggctcgcagaaccgcccggcttctgcgcagacggctccgcagacgggcttggcgcctgacaaaactggccagactcctgaagcgggagggacttatcgcggataccaacgtgtttcagaaacccttcaatctgaaggacgccaacgagaagggcctcagcttttggcagctgcgcgtggatgctcttgacagaaaactgtccgccgaagagtgggctcgggtcatctaccatctctgtaagcaccgcggcttccattggatttctagagccgaagagaaagcggccgagggggatagcaagtccgaaggaggcaaagtgaagcaggggctggctggaacaaagaaactgatgcaggagaagaattatcggaccgccgctgaaatggttctcacagagtttcctgaagcccagagaaacaaacaaggcgactactctaaggccctgagccgcatccttctgggggatgagatgacccagcttttcaaacaccagcgggagctgggaaatccgcatgctacggaaaagctcgaggcggccattctgggcaacggcgaccacaaatccgggctcttttgggctcagaatcccgccctggccggaaacgatctgctcaagatgctgggccactgcaccttcgaaaaggctgagtatagagtgcctaaagccagctttacagcggaacgccatgtctggcttacccggctgaataacctcagaatcgtggttgacgggacaacccgccccctgaacgaggctgagcggcaccttgccctgctcatgccttaccaacaggccggagatctgacgtataagcagctgagaacagctctcaccaaagccggctacctgcccgaatctttccgctacacagggcttgcttatgcctccggacagaaggcggacgagaaagccaaggaccctgaaagcgctccgctggtgaagctccccgcctggcatgagctgcggaaaaccctggaaaagaaagagcttgcttctgagtggcaaaagatttccagcgatgccctcgacggcaaacctcagctgctggatcagatcgcgtgggtcctctctgtgtacaaggacgataccgaagtggaggccgaactgtgtaaacttaatctgcccaacgctgagaagatgattgacgccctcctggatatcagatttgacaagttctccaatctgagccttaaagctctccgccaaatcgtccctctgatggagcagggccagcggtatgatgaagccgttgccaacattcccgagtacgggcaccactcccagctgcatgaagtgggagctggcgagcacaagtatctcccgcctttctacaaagaaagagacaagacagggcggatggtgtttaatgatgacatggacatcccccgcaaccctgtcgtgctgagagcgcttaatcaagcccggaaggttgtgaacgctctgattaaagagtatggatctccccatgaggtccacatcgaaatggccagagatctcagccgccccctggacgagcggagagatgtggaaaagctgcagaaagagttccgcgacagaaatgaaaaggataaagccctttttgctcaggacttcaacattgttggcgccgtgaaggggaaagagtttgagaagtaccagctctaccgggaacaacagggcaagtgcgcgtattccatcgagcctatggatatccatcgcctgttcgaacagggatacgtcgagattgaccacgctctgccgtatagcagatcttttgatgactccaaaaataaccgggtgctcgtcctggccaaggaaaatcgcgataaaggcaacagaacgcccttcgagtaccttgggggaaaggacaatagcgagcggtggcgccagtttgtggccttcgttgaaggcaacaaatcttatagactggctaagcggagccgcctcctgagaaaggattttgggaaagacgaggccaagggattccgggaaagaaacctgaatgacacccgctacatctgtcggtttttcaaaaactatgtggagcaataccttcagctccacgaggattccgacgcgaagagatgcgtcgtgctgtctggccagatgaccagcttcctgcgcgctcggtgggggctcgttaaagtgagaggcgattccgaccgccatcacgccctggatggagccattgtcgctgcctgtagccattctatggtgaagcggctttccgactacagcagacgcaaggaactggaacaggtgcgggctggctttgttgatgtcgacacaggggagatcgtgaatcctgccatgttccaacaggtgcaggagcactttcccaacccttggccccacttcagagatgaagtcaaactccggctgaatgtggacgatccggcgctgcttcattctgagatgaaccgctttggaacatattcccctgaggccctgaaggctctcagacccctgttcattagccgggcccctcaacgcagaaattccggcgctgcccacaaagacaccatctacgcccagcccgaacggctcgttgctcagggaggagtgacgcagaaggtccctctgacatctcttaccctgaaagatctcgacaagctgatcgacccccatagaaacgagaagctgtatagcgcgattcgcatccggcttgaacaacacggcgggaaaggcgataaggcctttccggcttccaatcctctgagaaaacccgactctgagggaaaccccaccggccctattgtgcgcggggttacaatggtgatcgataagctcagcgggattccgatccggggcgggattgccaaaaatgactccatggtcagagtggatgttttcaccaaggccggaaaatttcatctggtgcccgtctacgtgcaccacgctgtggccaaggtcctccctaaccgcgcggttgtggcttataaggacgaaacagagtggacgctgatcgatgacggcttcgatttttgcttcagcatgtaccccaatgaccttctgcggatcaaactcagaaacgcctctcatctggggtattacgcctcctgtaatcgcagcaccggcgctattaacctgtggtctcacgatagaaaccaacaggtgggaaaggacggcatgatcgagtccattggggtcaaaacagcccttaatgtggaaaagctgaacatcgacgttctcggaaatcggtaccctgcgccccctgagaaacgcagagatctggcttga

SEQ ID NO: 4003 - RNA, 3423 nt, synthetic construct
  misc_feature 1..3423: note = Cas9 variant
  source 1..3423: mol_type = other RNA
atgaagaacatgaccaaagtgaatgtcggcctggacgttgggatcagctccgccggatggtctgtgattaacgctgagacaaatcagatcctcgaaagcggcgtgagactgttctccgggtctgatgccgacgagaacgtcaatcggcgcaaccaaagacagggacggcgcctttttagacggcgcaagctgcggattcaggaagcgaaaaagtacctcgagaatgtgttccagctgaaagatatcgaacccaaggacgagtggaacccttatgagattcgggttcgcgctcttaatgaaaaggtgagcaaagaggaactgtccatcgccctcctgaacatcgtcaagcacagaggcatttcttacgagctggaggatgtgacggacgaagaggggaccaatacacagagctttcaatccggactcgattataaccggcgcctgcttaaaaccaagacagttggcgaaatccagtacgacagactgcagaaatatggccaagtgcgggggcagattcagaccgaggatggactcctgatcaatattttcccgacaaagaactacgtcgaagaggtggagcgcatccttgaaacccagaagaaatatcatcccgagattgacgatgtgtttatcgaaaagatcattagcttcgtcacgagaaaacgggagtactttgttggccctgggaatgaaaagtctagaaccgactacggaatctatcgcgagaacggcgagacactggataacctcttcgaaattctgatcgggaaagacaagttttaccccgaggaatatcgggccgctggatccagctacaccgcccaaattttcaatctgctcaacgacctgaataaccttagaatccctacaaccgaggatcaccatctgacgaaagctcagaaggaagagatcattacagagctcaagaatacctctcgcctgtccggcggcatgcttaaactgatcagcaaggtgacaaaagcccccaaggaagagatttctgggtatcggaaagacgaaaaggataagcctgacctccactccctggcgtactatagaaaacagaagaacatgctggagaaagagggaatccaaattgccgattttagcgaggaactcctggacgaacttgctaccatgatgaccctgaatacagagccgggcgaaatccgcaagcagctcaacaaaatcacgaatcagtacgatattctgacccccgaggtgatcgaggtccttgtgaagaaccatacagccttcgttgctacctccaatcacaagtggcaccggttttctctgaaactcatgaaggagttcattcctgaactgctggaaacaagcaaagagcagtccaccatcctctgcgaaagagggttcattcaaaaccgcgccagctacctggacgagaatcatcactttaactatgcggagcttcgggaaaatctgtacaaccccgtggtcagaaagtctacgtgtgagatgctcaaagtgttcacagccatccaggaaaagtatcctaacattcagaatgttatcgtggagctgccccgcgaaaccaacgaggatgagcagaagcggaaaatcaagaaaattaatgacaacaatgctaagagaaagaaggaaatcctgaaagaggcccaagctcagtccggacttagcgaagaggccctcgaggaaaagctgctgaagaccaaaggcctctacctgaaacttatgctgtggtatgagcaggaagggaaatgcgtctactctggacaggagattccgctcagcgatctgctgcaaaacaagggcggctatgaagtggaccatatcattcctatctccatctcttttgacgatcggctttgtaataaagtcctcgtgcgccagcagctgaacagccagaagtccaatcaaacacccttcgagtacatgaccacacacacggacgggcacctgagctttcatgagctcaaggaactggttggaaagaacaagagattctctaaagagaagcgggaacttctgctcgccgagatttactccaatgatatcgaaaccagaaaacgctttattaaccggaatctggtggacacaagctataccgctagaatcgtcctgaacgcgcttcagcagtacaagaaggagaatcaactctctatgaacgtgtccgttgtgcgcggcgccatgacaaacattctgcggaaaaaggtcaaactggataagaccagagagacgttccaccatcacgctatcgacgccagcctcatggccgtgatccctaatattgaatttttcaaagagcgcaaggaatggctgcccaagtccgctaacgaggaagtggttgaggtcgaggtgtctgaagaggaaaccatgcccgagaaagagtttaaggtgaaaatgagacttcctgagagcttcatccaggatgtccagattctgcagagaaattcctttgccaaggaagaagtgtctgggccgcaaacacgcgagagaaacctcaaaatcaagttcagccatcaggttgaccagaaaatgaatcggaaggtggcggatgacaccatttatggaacacgccaggctcaactgggcaaggataaaaaggaagagacctacgtcatcgggaaaatcaaggacatttataactacgatgagtatgtgagattcaaaaagcggtacgacaagaataaagaatcctttctgatgtaccaccacgacccccagacgttcgagaaacttgaagagatcctcgcccagtatcctgaatacattgaggatgagaaaggcaagaaaaagaaggttagcccctttgccctgtatcgcgaagagaacggacctgtgacaaaatacgctaagaaaaataacggccccgtcatcaagcagctgaaatattacgactctaagctcaatagaaagattgatatctcccataaatatagcaccaagaaccggcaagtggttctgcagtctcttaaaccgtacagaacagacgtgtaccgcaatcaggataccggggaatataccctggtcggaattgaccaaaacgatggcaagttcgtgaatgggcactacggaatccctaaatcccggtatgaggaaatcaaggccaacaacaagctcagcgagcatgacgagtttgtgttctctctgtacaaaaatagcatggtcaaggttattgatgaaaacggcgagtccatcgtggtgagatatctgagccgctctatgcccaatcggaaaaacaatgctgaaattaagcctgtcgagaaataccagtttgaggacggggaagtggttcccgtgtatggcaagtgcagaaaacagatgcagacagtcttcgtgaagaagggatggacgcttctgaaaggcaacaccgatatcctcgggaatacatactttgttgagaaggaatccgagaaccctaaaaagatgattgacgataaatga

SEQ ID NO: 4004 - RNA, 3423 nt, synthetic construct
  misc_feature 1..3423: note = Cas9 variant
  source 1..3423: mol_type = other RNA
atgagagagaacggcagcgacgaacggcgcagaaatatggatgagaagatggactaccggatcgggctggatattggaatcgcctccgtgggctgggctgtcctccagaacaattctgacgatgaacccgttcgcattgtggacctgggggtgagaatcttcgataccgccgagattcctaaaacaggagaaagccttgcgggcccgcggcgcgctgccagaacgacccggcgcagactgcggcgcagaaagcaccggctcgaccgcatcaaatggctgtttgagaaccaagggcttatcaatattgatgacttcctgaagagatataacatggccggactccccgatgtctaccagctgcggtatgaggctctggacagaaaactcacagatgaagaactggcccaggtgcttctgcatatcgctaagcaccgcggctttcggtccaccagaaaggccgaaacagcggccaaagagaatggcgctgttctcaaggccaccgacgagaaccagaaacgcatgcaagaaaaggggtaccggacagtgggagagatgatttatctggacgaggctttcagaaccggctgctcttggagcgagaaagggtacatccttacgcctcgcaataaggccgaaaactatcagcataccatgctgcgggcgatgctcgtcgaggaggtgaaggaaatcttttcctctcagagacgcctgggaaatgagaaagccacagaagaactggaagagaagtacctcgagattatgaccagccagcggtccttcgatctgggccccgggatgcaacctgacggaaaacccagcccttacgctatggaaggcttttctgatagagttggcaagtgtacattccttggggaccagggagagctgcgcggcgccaaagggacctatacggctgaatactttgtggccctccagaagattaaccacacaaaactggtcaatcaggatggagagacccggaacttcacagaagaggagagacgggcccttaccctgctcctgtttacccaaaaggaagtgaagtatgctgcggtgcgcaaaaagctgggcctcccggaggacatcctgttctacaatcttaactataaaaaggccgctacaaaagaagaacagcagaaggagaaccaaaatacggaaaaggccaaatttatcgggatgccctactatcatgattacaagaaatgcctggaggaaagagtcaagtacctcaccgagaacgaagttcgggacctgttcgatgagattggaatgatccttacatgttataaaaatgacgattccagaaccgagcgcctggccaagctcggcctggtgcctattgaaatggagggcctgctcgcttacacacccaccaagttccagcacctgagcatgaaagccatgcggaacatcattccttttcttgaaaaggggatgacgtatgacaaagcgtgcgaggaagctggatacgacttcaaggccgattctaaaggcacaaagcagaagctgctcaccggggagaatgtgaaccagaccatcaatgagatcacaaaccccgtcgtgaaaagatccgttagccaaaccgtgaaggtcattaatgccatcattcgcacatatggatctccgcaggctatcaacattgaactggccagagagatgtccaaaacgtttgaggagcggcgcaagatcaaaggcgacatggaaaagagacagaaaaataacgaggatgtgaagaagcagatccaagagctggggaaacttagccctaccggccaggacattctcaagtaccggctgtggcaggaacagcaaggaatctgtatgtattccggcaaaacaattcccctggaggaactcttcaagcctgggtacgatatcgaccacattctgccctactctatcacctttgatgacagcttccgcaataaagttcttgtgacatcccaggagaacagacagaagggaaatcggaccccctatgagtacatgggcaacgatgaacagcgctggaacgagtttgaaacgagagtcaagaccacaattcgggactataaaaagcaacagaaactgctcaagaaacatttcagcgaggaggagcgctctgagtttaaggaaagaaatctgaccgatacaaagtacatcaccacggtgatctataacatgattcggcagaatctggagatggctcctcttaacagaccggagaaaaagaaacaagtccgcgccgtgaatggggcgatcacagcctacctccggaagagatggggactgccccagaaaaaccgcgaaaccgacacacaccatgctatggatgccgttgtgattgcttgctgtaccgacggcatgatccagaagatttcccggtataccaaggtcagagaacgctgctacagcaaagggacagagttcgtggacgccgagacgggcgaaatctttcggcctgaggattactctagagcggaatgggacgagatcttcggagttcacattcccaagccttgggaaacctttcgcgccgagctggatgtgcggatgggcgacgatcccaaagggttcctcgacacacacagcgatgtcgctctggagcttgactatccggaatacatctatgagaatctgagacctattttcgtgtcccggatgcccaaccataaggtgaccggagccgctcacgccgatacaatccgctctcctagacattttaaagacgaaggcattgttctcaccaagacggccctgacagatctgaaacttgacaaggatggggagatcgacggatactataatccccagagcgacctcctgctgtacgaggctctcaagaaacaactgcttctgtatggcaacgatgcgaagaaagccttcgctcaggactttcacaagcctaaagccgatgggaccgaaggccccgtcgtgcggaaggtgaagatccagaaaaagcagaccatgggagtcttcgtggactccggcaatgggattgccgagaacggaggcatggttcgcatcgatgtgtttagagtcaatgggaaatactacttcgtgccggtttatacagctgacgtggtcaagaaagtgctccctaaccgggccagcaccgcgcataagccctacggagaatggaaggttatggaggataaagactttctgttctctctgtattccagagatcttattcacatcaagagcaaaaaggacattcccatcaaaatggtgaatggcgggatggaaggcatcaaggagacatacgcttattacattggagccgatatctctgccgctaacattcaaggcatcgcccacgactcccgctataagtttcgggggctcggcattcagagcctggacgtcctggagaaatgtcagatcgatgtgctcggacatgtgtccgtcgttagatctgaaaagcgcatggggttcagctga

SEQ ID NO: 4005 - RNA, 3423 nt, synthetic construct
  misc_feature 1..3423: note = Cas9 variant
  source 1..3423: mol_type = other RNA
atgaacggcctggtgctcgggctggacatcggaattgccagcgtcggcgttgggatccttgagaaaaattccggaaaaattgtgcacgcttctagcagaatcttccccgccgcgaccgctgataacaatgtggaacggcgcaagaacagacaggcccggcgcctgaatagacggaaaaagcatcgcggcgtcagatttcaagacctcttcgaggattacgggctgcttacagacttttccaaagtgtctattaacctgaatccttatcggctccgcgttgatggactgaaccagcagctgacgaatgaagaactcttcatcgccctgaagaacatcgtgaagagacggggcattagctaccttgacgatgcttccgaagacggcgggaccgtctctagcgattatggaaaagccgtggaggagaatcgcaagctgctcgctgaaaagacaccgggccagatccaactggagagatttgaaaagtacgggcagcttcggggagacttcaccgttgtggagaacggcgagaaatgccgcctgattaatgtcttttccacaagcgcctataagaaggaagcggagagaatcctccggaaacagcaggatttcaacaatcaaattaccgacgaatttatcgaggattacctgaagattctgacagggaaaagaaagtattaccacggacccggcaacgaaaaatctcgcaccgactacggccggtatacgacccataaggactccaaaggggagtacgtgacactcgataacatcttcggagtgctgatcggcaagtgtaccttttatcctaatgagtacagagccagcaaggcttcttatacagcccaggagttcaaccttctgaatgacctcaacaatctgaccgtccccacggagacaaagaaactttccgaggagcagaaaaagaccattatcgaatacgctaaaagcgccaagacactgggggcgtctaccctcctgaagtatattgccaaaatgatcgatacctccgttgaccagattcgcggataccgggtggatgtgaacaataagcctgagatccacacatttgaggtctacagaaaaatgcaaagcctggaaacgatctccgtgggcgagctctctcgcaacgttctggacgaacttgctcatattctgaccctcaatacagagcgggaagggatcgaggaggccattaacaccaagctgaaagatagcttctcccaggaccaggtgcttgaactggtccaattcagaaagaataacagctctctcttttccaagggatggcacaatttcagcctgaaactgatgatggagctcatccccgaactgtatgagacatctgaggaacagatgaccattcttacgcgcctgggcaagcagaaaagcaaggagacatccaaacggaccaagtacatcgatgaaaaggagctcaccgaagagatctataaccctgtggttgctaaatctgtgagacaggccattaagatcattaatgaggccacaaagaagcacggcatctttgacaacattgtcatcgaaatggctcgcgagaacaatgaagaggatgcgaaaaaggactacattaaacggcaaaaggccaaccaggacgaaaagtatgctgccatggagaaagccgctttccagtacaatgggaagaaagagctgccggataacatctttcatggacacaaggaactggccaccaaaatcagactttggcatcagcaaggcgagaagtgcctctatacaggaaagagcattcccatctccgacctgattcacaatcagtacaaatacgaaatcgatcacattctgcctctcagcctgtctttcgacgattcccttagcaacaaggtgctggtcctcgcgacggctaatcaggagaaaggacagcggaccccctttcaagccctggactctatggatgacgcctggtcctatcgcgagttcaagagctacgtgaaagaatccaagctgcttggcaacaagaaaaaggagtatctcctgacagaagaggatatctctaaaatcgaagttaagcagaaatttattgagagaaatctggtggacacccggtacagctccagagtcgtgctcaacgctctgcaggatttctataagaatcataactttgacacaaccatctctgttgtgcgcgggcagttcacgagccaacttcggagaaagtggggcctggagaaatcccgcgaaacctaccaccatcacgccgtcgatgctctcattatcgccgcgagctctcagctgagactgtggaagaaacagaataaccctcttattgcctataaggagggacaatttgtggactcccagacaggcgaaatcatcagcctcaccgacgatgagtacaaagaactggtgttcaaggctccctacgaccatttcgttgatacactgtcttccaaaacctttgaggacagcattctcttctcttatcaggtcgatagcaagtttaatcggaagatctccgacgccacgatttacgctacacgcaaagccaagctggataaagagaagaaagaatatacctacacacttgggaagatcaaggacatttatagcctgggaaccaaaaccccgtctaagacaggcttctacaaatttctcgatctgtataacaaggacaaatcccagttcctgatgtttcaaaaggatagaaagacgtgggacgaggtgatcgagaaaatcatggaacagtaccggcctttcaaggaatacgataaagcggggaaacttgtggactttaaccccttcgagaaatatcgccaggagaatggacctattagaaagtacagcaagaaaggcaacgggcccgaaatcaagtccctcaaatattacgacattctgctgggcaagcacaaaaatatcacccccgagggatctcggaacacagtcgccctcctgagccttaatccttggcgcaccgatgtgtattacaacatggaaacaaagaagtatgagtttctgggcctcaaatacgctgacctgccgttcgaagaagggggagcctacggcatttccaccgagacgtataatgaactgagagagaaggaagggatcgggaaaaactctgagtttaagttcacactttacaaaaatgatctgattctcatcaaggacaccgagaccaactgtcagcaattctttcggttctggagccgcacaggcaaagataatcccaagtcctttgaaaagcacaaaatcgagctgaagccttatgaaaaagctaagttcgagaaaggggaggaactcgaggttctgggcaaggtgcccccttctagcaaccagtttcagaagaatatgcagattgaaaacctttccatctacaaagtcaagaccgacgtgctgggaaataaacatttcattaagaaagagggcgataagcccaagctcaaattttga

SEQ ID NO: 4006 - RNA, 3423 nt, synthetic construct
  misc_feature 1..3423: note = Cas9 variant
  source 1..3423: mol_type = other RNA
atgaacggcctggtgctcgggctggacatcggaattgccagcgtcggcgttgggatccttaagaaagatattggagagatcattcacaccaattccagactgttctctgctgccacagcggacagcaacatcgaacggcgcggccatagagggggaaagcggctcacgcgccggaaaaagcacagatccatccgcctgcatgatctttttgaggacttcggcctgctcaccgatttttctaaagtgagcattaatctgaacccctaccagctgagagtgcaaggcctcgacaatcagctgacaaacgaagaacttttcatcgctctgaagaatattgtcaagcggcgcgggatctcctatctcgatgacgcctctgaagatggaggcaccgtgagctccgactacgggaaagccgttgaggagaacagaaagctgcttgctgaacagacacctggacagattcaactggatcggtttgagaaatatggccaggtgcgcggggacttcaatgtcgtggaaaacggagagaagagacggctcatcaatgtttttaccacaagcgcctactctaaagaggctgaacgcattctgagaaagcagcaggagttcaacaagaaaatcaccgatgaatttatcgaggactatctgacgattctcaccggcaagcggaaatactatcacggcccggggaatgaaaagtccagaacagactacggacgctacaccaccaaaaaggatcccgagggcaaatatatcacactggacaacattttcgggatccttattggaaagtgcacgttttaccctgatgagtatcgggccagcaaggcgtcttacacagcccaagagttcaatctgctcaacgacctgaacaatcttaccgtgcccacagagaccaaaaagctgtccgaagaacagaaaaagaccatcatcaaatatgctaagacagccaagacgctcggcgctagcaccctgctgaaatacattgccaagctcatcggggcgtctgtcgatcagattcatggatatagaatcgaccctaacaaaaagcccgaaatgcacacatttgagacctaccgcaaaatgcagtccctggagacaattagcgtggaggagcttcctcggaaggtgctggatgaactcgcccacatcctgacccttaatacggagagagaaggcatcgaggaggctattaacgccacactgaaggacaccttctcccaagatcaggtcctcgaactggttcagttccgcaaaaataactctagcctgttttccaagggctggcatagcttctctctcaaactgatgatggagcttatcccggaactgtacgagacctccgaggaacaaatgacaattctcacccggctggggaagcagaaaagcaaggagacatctaagagaacgaaatatatcgacgaaaaggagctgaccgaagagatttacaatcccgtggtggctaaaagcgtccgccaggccatcaagattatcaacgaggccaccaaaaagtatggaatctttgataatattgtgatcgaaatggctcgggagaacaatgaagaggacgcgaaaaaggaatacattaagagacagaaagccaaccttgacgagaagaatgctgccatggagaaagccgctttccaatataacggcaagaaagaactccctgataatgtttttcacgggcataaggagctggccacaaagatccgcctgtggcaccagcagggagaaaaatgtctctacacaggcaagaacattcccatctccgacctgatccagaaccaatataaatacgagattgatcacatccttcctctgtctctcagcttcgacgattccctgagcaataaggtgctggtccttgcgaccgctaaccaggaaaaagggcagcggacgccctttcaggccctcgactctatggatgacgcctggtcctacagagagttcaagagctatgtgaaggattctaaactgctgggcaataagaaaaaggagtacctcctgaccgaagaggacatttccaaaatcgaagttaagcaaaagtttattgagcggaaccttgtggatacacgctatagctccagagtcgtgctgaatgctctccaggacttctacaaagagcatcagtttgataccacaatctctgtcgtgcggggacagttcaccagccaactgagacgcaagtggggcctggaaaaatcccgggagacgtatcaccatcacgccgttgacgctcttatcattgccgcgtctagccagctcagactgtggaagaaacagaacaatccgctgatctcctacacagaagggcaatttgtggaccaggtcaccggagagattatcagcctctctgatgacgaatataaggagctggtgttcaaagccccttacgatcatttcgttgacacacttaagtccaagaaatttgaggatagcattctgttctcttaccaggtggactccaagtataaccgcaaaatcagcgatgctaccatctacgccaccagaaaggctaaactcgacaaggaaaataaggagtatacatacacgctgggcaaaattaaggatatctatgccctggggaccaaatctcccagcaagacaggattttacaaattccttgacctctataacaaggataagtcccagtttctgatgttccaaaaagaccggaagacctgggatgaagtcattgagaaaatcattgaacagtaccgcccttttaaggagtacgacgagaatggcaaagaagtggacttcaacccctttgagaagtatagaatcgaaaatgggcccattcggaagtacagcaaaaagggcaacggacctgagatcaaatctctgaagtattacgataatctcctgggcaaattcgtggacatcacaccgtccgaaagcaagaaccccgttgcgcttctgtccctcaacccttggcgcaccgatgtctattacaatacggagacatctaagtatgagtttctggggctgaaatacgccgacctttgcttcgaaaagggaggcgcttacgggattagcgaggtgaaatataacaagatcagagaaaaagagggaattggcaaggagtccgaatttaaattcaccctgtacaagaatgatctcatcctgattaaggacaccgagacaaactgtcagcagatcttccggttttggtctcgcaccgggaaagataatcccaagagcttcgaaaaacacaagatcgagctcaaaccttatgaaaaggccagatttgagaagggcgaggaactggaggtgcttggaaaagtgcccccgtcctctaaccaactgcagaagaatatgcagattgaaaacctcagcatctacaaagtcaagacagacgttctgggcaataaacacttcattaagaaggagggggaggaacctaaactgaagttttga

SEQ ID NO: 4007 - RNA, 3423 nt, synthetic construct
  misc_feature 1..3423: note = Cas9 variant
  source 1..3423: mol_type = other RNA
atggaggaaaacttccagtacagaatcggcctggacattgggatcaccagcgtgggatgggccgtcctccaaaataactcccaggatgagcccgttcggattacagacctgggcgtgcgcatctttgatgtggctgaaaatcctaagaacggggacgcccttgcggctccgagacgggatgcccgcacgaccagacggcgcctgagacggcgcagacaccggctcgagcgcattaaattcctgcttcaggaaaatggactgatcgagatggactcttttatggagagatattacaagggcaacctccccgatgtctatcagctgcggtacgaagggctggaccgcaaactcaaggatgaggaactggcccaagtgcttatccatattgctaaacacagaggattccggagcacaagaaaggccgagaccaagggcaaagagggcggggctgttctgaaggccacaaccgaaaatcagaaaatcatgcaggagaagggatatcgcacagtgggcgaaatgctctacctggacgaggcgtttcataccgaatgcctttggaacgagaaagggtatgtcctgacgcctcggaatagacccgatgactacaagcacaccattctccgctccatgctggtggaggaagttcatgccatcttcgctgcccagcgggctctgggaaacgagaaggccacagaggaactcgaaaatgcgtacgtggagattatgacctctcaaagatcctttgatatgggccctgggctgcagcccgacggaaaaccttccccgtatgccatggagggcttcggcgaccgcgtcgggaagtgtacatttgaaaaagatgagtaccgggctcccaaggccacctatacggctgaacttttcgtggccctgcagaaaatcaaccacacaaagctcattgacgagtttggaaccggcagattctttacagaagaggagcgcaaaaccatcatcgatctgcttctgtctgggaaggaactcaagtacggaaccattcggaaaaagctgaatatcgaccctagcctgaaattcaactccctcaattatagcgccaagaaagagggcgaaacagaggaggaaagagtgcgcgatacggagaaggctaagttcgcgtctatgttttggacctacgaatattccaaatgcctgaaggaccggaacgaggaaatgacagtcgggcagaaagccgatcttctggacagaattggagagatcctcaccgcttacaagaacgatgacagccggtcttcccgcctggaggatcttggcctgagcagagaagagattgacggcctcctggaactgtctcccgccaaataccaacgggtttccctcaaggccatgagaaagatgcagccttatctggaggacgggcttatctacgataaggcttgtgaagccgcgggatatgacttccgcgctctgaatgatggcaacaagaaacacctcctgaagggggaggagatcaatgccattgtgaacgacatcacaaatcccgtggtcaaacggagcgtgtcccagaccattaaggttatcaacgccattatccaaaagtacggatctccgcaggctgtgaatatcgaactggccagagagatgagcaaaaactttcaggatcgcacgaatcttgaaaaggagatgaaaaagagacagcaagaaaacgagcgggctaaacagcagattatcgagctcggcaagcagaatcctacagggcaagacattctgaaatatcgcctgtggaacgatcagggcggatactgcctctattccggcaagaagatccccctggaggaacttttcgggggaggctacgacattgatcatatcctgccttacagcattacctttgacgattcttatagaaataaagtcctcgtgaccgcccaggaaaaccggcagaaggggaatcgcacaccctacgagtatttcggagcggacgagaaacactgggaagattacgaggccagagttcggctgctggtgcgcgactataagaaacaacagaaacttctcaagaaaaactttaccgaagaggaaagaaaggagttcaaagagcggaacctgaatgacacaaagtacatcacgcgcgtcgtgtataacatgatcagacagaatctggaactcgagccctttaaccatcctgagaaaaagaagcaggtctgggctgtgaatggcgccgttacctcctacctgcggaaaagatgggggcttatgcaaaaggatcgcagcacagaccggcaccacgctatggatgccgtggtcattgcgtgttgcaccgacggcatgatccataaaatttctagatacatgcagggacgcgaactggcctatagccggaacttcaagtttccggatgaagagacaggcgagatcctcaatagagacaacttcacccgcgaacagtgggatgagaaatttggggtgaaggttcccctgccttggaatagcttccgggacgaactggatattagacttctcaacgaggaccccaagaatttcctgctgacgcacgctgatgtgcaacgcgaactcgactaccctggatggatgtatggcgaggaggaatctcccatcgaggaagggcggtacatcaactatattagaccgctgtttgtcagccggatgcctaatcataaagtgaccggatccgcccacgatgctacaatccgcagcgccagagactacgagacccggggcgtggttattacaaaggtcccccttaccgacctgaaactcaacaaggataatgagatcgaagggtattacgacaaagattctgaccgcctgctgtaccaggcccttgtgagacagctcctgctgcatggcaacgatggaaagaaggctttcgcggaggactttcacaaacctaaggccgatggcacggaagggcccgtggtccggaaagtgaagattgagaaaaagcagacatccggagttatggtgagaggcgggaccggaatcgctgccaacggcgaaatggtccgcatcgacgtgttccgggagaatgggaaatattactttgttcctgtgtatacagccgatgtcgtgagaaaggttctccccaaccgcgctgccatgaatggcaagattgcgagcgactggaaaaccatggaggataacaatttcgtgttttctctgtactcccgggaccttatccacgtcaagcgcaaaaaggctattccgaccatcctgagctccggagccacattcgaacaagaggaattttatgcctacttcacgggcgctgacatttctaccgtgagcatcgccgggatctccaacgataattcttttaaattcagaggactcggcattcaggggctggagatctttgaaaagtgtcaggtggacattctgggaaacatcagcgtcgttcggcatgagaatagacagggcttccactga

SEQ ID NO: 4008 - RNA, 3426 nt, synthetic construct
  misc_feature 1..3426: note = Cas9 variant
  source 1..3426: mol_type = other RNA
atgtacagcatcggcctggacattgggatcgcctccgtgggatattctgtcattgagaccaacagcggcagaatcgttgaactcggggctcggattttcgaggcccgcaattccgataacaataaggacagacgggattttcgcggaggcagacggctgatccgcagacggaaaacacgccttgacgatgcgaagagatacctggacgatcaggggttcaaaaacgacaagtctctcatcaatgtgtgcccctatagcctgcgggtgaaaggacttacggaggaactgtccaagtctgaaattcgcaaggtcatcctccacattctgaaaaagagaggcgtgagctacctgtccagcgaggatctcgacacctcttccgttgataacaaagacagctttaagcaagctgtgaccaaaaatctgcggcagcttgatgacaagacacctggccagatccagtatgagcgcctgcaagaatctgggagagtccggacaggaattaaccagaatggccagtaccagctcaacgtgttcgacgttgcctcctatgccaaggagctgaaacttatcctggaaacccaacagcagtaccatcaggagattgatgaccactttctcgatttctttacaaaggacgggtacagagaggatgctggactgatctatcgcaaacggccgtactatgacggccccgggaatgccgctcaaaacagctcttacggaagatgggccaattatcaggtggatggcaagcctgcggaaaacatcttcgaccagctgattggcaaagattttaccgggaagatccgcgcctccaatctcggacccagcgctcaaaaattcaacctgcttaacgacctgaataacctccggattacgaccagagaggaagagaagctgacatttgaagagaagcaggagatccttgaagtcctggagaatgatcgccctaaaaccttcggcccccggaacattgccaagatgctcaaagtggacatggacgatatcaaggggtggagactcaattcctctgacaaacctgaaatccatacaatgaaggagtacaacgatatgcgcctggtgctggaagctggaggctttgacattaaggccatcgatctggaccacattgaggagatcgcgagccttattaccctgaatacggaacgggaggccttcgaactctccctgagcaacgagatcgataataaccttaaacagttcctggtcgaaaattttaacgctctcagaaagtgtaaaccgaataactcttggcattccttcagcaaggagaatctgcagcgcctgatcacagagctcgaacacacctctgacgagcaaaacacaattctggaacggcttgggctgaaatttgatctcagaagcaagtattccgaccgggataccctgcccatccacgaggttctggaggaaatttacaaccctaccgtgtctaagagcgtgcgccagacattcagagtccttaatgccctcgtgaaaaagtacggaaaagagaacatcgactatgttacgattgaaatgccccgggataagaatgaggacgaccagaaaaagaccatcagagaaattcagaaggtgaacaaaaatcgcaaggataaatccaaggagtactttctgaaaaagagcggctggtctgaggaaaaattcgaggaaaagctgcggacatccagacgctttgctagcaagctctattacttctatgagcaagacggcctgtgcgcctacaccgggcagcagatccagcctgaagatcttctgacagagagagtcgaggtggaccatatcattcccctctctgtttccctggatgacagcatcaacaataaagtgctggtcacctccgaagccaaccaaaagaaaggacagcggtctccgtatgatgcttttatgagcggcgacttctccaagtaccgcacgtacgatgagtataaagcgtgggtgctttctaataagtacaagaaatataagaaagccctcctgctggaagagagaaacatttttgaccctgaactcgctaagaaattccggcagcgcaatctgaacgatacaagatacgccagccggatcgtccttaatgccgtgcagtcctttttctataagaccgacaccaagacacgcgttgtgaacggggctttcacccacacactgcggaaaaagtggaatctcgccgataaagacagagagacgcatcaccaccatgcgattgacgctaccctggtcgccgtgacaccctttgttaaggccgagcgctacgaatattacaaagatagcgagggaaaggcttctatggtggacaccgtcacaggcaccatcatcccttactccgaatataagaaaaagaacctgtacgatagaagcaactatcttctcatgttcgggaatgagtctacgattaaccaagagaaagaagacaagtccgccgagtttatccggaatctgattcccgctaaaatctaccccgaaattaagttcagccaccaggtggatagaaaatctaaccgccggctgagcgacgccaccatctattccacaagaagctacaccgtggagaagggccgcggaaagaataaacgggaagttatcgagagagatattatcggcaagattaaagacatctatacagcggatgggtacgccgagtacgtcaagtataaagactctctcctggtgaaggaaattgatgagaagacctttgaaaaacttgaggctatcatcgaagagttctccgacacggtggaggtcacagaccagcaaggaaaggtgaaaaaggttagcaaatccccttttctgcagtactgtgaaaagtatgatgtgccgggcgtcaccaagtactctaaaaagaacaatgggcccgtgattcgcagcctcaaatatcggtacacaaagctgagatcccatatcgacatttctcctaaaaacagcaagaataccgttgccctgcttaccctcgctccctggcgcacagatgtgtattactcccaggagacggcctcttaccatctgctgggactcaagtatatcgacctgagcttccgggatggcgggtacggcgtctccagaaaacggtatgaagagattaagaaaaacgaacgcatccctgaggacggagagtttaagttcagcctttacaaaaaggattatattgaaatcgagtttgacaagaaaatcctgcccggcctctaccagtctagagatgtgtccgcgcggaataagttcagcatgaaaccgattgacaaggcccaatggacctctaaagaagatgttctgatgtttgggaacgtgaaggcttccggagtcttcgagaaaacactgaagaagaattatgtgcttcgcaaataccacgtggacgtcctgggcaacaagttcgaggttaaagatgaaatcctcaaggacattctggagtga

SEQ ID NO: 4009 - RNA, 3429 nt, synthetic construct
  misc_feature 1..3429: note = Cas9 variant
  source 1..3429: mol_type = other RNA
atgtacagcgtgggcctggacatcgggattgcctcctgcggatattctatcattaacgatgtcaatggcaacatcgttgagctcgggaccctgcttttcaagagcagaaattccgacaacaatgaagaacggcgcacaaacagaggatctcggcgcctgattaatagacggcgcacgagactcgatgacggcaaaaagctgcttgctgaaaaagggtttaagcaggatagcaaactgaagcacgtgtgtccctacgagctccgggtgaagggactgcatgaaaaactgacccaaggcgagatctataaggtcgtgctccacatcctgaaaaagcgcggcatttcctaccttgacgagtctgatgaaaacagctccgggatcgacggagccagctataaagatcaggttaatctgaacctcaatctgcagaaggagcttacacctggccagattcaactgaagagactcaaagaaaacgggcggatcaagtctggagtgaccttcgagaatggctaccagctgaacgtcttttccgtgagcgcgtatgctaatgagctgaacaaaattctcacaaagcagtctgaatactactccgagatcgaccagatttggatcgatcgcttcaccaaaaacgggtatagaaaggaagccggactggtttaccggaaacgcccgtattacgacggccccggcaatgagaagaacaatagcatctatgggagatgggccaactttaaggaagatggacatcctaaagagaatattttcgaccaacttatcggcctggactctgtggattccacacaggtccgggctagcgcctccaccctcacggctcagaagtacaacctgcttaatgacctgaacaatctcaccattatcgaggatgacagaaaatttacaaccgatgaaaaggtgtctattatcaactatctgatgacacaggacatcacccgcttcgggcccaaagagctggccaagttttaccaactcgaagtggatcagattcggggatggagaatcgacaataagggcaaccctgagattcacagcctgaaagtctaccgcgattggaagaaaatcttcaatacgtccagcattgaccttacatctatccagacctgggttgtggatgaactggcgaacgtgatcacactcaataccgagattccctccaccctggccacacttaagatcaaaattcctgacatcgaccaacagattctgaactttgtcgagaacaatttctatgaactcaagaagaaaacgagcaagaactcttggcatagcttttccctgaaaaccctgaatatcctcattccggagctgcttaacacatctgaagaacagaataccatcctggaacggctcaacctgaagttcgatctgaaaaataagtacgctgagaagaaccagatccccgtgaaagagcttctcgaacaaatttataatcctacagttaccaagagcgtgcaccagtccatcaaactgttcaacgagattatcgaaaagtacgggaaaaataacattagctatgtcacgatcgagatgcccagagacaagaatgatcaggaccagaaagatacaatcaagcgcattaacaagctcaattctgagcggaaaaacgactccgaaaagtactttctggagagaagcggatgggataccatccgcttcgaatctgccctgaaaaagcctcggtttgctgagaaacttctgttctattacgaacaaaagggcaagtgcgcctactccggccaggacattctcgcggagagcctgctgaacgagtcctgtgaagtggatcacatcattcccctttctatcagctttgacgattccatccataataaagttctcgtgaccgcctctagcaaccaggagaaggggcagagaacaccgtatatggctttcattgacggagccaaactgggccaatcctgggatgactttgtcgcttgggtgaatagctgcgggttccaccgcaagaaagtccagaacctgctctacgaagagaatatctttaaccctgacgtgcagcggggattcgtttctagaaatctgaacgatacccggtatgcctcccgcattgtgcttaatgccatccagagctttttctacaagcaaaaggacctgacaaaagtcaaggtggttaacggctcttttacgcataccctccggaaaaagtgggggtccagcctggataaaaatagagacacatatcaccaccatgctgtggatgcgaccctgtgtgccgtcacacccttcattaacatcgtgaagtacgagttctttgaggaggacggcatcaagtatatggtggatcttaccacgggagaaaaagttgcttactctgactacaagaaaatgaagttctatgataaaagagcctacgtccctatttgggacggctttatcaagcagctcacccccgccaatctgtatcccaaaattaagttcagccaccaggtggattccaagtggaaccgcaaaatcagcgacgctacaatttactctacccggaagatcgtggagacaaaaattaataagaaaggggtcgccaaggaaaccgtgaaggatatcgttatcgacaaaattaaggacatctatacgcctgagggatggagaaaatttaaggaaaaacaagataagctgctcatgaagaacttcgacgagaaaacatacaacaagctgattaaaatcgcgaaggagtatccggagaaaaaggaggtgcagacctccaatggcaaggtcagccttgtggaagtttccccctttaaaatgtactgcgaggagcagaacgtgcctgctattcgcaagtactctaaaaaggggaatggaccctatatcagaagcctgaaattctacgataaggaactcggcaagcatatcaacattacaaaagactcctatgggaatgatatcgagcggaccattcgcaacaagaaaatcattctgaagaatcagaactcttggagaaccgacgtctactataatagcgtgaacaattgttacgaactgcttggcatcaaatattgccacctcaagttttaccggggaaaatacggcatccctaagtccatttatgatgagctgaagaaagaagacgagatctctagcgagtccgttttcaagtttagcctgtaccgccatgatagagtgcggttcgaaaaagacggggagtatattgaagccctctttggatctaagaacgagtccaataaaaactacctggaacttagccccatcgataagaataagtggctgtctaaagagaacgtcaagttcttcggcgaggtggccgcttccgggcgctttattaaaggactcaagccgggcatcaaagtgattaagcaaagcacagactatatggggcacgtctacgccatccaccaggaaaagctgaaattcgttctgtctgacgcttga

SEQ ID NO: 4010 - RNA, 3435 nt, synthetic construct
  misc_feature 1..3435: note = Cas9 variant
  source 1..3435: mol_type = other RNA
atgaccagcaagcaggagaaacacggcgccctgacattcgggctcgacatcggaattgcttccgtgggctgggccgtcctgggggaatctagaatcgttgatcttggagtgcggtgctttgacaaggcggagacggctaaagaaggcgagagcctgaacctcacccgcagaatggcccggctgcttcgcagacggctgcgcagacgggcctggcgcctcacaaagctggctagactgctcaaacgggaagggctgattgccgatgctaatcttttcaagcataagatcgagaaaaacacccccgtgcctaagtcctcttggcaactgcgcgtcgacggactcgatagacagctgaatgccgaggaatgggcgcgggtgatttaccacctttgtaaacatcgcggctttcactggatcagcagagccgaggaaaaggctgccgagggcgactccaaaggggagggaggcaaggttaagcaggggctggctggaacgaaaaagctcatgcaggaaaaatcttatcggaccgccgcggagatggtgctggccgagttcccggatgctcaaagaaacaagcagggcgactacagcaaagccctgtcccgcatcctcctgggggatgaacttaaggctctgtttgaacatcagcggaaactcggaaatcccgtcgccacagagaagctggaggccgctattcttggcaacggcgacaagaaatgcgggctgttctgggcgcagaatcctgccctcgctggaaacaagctgctggaaatgctcggcagatgtacctttgagaaaacagggggagatgacggcaagggggaatatcgcgcccccaaagccagcttctctgctgagcggcacgtgtggctgacccaccttaataacctgagaatcgttgtggatggaacaacccgccctctcaatgaagccgagcggagagtcgcgctgcccatgccttaccaacaggctggcgacctttcctataagcagctgggcggggccctcattaaggagggatttctgcagaaagacggcttcaagtttgccgggctgccgtaccccacaaaacaagctagcgaagagaaggccaaagatcctgaaacctctgtgctctgcaagctgcccgcttggcatacgcttcgcaagacactggagaaacacggactcgaatccgagtggcagaagctgagcaccgacgccctggatggcaaacctcagcttctcgacaacatcgcgtgggtgctgtctgtctataaggatgacgatgaggttaaaacagaactggggaagctcaatctgcccaacaccgagaagatgattgacgcccttctggatatccggttcgacaaattttccaatctcagcctgaaggctctgtccaaaattgtgccgttcatggaacaaggccagagatacgatgaggccgtggctaacatccctgagtacggacatcactctcagcttcacaaggtcggcgccggggaacataaatatctgccccctttctacaaggagcgcgacaaaaccggacggatggtgtttaacgacgatatggacatccccagaaatcccgttgtgctccgggcgctgaaccaggcccgcaaggtcgtgaatgctctcattaaggaatatggcagccctcacgaggttcatatcgaaatggccagagatctgtcccggccgcttgacgagagacgcgatattgagaaactgcaaaaggagttcggggaacggaacaaaaaggacaaagaactctttgctcaggatttcaatatcgtgggaacagtcaagggcaagcagtttgagaaataccagctgtatagagaacaacaggggaagtgtatttaccccagcatggacgagaaacagggcatctgctgttattctctgaagcctcttgatctccaccgcgtgctgtacgaggaaggatacgccgagatcgaccatgccctgccctattcccggagcttcgatgactctaaaaacaatagagtcctcgtgctggctaaggaaaaccgcgataagggcaatagaacgccttttgagtaccttggggacaaagacaacagcgaaccctggcggcagttcgttgcgtttgtggagggaaataaggcctatcgcctggctaaaagatcccggctcctgcgcaaggatttcggcgacaaagaggccaaggaatttagagagcggaacctgaatgatacccgctacatttgcaagttctttaaaaactatgtcgaacaataccttcagctccacgaggactctgaggccaagagatgtgtggttctgagcgggcagatgacatccttcctgcgggctagatggggactcgtgaaagtccgcggcgatagcgaccggcaccatgccctggatgcggctgtggtggccgcctgctctcacgggatggttaagagactttccgactatagccgccggaaagaactggagcaggtcagagaaggcttcgtggatgtggacaccggagagatcgtcaatccggctatgtttcaacaggtgcaggaacatttccctaacccctggcctcactttcgcgatgaggttaagctccggctgtctattgacgatcccacactgcttagatccgagatggaaaaattcggcacctacacgcctgagagcctggaagccctccgccccctgtttgtgtcccgggcgccgcaaagacggaactctggggctgcccacaaggacacaatctacgcccagcctaagcgcctcgtcgctcagggaggcgtgacccagaaagttgccctgagctcccttaccctgaaggacctcgataaactgattgacccccatagaaatgagcggctgtatgctgccatccgcgcgagacttgaacaacacgggggaaagggcgataaagccttccccgcttctaaccctctgcggaagccggacagcgaggggaatcccacaggccctatcgtgagaggagtcaccatggtgattgataagctctccggcatccccattcgcgggggaatcgccaaaaacgacagcatggttcgggtggatgtctttacaaaggctaataaattccatctggtgcctgtgtacgtccaccattctgttctcggcctgcccaaccaggccattgtcgggggaaaggaggaatccgagtggacgcagatcgacgatagctttgactggcacttctctatttatcctaatgatcttatcagagtgaccctgaaacaggaaggccgctttggctactatgccgggtgtgaccggtccacagctgcgatccacctctgggcccatgacagaaaccaacaggtgggaaaggatggcctgattcgcagcatcggggtgaagaccgctctgtctattgagaaattcaatgttgacgtgcttggaaaccggtaccccgccccgcctgaaaagagacgcgatctggcctga

SEQ ID NO: 4011 - RNA, 3435 nt, synthetic construct
  misc_feature 1..3435: note = Cas9 variant
  source 1..3435: mol_type = other RNA
atgaccagcaagcaggaaaacctgggcgccctcacattcgggctggacatcggaattgcttccgtgggctgggccgtccttggggaaaatagaatcattgatctgggagttcggtgctttgacaaagcggagacggctaaggaaggcgagtctctcaacctgacccgcagaatggcccggcttctgcgcagacggctccgcagacgggcctggcgcctgacaaaactggctagactcctgaagcgggaagggcttatcgccgatgctaatctgttcaaacacaagattgagaagaacacccccgtgcctaaaagctcctggcaactccgcgtggacggactggatagacagcttaatgccgaggaatgggcgcgggtcatctaccatctgtgtaagcaccgcggctttcattggatctctagagccgaggaaaaagctgccgagggcgacagcaagggggagggaggcaaagtgaagcaggggctcgctggaacaaagaaactgatgcaggaaaagtcctatcggaccgccgcggagatggttctggccgagttcccggatgctcaaagaaacaaacagggcgactactctaaggccctcagccgcattctgcttggggatgaactgaaagctctctttgaacaccagcggaagctgggaaatcccgtggccacagagaaacttgaggccgctatcctgggcaacggcgacaagaagtgcggactcttctgggcgcagaatcctgccctggctgggaacaaactgctcgaaatgctgggcagatgtacctttgagaagacagggggagatgacggcaaaggggaatatcgcgcccccaaggcctccttcagcgctgagcggcatgtctggcttacccacctgaataacctcagaattgtggttgatggaacaacccgccctctgaatgaagccgagcggagagtggcgcttcccatgccttaccaacaggctggcgacctgtcttataaacagctcggcggggccctgatcaaggagggatttctgcagaaggacggcttcaaatttgccgggctcccgtaccccacaaagcaggcttccgaagagaaagccaaggatcctgaaaccagcgtcctgtgcaaacttcccgcttggcacacgctgcgcaagacactcgagaagcatggactggaatctgagtggcaaaaactgtccaccgacgcccttgatggcaagcctcagctcctggacaacattgcgtgggtgctgagcgtgtataaagatgacgatgaggtcaagacagaactcgggaaactgaatcttcccaacaccgagaagatgatcgacgccctgctcgatattcggttcgacaagttttctaacctgtccctgaaagctcttagcaagatcgttccgttcatggaacaaggccagagatacgatgaggccgtggctaatatccctgagtacggacaccattcccagctccacaaagtgggcgccggggaacacaagtatctgccccctttctacaaagagcgcgacaagaccggacggatggtctttaacgacgatatggacattcccagaaatcccgtggttctgcgggcgctcaaccaggcccgcaaagtggtcaatgctctgatcaaggaatatggctctcctcatgaggtgcacattgaaatggccagagatcttagccggccgctggacgagagacgcgatatcgagaagctccaaaaagagttcggggaacggaacaagaaagacaaggaactgtttgctcaggatttcaatattgttggaacagtgaaaggcaagcagtttgagaagtaccagctgtatagagaacaacaggggaaatgtatctacccctccatggacgagaagcagggcatctgctgttatagccttaaacctctcgatctgcatcgcgtcctgtacgaggaaggatacgccgagattgaccacgccctcccctattctagatccttcgatgacagcaagaacaatcgggtgctggtccttgctaaagaaaaccgcgataagggcaatagaacgccttttgagtacctgggggacaaggacaactctgaaccctggcggcagttcgtggcgtttgttgagggaaataaagcctatcgcctcgctaagagaagccggctgctgcgcaaagatttcggcgacaaggaggccaaagaatttagagagcggaaccttaatgatacccgctacatctgcaagttctttaagaactatgtggaacaatacctccagctgcatgaggactccgaggccaaaagatgtgtcgtgctgtctgggcagatgacgagcttcctccgggctagatggggactggttaaggtgcgcggcgattccgaccggcaccacgcccttgatgcggctgtcgtggccgcctgcagccatgggatggtgaaaagactgtctgactattcccgccggaaggaactcgagcaggttagagaaggcttcgtcgatgtggacaccggagagattgtgaacccggctatgtttcaacaggtccaggaacacttccctaatccctggcctcattttcgcgatgaggtgaaactgcggctgagcatcgacgatcccacacttctgagatctgagatggaaaagttcggcacctacacgcctgagtccctcgaagccctgcgccccctctttgttagccgggcgccgcaaagacggaactccggggctgcccacaaagacacaatttacgcccagcctaagcgcctggtggctcagggaggcgtcacccagaaggtggccctttctagcctgaccctcaaagacctggataagctgatcgacccccacagaaatgagcggctttatgctgccatccgcgcgagactggaacaacatgggggaaaaggcgataaggccttccccgcttccaaccctctccggaaaccggactctgaggggaatcccacaggccctattgttagaggagtgaccatggtcatcgataagctgagcggcattcccatccgcgggggaattgccaagaacgactccatggtgcgggttgatgtgtttacaaaagctaataagttccacctcgtccctgtgtacgtgcatcacagcgtcctgggccttcccaaccaggccatcgttgggggaaaagaggaatctgagtggacgcagattgacgattcctttgactggcatttcagcatctatcctaatgatctgatcagagtgaccctcaagcaggaaggccgctttggctactatgccgggtgtgaccggtctacagctgcgattcacctgtgggcccacgacagaaaccaacaggtgggaaaagatggcctgatccgctccattggggtcaagaccgctcttagcatcgagaagttcaatgtggacgttctgggaaaccggtaccccgccccgcctgagaaaagacgcgatctcgcctga

SEQ ID NO: 4012 - RNA, 3438 nt, synthetic construct
  misc_feature 1..3438: note = Cas9 variant
  source 1..3438: mol_type = other RNA
atgaagaccatcctgggcctcgacctggggacaaacagcattggatgggcccttgtgaaagagacggaaaattccaacgagaagtctgaaatcattaaactgggcgtcagagttaatcccctcaccgtggatgagaagacaaacttcgaagctgggcggcctctgagcaccaatgccgaccgcacagcgaaaagatccgctcggcgcaaccttcagagatacaagctgcggcgcaagaatctcatcgatctgctgattaaacacagactcatcgacaaggataccccgctgacagagatcgggaaaaacaccacgcatcaaacccttgagctgcgggccaaggccgctcgcgaaagaattgagctcgaagacctggcccgggtgtttcttgctatcaataaaaagcgcggctatagatctagccggaaggtcaacaatgaggaggaaggacaggtggttgatggaatggccgtggcgaaaaagctgtacgacgagaacctcacacccggccagtatgcctacgaactgctgtccaaaggcaagaaatatgtccctgatttctaccgctctgacctccaggctgagtttgatagcatttgggaatatcaaaagcagttctacgccgacatcctggatgacgagctttacaatgctctgaaagggcagggacagcaaaactccagaaagcggtttctcgccattaagggcgtgtataccgcggagaataaagggaagagagacgaagttaaactgcagcactacaagtggcgcagcgaggccatcacacagaaactttctattgaagaggtggcttatgtcctggtggaaatcaacaacgatctcaataagtccagcggatacctgggcgccatctctgaccggtccaaggagctgtatttcaacaaagagaccgtgggggaaaatctctggaagcagattcagaaaaacccccatacgagcctgaagaatcaagtcttttacagacaggattatcttgacgagttcgaacaaatctgggagacacaggctcagtttcaccctcagctgaccctcgccctgaaagaacaaattcgcgatgttgtgatcttctaccagcggaaacttaagtctcagaaaggactgctctccttttgccagttcgagagctgggagattgaaagaaaggacgagaacggcaatgtgatcctgaacaaaacaacccaactgcccaagcgccagaccgtcggccggagagtggcccctaaatcctctccgctctttcaggagttcaagatctggcagaatattaacaatctggaaatcgctaagattagcgatgggaactccaaaaataagaaagagacagaagcgcttagcgacgatgagcgcaagctcctgttcgaggaactgaacctgcggggaaatctttctcaaaaagaagttctccagatcctgggcctgaaggacaaagagtacaagacgaactttcccgaggggctcgaaggaaacagaaccaatgccgctctgttcaacatttatcagcagatcgccgagaatgaaggctacggggattggacaaagaaatccgcccaagagatcaaggaggaacttaaagctgtgtttcctcagattggaatccaggccgacattctggacttcaacgcggagctcgatggcaaggaatttgagaatcaagctagctatcagctgtggcatctgctttactctgccgaagaggacgataaaatcaacgaagaggaccagattatctatggcaatagcgccgtctccctcaagaagaaactgtgtgagaagttcgggtttacccccgaatacgctaaatggattgccaacgtgtctctgcaggatgactatggaaatctcagcacaaaggctatgcgcaaaatcatcccttacctgattgatggcaacgactactccgaggcctgcgcgcttgccgggtataatcacagcaactctctgaccaaggaagagaatgataaccgggagagactcaataagctggaactgcttcccaaaaactccctccggaacccggttgtggagaagatcctgaatcaaatggtcaacgtggtcaatcaggtgattgaaacgtacggaaaacctgacgaggttcgcatcgaactggctagagagctcaagaaaagcgccgaggaacgggctgagatgacaaagggcattaacgaagccaccagacgcaatgaggatatcaagaaactgatcaccaagaacttcgggattcccaatcctaccaaaaacgacgtggtccggtatagactttgggaggaactggcgcccctcgcctacaaggatgtgtttacaggccgccagatcaaaaaggaggacctgttctcttccaaaattgacatcgaacacattatccccaaggctctgctttttgatgacagcttctccaataagacactcgcctttagagagacgaacctgaaaaaggctgatcggaccgcctatggattcatcgaatctgactacaatgccacactggatgactatattcagcgcgttgagaccctctacaacaatgctaaaggcacaatcagcaaggggaaaagaaacaagctgcttatggcgcaaaagaatctgcctgatggattcattgaacgggacctccgcaactcccagtacatcgccaaaaaggctaaatctatgattgagaaggtgtttaacgatgtcaatgtgaccagcggctccatcacggacagactgcgggaggattgggacctgatcaacgtgatgaaagaacttaatttcccgaagtataaggccctggggctcaccgagattgaggaacgctacgatatcggacaggagaaaacaaagaaagttgaagtcattaccgactggacaaagagaaacgaccatcggcaccatgccatggatgctctgaccgtggcctttacgacaaaaagccacgtgcagtatctcaataacctgaataccatccactctcttaagggcgacgaggtcgatctggaactctccaagctgtacgggctgaaaaacacaattaccgaggtggttaataagaaacgcaagttcattccccctatgcccaactttagagaagaggcgaaaaagcatatcgagaccatccttgtgagcatcaagaataaaaacaaggtctatacaaagaatattaacaagacgaaaaaggaatctggctaccacaccaaagagcaactgacacctcggggacagctccataaggaaaccgtgtatggcaagtccaaaagacccatgaataagccgacaaaaatcaacaagaatttcagcctggagcaggctcaactcattatcaacgttcaggaaaaagagctggtgcttcgccacctggcccagtttgacaacaatcctgccgtcgctttcgataccaagacgctcaagaaatgtcattacctgaagatggtgaacctgtga

SEQ ID NO: 4013 - RNA, 3441 nt, synthetic construct
  misc_feature 1..3441: note = Cas9 variant
  source 1..3441: mol_type = other RNA
atgagcggcaacacccacgggcccctgacattcggatttgacatcggcattgcctccgtggggtggtgcgtcctcggagagaatagaatcgttaacctgggcgtgcggtgtttcgataaggctgaaacggccaaagagggggaatctcttaatctggcgcgcagaaccgctcggctcatgcgcagacggctgcgcagacgggcctggcgccttacaaagctggccagactcctgaaacgggagggactgattgctgaagccagccgcatccatattccttccccggtgtctccctggagactccgggtcgagggcatcgaccgcagactgaccgatgacgagtgggctcgggtgatctaccacctttgcaagcatagaggctttcactggattagccgcgccgaagaacggaaagcggaatccgatgccaaggaagggggaagagttaagaaaggcctgtctgacacacagcgccggatgaccgagaaggggtatagaagcgctgccgaaatggtgctcgctgagttccctgatgcccaacgcaacaaacagggagactacggcaaggcgctgtcccggatccttctgagcgatgaactcgccctgctgtttagacgccagcgggagctcgggaatcccaacgctggaaatgaactggaggccacaattcttggcaacggcaatagaaaatctgggctgttctgggagcagaagcctcccctcgctggagccgacctgcttaagatgctgggccgctgtacctttgagaaaaacgagtatcgggcccctaaggcttccttcacggcggaaagacatgtctggctcacccggctgaataacctgcgcgtggttgtggatgggacaaccagaagcctcgacgatgccgagcaccggctggtccttccgctgccctacaaacaagctggagactttacatataagcagctcagaaccgccctgacgaaagccggccttctgcctgaagggttcaagtttgctggactctcttaccccacaggccgccagctggacgatcctaaagccaaggaccccgagtccgagaagctggtgcggctcccggcgtggcaggaactgagaaaaacccttaaggataaaaatctggagacagaatgggagggcatggctggggccgccaccggaggcaaccctgaactcctggacgagatcgctcgcgtgctgagcgtcttcaaggatggggacgaggttaccgccgaactttggaaactccccctgcctggaggcaaggctatgattgatgccctgtctgagatctcctttgacaagttccacgcgctcagcctgaaagcccttagaaagattgtgccccatatggaatccgggctgcggtatgatgaggcttgcgccgtggctggctaccaccattctcaactccacgccgcgggagccggcgagcacaaattcctgccccctttttacagccgcagagacaaggatgggcggatggtcttcaatgaggagctggacgtgccgcgcaaccccgttgtgcttagagctctcaaccaggcccggaaagtcctgaatgctctggtgcgcacatatggatcccctacggccgttcatatcgaaatggccagagacctcagccggcccctggatgagcgcaacaaggtgaagaaagctcaggacgaatacagagagcggaatgagaaggataaagcggcctttgctgccgaatatggcatcgcccctaagtctagagagttcgaaaaatttcagctttaccgcgagcaacaggggaagtgtgcttattccctcaagagcctggacctgcaccgggtcctgcatgatattggatacgccgaagtggaccacgcgcttccctattctagaagctacgatgactccaaaaacaataaggtcctcgctctgaccgaggagaaccgcaataaaggcaaccggacagcctacgaatatctgacctctttcccgggaggcgagaatggagaaagatggcgcaactttagcgtggccgttgagacaaataaggcttaccggctcgccaaaagaacccgcctgcttcggaaggatttctccggcagagcggctgaagagtttcgggagcgcaacctgaatgacacgagatatatctgccggttctttaaaaacacagtggaacgcttcctcaagctggatgccaaggtcggggccggagacaccgctgagattagcgccaaaagatgtgtggttctgtctggccagaccacagcttttcttcgggccagatgggggctcctgaaggtgcgcggaaattccgatcggcatcacgcgctggacgccgctgtcgtggccgcttgcagccacggcatggtgaaaagactcggggactactctcgcaccaaggaactggccaaagttcatgatggcttccctgaccccgagacaggagagatcattgatcctgtcatgttccaacagcttcacgcccattttcccgacccttggccccacttccgggctgaactggaggcgagactcaacgtggatgacacggccgatctgcgcgctcggatggaactgtttggcacctatgccccggaggcccttgaaacactgagacctctcttcgtgtcccgcgctccccagagacggaacagcggggccgcgcacaaggacaccatctacgctcagcccgagcgcctgaaggagcaaggaggcgtcacacagaaagtgcctctcacctccctgacgcttaaggatctggacaaactcatcgatccgcatagaaatgaaaagctgtatgccgccattcgggctcgcctggaggcccacgggggaaaagcggacaaggcttttcccgccggcaaccctcttagaaagcccgatcgggaagggaatcctaccggccccgttgtgagaacagtcaccatggtgatcgacaaactgtctgggattcctgttcgcggcgggatcgccaagaacgacacaatgctccgggtggatattttcagacataaaaaggacggaaaatttcacctggtccccgtgtacgtttaccatgctgtggccaaggagttcccgaatcgcgctatcgtccaggccaaggatgaagacgagtggaccctcatcgatgacaaatttgatttctgttttagcgcgcaccctaacgacctgcttaagattacgcagaaatccggcgagacaatcttcgggtattaccggggatgccactctggcaccgccgctattaatatcgccctgcatgatagatatgcttacgccgaaaagacaaccagcctcgccttttccaaaaagaaccccggcaaacctattcccaatgacaagctggggctgatcgagggaattggcgtgaagatggctgcgaacatggaaaaattccacgtggatacccttgggaatatctatccggcccctcccgagcaacggcgcggactggcttga

SEQ ID NO: 4014 - RNA, 3441 nt, synthetic construct
  misc_feature 1..3441: note = Cas9 variant
  source 1..3441: mol_type = other RNA
atggcctacagactgggcctcgacatcgggattaccagcgtgggatgggctgtcgttgccctggagaaggatgaatccggccttaaacccgtgcggatccaggacctgggggtgcgcattttcgataaggcggaggactctaaaacaggagctagcctcgccctgcctagacgggaagcccgctccgctagacggcgcacgagacggcgcagacaccggctttggcgcgtcaagagactgctcgagcaacatggcatcctgtctatggaacagattgaggccctgtatgctcagcggaccagctccccggatgtgtacgccctccgcgttgcggggctggacagatgccttatcgccgaggaaatcgctcgggtgctgattcacatcgcccatagacgcggatttcagtctaaccggaaaagcgagattaaggattccgacgctggcaagctcctgaaagccgtccaagaaaatgagaaccttatgcagagcaagggctatagaacagtggcggagatgctggtttctgaagccaccaaaacagatgctgaggggaagctcgtgcacggaaagaagcatggctacgtctccaatgtgcgcaacaaggccggggaatatcggcacaccgtgagcagacaggctatcgtcgacgaggttcgcaaaattttcgccgcccagcgggctctgggaaatgatgtgatgtctgaagaactggaggactcctacctcaagatcctgtgtagccaaagaaactttgatgacggccccgggggagactctccttatggccacggctccgtgagccccgatggggtccgccagtccatttacgaacggatggtgggatcttgcacattcgagaccggcgagaaaagagcgcctcgcagctcctacagctttgagcggttccagcttctgacgaaggttgtgaatctcagaatctatcggcagcaagaagacgggggacgctacccctgtgagctgacccagacagagagagcccgggtcatcgattgcgcttatgaacagaccaaaattacatacggcaaacttagaaaactgctcgacatgaaggataccgagtcttttgccgggctgacgtatggactgaaccgctcccggaataagacagaagacaccgtgttcgttgagatgaaattttaccatgaagtgagaaaggccctccaacgcgctggcgtcttcatccaggatctgagcattgagacacttgaccagatcggctggattctgtctgtgtggaaaagcgatgacaacagacggaagaaactctccaccctggggctttctgataatgtcatcgaggaactgctccctctgaacggaagcaagtttggccacctgtccctcaaggccatccgcaaaattctgccgttccttgaggacgggtatagctacgacgtggcgtgtgaactggctggataccagtttcaaggcaagaccgagtatgttaaacagagactcctgccccctctgggggagggcgaagtgacaaatcccgtcgtgcggcgcgccctttctcaggccatcaaggttgtgaacgctgtcattagaaaacatggatcccctgagagcatccacattgaactcgcccgggagctgtctaagaatctggatgaacgcagaaagatcgagaaagctcagaaggagaaccagaaaaacaatgaacaaatcaaggacgagattcgggaaatcctcggctccgcccacgtgacggggcgcgatattgtgaaatacaagctgttcaagcagcagcaagagttctgcatgtatagcggagaaaaacttgacgttaccagactgtttgagcccggctacgcggaggtcgatcatatcattccgtatgggatctccttcgacgattcttacgacaacaaggtgctcgtgaaaacagaacagaatcggcagaagggaaacagaacccctctggagtatctgcgcgataaacccgaacagaaggccaaatttattgctcttgtcgagagcatccctctctcccaaaagaagaaaaatcatctgctgatggacaagcgggccatcgatctcgaacaggagggcttcagagagcgcaacctgtctgacacacggtacattaccagagctcttatgaatcacatccaggcctggctgctctttgatgaaacggcgagcacacgctccaaacgggtggtttgtgtgaacggggccgtcaccgcttacatgagagcccgctggggcctgaccaaggaccgggacgctggagataaacaccatgccgccgacgctgtggttgtggcgtgcattggcgatagcctgatccaaagagtcacaaagtatgacaagttcaaacggaatgcccttgctgatcgcaacagatacgtgcagcaggtttctaagtccgaggggattacccagtatgtggacaaagaaacaggagaggtctttacgtgggagagcttcgatgaacggaagtttctccccaatgagcccctggaaccttggccgttctttcgcgacgagctgctcgccagactgtctgatgacccctccaaaaacatccgggccatcggccttctgacctacagcgaaacagagcaaattgatcctatcttcgtgtctagaatgcccacccgcaaggtgacaggggctgcccacaaggagaccattcggagccctagaatcgtcaaagttgacgataataagggaacggaaattcaggtggtggtctccaaagtggcgctcaccgagctgaagctgacaaaagacggcgaaatcaaggactattttcgccccgaggatgacccgcggctttacaacaccctcagagaacgcctggttcagttcgggggcgatgctaaggccgccttcaaagagcctgtgtataagatcagcaaagacggatctgtccggacacccgtgagaaaggttaaaattcaggagaagctgaccctcggcgtgcctgtccacgggggacgcggcatcgctgaaaatgggggaatggtgagaattgatgtttttgccaaaggcgggaagtactacttcgtgcccatctatgtcgcggacgtgctgaagcgggagcttcctaaccgcctggctacggcccataaaccctactccgaatggagagtggtcgatgacagctatcaatttaagttctccctctacccgaacgatgccgttatgattaaaccttctcgggaggtggacatcacatataaggatcgcaaagaacccgtgggctgtagaatcatgtactttgtcagcgctaatattgcctccgcttctatcagcctgcggacccacgacaactccggagagctggagggccttgggattcagggactggaagtgttcgagaagtatgttgtgggccccctcggggacacacatcctgtctacaaggaaagacgcatgccgtttcgggtggagagaaaaatgaattga

SEQ ID NO: 4015 - RNA, 3441 nt, synthetic construct
  misc_feature 1..3441: note = Cas9 variant
  source 1..3441: mol_type = other RNA
atggcctacagactgggcctcgacatcgggattaccagcgtgggatgggctgtcgttgccctggagaaggatgaatccggccttaaacccgtgcggatccaggacctgggggtgcgcattttcgataaggcggaggactctaaaacaggagctagcctcgccctgcctagacgggaagcccgctccgctagacggcgcacgagacggcgcagacaccggctttggcgcgtcaagagactgctcgagcaacatggcatcctgtctatggaacagattgaggccctgtatgctcagcggaccagctccccggatgtgtacgccctccgcgttgcggggctggacagatgccttatcgccgaggaaatcgctcgggtgctgattcacatcgcccatagacgcggatttcagtctaaccggaaaagcgagattaaggattccgacgctggcaagctcctgaaagccgtccaagaaaatgagaaccttatgcagagcaagggctatagaacagtggcggagatgctggtttctgaagccaccaaaacagatgctgaggggaagctcgtgcacggaaagaagcatggctacgtctccaatgtgcgcaacaaggccggggaatatcggcacaccgtgagcagacaggctatcgtcgacgaggttcgcaaaattttcgccgcccagcgggctctgggaaatgatgtgatgtctgaagaactggaggactcctacctcaagatcctgtgtagccaaagaaactttgatgacggccccgggggagactctccttatggccacggctccgtgagccccgatggggtccgccagtccatttacgaacggatggtgggatcttgcacattcgagaccggcgagaaaagagcgcctcgcagctcctacagctttgagcggttccagcttctgacgaaggttgtgaatctcagaatctatcggcagcaagaagacgggggacgctacccctgtgagctgacccagacagagagagcccgggtcatcgattgcgcttatgaacagaccaaaattacatacggcaaacttagaaaactgctcgacatgaaggataccgagtcttttgccgggctgacgtatggactgaaccgctcccggaataagacagaagacaccgtgttcgttgagatgaaattttaccatgaagtgagaaaggccctccaacgcgctggcgtcttcatccaggatctgagcattgagacacttgaccagatcggctggattctgtctgtgtggaaaagcgatgacaacagacggaagaaactctccaccctggggctttctgataatgtcatcgaggaactgctccctctgaacggaagcaagtttggccacctgtccctcaaggccatccgcaaaattctgccgttccttgaggacgggtatagctacgacgtggcgtgtgaactggctggataccagtttcaaggcaagaccgagtatgttaaacagagactcctgccccctctgggggagggcgaagtgacaaatcccgtcgtgcggcgcgccctttctcaggccatcaaggttgtgaacgctgtcattagaaaacatggatcccctgagagcatccacattgaactcgcccgggagctgtctaagaatctggatgaacgcagaaagatcgagaaagctcagaaggagaaccagaaaaacaatgaacaaatcaaggacgagattcgggaaatcctcggctccgcccacgtgacggggcgcgatattgtgaaatacaagctgttcaagcagcagcaagagttctgcatgtatagcggagaaaaacttgacgttaccagactgtttgagcccggctacgcggaggtcgatcatatcattccgtatgggatctccttcgacgattcttacgacaacaaggtgctcgtgaaaacagaacagaatcggcagaagggaaacagaacccctctggagtatctgcgcgataaacccgaacagaaggccaaatttattgctcttgtcgagagcatccctctctcccaaaagaagaaaaatcatctgctgatggacaagcgggccatcgatctcgaacaggagggcttcagagagcgcaacctgtctgacacacggtacattaccagagctcttatgaatcacatccaggcctggctgctctttgatgaaacggcgagcacacgctccaaacgggtggtttgtgtgaacggggccgtcaccgcttacatgagagcccgctggggcctgaccaaggaccggaatgctggagacaaacaccatgccgccgatgctgtggttgtggcgtgcattggcgacagcctgatccaaagagtcacaaagtatgataagttcaaacggaacgcccttgctgaccgcaatagatacgtgcagcaggtttctaagtccgaggggattacccagtatgtggataaagaaacaggagaggtctttacgtgggagagcttcgacgaacggaagtttctccccaacgagcccctggaaccttggccgttctttcgcgatgagctgctcgccagactgtctgacgatccctccaaaaatatccgggccatcggccttctgacctacagcgaaacagagcaaattgaccctatcttcgtgtctagaatgcccacccgcaaggtgacaggggctgcccacaaggagaccattcggagccctagaatcgtcaaagttgatgacaacaagggaacggaaattcaggtggtggtctccaaagtggcgctcaccgagctgaagctgacaaaagatggcgaaatcaaggactattttcgccccgaggacgatccgcggctttacaataccctcagagaacgcctggttcagttcgggggcgacgctaaggccgccttcaaagagcctgtgtataagatcagcaaagatggatctgtccggacacccgtgagaaaggttaaaattcaggagaagctgaccctcggcgtgcctgtccacgggggacgcggcatcgctgaaaacgggggaatggtgagaattgacgtttttgccaaagatggcaagtactacttcgtgcccatctatgtcgcggacgtgctgaagcgggagcttcctaaccgcctggctacggcccataaaccctactccgaatggagagtggtcgatgacagctatcaatttaagttctccctctacccgaatgatgccgttatgattaaaccttctcgggaggtggacatcacatataaggatcgcaaagaacccgtggggctgagactgatgtactttgctggcgccgacatcagcggagctacccttacactgcggacccacgacaactccggcgagctcaaggggctgggcattcagggactcgaggtcttcgaaaagtatgtggttgggcccctgggagatacccatcctgtgtacaaagagagacgcatgccgtttcgggtcgaaagaaagatgaattga

SEQ ID NO: 4016 - RNA, 3447 nt, synthetic construct
  misc_feature 1..3447: note = Cas9 variant
  source 1..3447: mol_type = other RNA
atgaccaagctgaaccagccctacggcatcgggctcgacattggaagcaattccatcggcttcgccgtggtcgatgctaactctcaccttcttagactgaaaggggagacagccattggagcgcggctctttcgcgaaggccaaagcgctgccgacagacgggggtcccgcacgaccagacggcgcctgtctagaacacggtggcgccttagcttcctgagagatttcttcgcccctcatatcaccaagattgacccggactttttcctccggcagaaatattccgagatctctcccaaggataaagatcgctttaagtacgaaaagagactgttcaatgaccggacagatgctgagttttatgaagcctaccctagcatgtatcatctgcgcctcagactgatgaccgacgcttcccaggccgatccccgggagatcttccttgcgattcaccacatcctgaaaagcagaggacattttctcacacctggcgccgctaaggacttcaacaccgataaagttgacctggaggacatttttcccgcccttacggaagcctacgcccaggtgtatcctgatctggagctcaccttcgacctggcgaaggccgatgacttcaaagctaagctgctcgatgaacaagccacaccgtctgacacccagaaggctctggtgaatcttctgctctccagcgatggcgagaaagagatcgtcaagaaacgcaaacaggtgctgacagaatttgccaaggccattaccgggcttaagacgaaattcaacctggctctcggaacagaggttgacgaagcggatgcctctaattggcagttttccatgggccaactggacgataagtggagcaacatcgagacctctatgacagaccaggggaccgaaattttcgagcagatccaggagctgtaccgggctagactcctgaatggaatcgtgcccgccggcatgtcccttagccaagccaaggtcgctgactacgggcagcacaacgaagatctggagctctttaaaacctatctgaagaaacttaatgaccacgaactggccaagacaattcgcgtgatctacgatcggtatattaacggagacgatgcgaaacctttcctcagagaggactttgttaaggctctgacgaaggaagtgaccgcccatcccaatgaggtctccgagcagctgctcaaccgcatgggccaagccaatttcatgctgaaacagcggacaaaggctaacggcgccatccctgtgcagcttcagcaaagagaactggatcagattatcgctaaccagtctaaatactatgactggctcgccaagcccaatccggtggagaaacaccgcgcgagcaagccttaccagctggatgaactgcttacctttcggatcccctattacgtcgggcctctcattacacccaaggagcaagccaaatccggagaaaacgttttcgcttggatggtgagaaaggaccccagcggcaatatcaccccttacaactttgatgagaaagtggaccgcgaggcctctgctaatgtcttcattcagcggatgaagacgacagatacctatctgatcggggaagacgtgctgccgaaacagtccctcctgtaccagaagtatgaggttcttaacgaactgaataacgtgagagtcaataacgaggccctcggaaccgaccaaaagcagcggctgattcgcgaggtgtttgaaagacatagctctgttacaatcaaacaggtggcggataatctggtcgcccacggcgacttcgctcagcggcccgagatcagagggcttgccgatgaaaagcgcttcctcagctccctgtctacctaccaccaactgaaagagattctccatggagctatcgacgatagcacaaagctgcacgacattgaaaacatcattacgtggtccaccgtgtttgaggatgccgccatcttcaaaacaaagctggctgagattgactggctggatgcggccaccatcaaaaagctcagcaatatccggtatagaggctggggccagttttctcgcaagctgctggacgggcttaaactcggaaacggccagacagtcattcaagaactgatgctgtccaatcataacctcatgcagatcctgaccgatgagacgcttaagaccacaatggctgaactgaaccaggacaaactcaaggccgatgacattgaggacgtgatcaatgatgcctacaccagcccttctaacaaaaaggctctgagacaggttctgcgggtggtcgaagacattaagcacgccgcgaatgggcaagatccctcctggctttatatcgagacagctgacggacctggcaccgccgggaaacgcacgcagagcagacagaagcagatccaaacagtgtacgccaacgctgcccaggagctcattgattccgcggttcggggcgaactggaggacaaaatcgctgataaggcctctttcaccgaccgcctggtgctctactttatgcagggaggcagagatatttatacaggggctcccctgaatatcgaccagcttagccattacgatattgaccacatcctgccgcaatccctcatcaaagacgattctctggacaaccgggtcctggtgaatgctaccattaaccgcgaaaagaataacgtgttcaccagcacactttttgcctccaagatggctgccacgtggagaaaatggcacgaggcgggactgatcagcggccggaagctccgcaatctgatgctcagacctgatgaaattgacaaattcgcccatgggtttgttgctcggcagctggtcgagaccagacagatcattaaacttacagagcaaatcgccgctgcccagtatcccaacaccaagatcattgccgtgaaggctggactgtctcaccagctccgcgaggaactggatttccctaagaatcgggacgtgaaccattaccaccacgcgtttgatgccttcctggctgccagaatcggcacatatcttctgaaacgctacgccaagctcgctccctttttcacctatggggaatttgccaaagtcgacgtgaagaaatttcgggagttcaattttattggcgcgctgaagcatgctaaaaagaacatcgttgccaaggatacgggagagattgtgtgggacaaagaaagagatatccaggagctcgaccgcatttacaacttcaagcggatgctgatcacacacgaagtctactttgagaccgccgatcttttcaaacaaaccatctatgctgccaaggactccaaagaaagaggcgggagcaagcagctgattcctaagaaacgcggataccccacacaggtgtatggcgggatccatggaaagattcggctcacctggagatggctgaaactgcttcggcgcaagaaaatgtctatcgagctgtccgagctccagctgctcaagtga

SEQ ID NO: 4017 - RNA, 3450 nt, synthetic construct
  misc_feature 1..3450: note = Cas9 variant
  source 1..3450: mol_type = other RNA
atggagagataccacatcggcctggacattgggaccagctccatcggatgggccgtgattggcgatgacttcaagatcaaacggaagaaagggaagaacctcattggagtccgcctgtttaaagaaggcgatacagctgccgagagacgggggttccgcacgcaaagacggcgccttaatagacggaagtggcgcctgaagctcctggaagagatctttgacccctatatggcggaagttgataaatacttctttgctagacttaaggagtctaacctgagccctaaagactccaataagaaatatctcggatctctgctgttcccggatatcagcgactccaacttttacgataagtatcccaccatttaccatctccggcgcgacctgatggagaaggataaaaagttcgaccttagagaaatctatctggccattcaccatatcgtgaaataccggggcaattttctcgagaaggtgcctgccaaaaactacaaaaattctggcgctagcattgggttcctgcttgaagaggtcaacgatctgtatggaaatatcattggcaacgaggacgtggccatcctcgacaatgataaatttgaagacgttgagaagatcattctgaacgatgaaatccgcaatattgacaagcaaaagaacgtggggagactgctcgtcaaggataaaaaggagaaaaatatcgtgacagctttctccaaggccatttttggatacaagttcaacctggaagaccttctgctcatcgagagcgatgagaaaaacaagctgaccttcaatgacgaaaacatcgatgacatttttaatgagctttctcactccctgaacgataatcagatggacctcctgacaaaaacccgggaaatctatttcaagtttaaactgaacatgattgttcccacaggctacaccatcagcgagtctatgattgaaaagtatgagatgcataaggcgcacctcaaaatgtacaaggagttcatcaatacgctgaacgccaaagacagaaagatccttaaaaatgcttattccgattacattaacaatgaaaaggccaaggctgccaacgcgcaggagaatttttacaaaaccgtgaagaaaacaatcaaggaaaacgacagcgataccgccaaaaagattatcgggctgattgacgagggaaatttcatgcctaaacagcgcacaggcgaaaacggcgtcatcccccaccaactccatcagattgagctggatcggatcatcgagaaccaggctaagtattacccttggcttgccgaagagaatccggtggaaaagaacagaaaatttgctaagtataaactggacgagctcgtgaccttccgcgtcccctactatgttgggcctctgattgataagacggagtctaataaaaacgaaaaggagacaaagtttgcctggatggtgcggaaagccaagggaaccatcacaccctggaatttcgaaaacctggtggacagaaccgagtccgctaatcgctttattaaacggatgaccagcaaggatacatacatcattggcgaagacgtcctccctgcgtcctctctgctttatgagaaatacaaggtgctgaacgagctcaataacatcaaggttaataaaaagaaactggatgtggaacagaagcaacacgtctacctggaccttttcacgacccgcaaaaacgtgacaaaggatgacctcgccaccagcctgaattgcgacgttgagtccatcacagggctgaccgataacaagaaatttaatagctctctctccagctatattgacctgaaggctatccttggaaacattgtggatgactactctaaaaacgaagatctggagaagatcattgaatatagcacgatcttcgaggacggcaatatctacaaagagaagctctccgaaatttcttggctgacagatgagcagatcgaaaaactgagcaacattcatttcaaggggtggggaagactttccaagaaactcctgacccagatcaccaatgagaacggcgaacggattatcgacacactgtggaataccagcaacaattttatccaggtcatttctgatgagtccatccaagccaagctcgccgagattaacggcgaatatgctaataaatacaacctggaggacatccttgatgaagcctatacaagcccccagaataagaaagcgattagacaggtgatgaaggtcgtggaggacatcgagaaggctatgaaatgtgaaccgacgtctattgccatcgagttcacccgcgaaaagcggaaatccaagctgacaaacaccagatacaaaaagatcagcgagacatacgaaaagattaccgatgagctcatctccgagtatgaactggggaaactgcaatctgagcttgacagcaaggttaataacatgcgggaccgctactatctctactttatgcagctgggaagagatatgtatacgggcgagaaaatgaatattgacgaactgcaccagaagtacgatatcgaccacattctccctcagtccttcatcaaagatgactctctgaacaaccgggtgcttaccagcaagtccgtcaatatcaaggagaaaagcgataagacagccgctgacctgtatgccgctaaaatgggggatttttggagaaagctccgcaaacaaggactgatgaccgaacagaagtacaagaacctgcttacacggaccgactctattaataaatacacgaagcagtccttcatcaaaagacagctcgtggagacaagccaagttgtgaagctggccgcgaacattctgcaggataaatatcgcaataccaagatcattgaaatcagagcccggctcaactctgacctgcgcaaaaagtacgagcttatcaagaatagagaagtcaacgactatcatcacgctattgatggctacctgacaacctttgtggggcagtatctctacaaagtgtatcccaagctgcggtcctacttcgtttacgacgattttaaaaagctggacagcaattatcttaaacatatggataagttcaactttatctggaagctggaggacaaaaaggccgaagatgtctacgacaaagtgaatgatgagttcgtgctcaacgtccctgagatgaaggaatatattcgcaaaatctacaattataagtacatgctggtgtctaaggaggttaccacgaaaaacggcgctttttatgaccagacaaagtacaatgccaaaaccattaacctcatccccattaagaaagataagcccacaaatatctacggaggctataaggggaaagtgagctcctacatgatgctggtcaagatccagaaaaagaaagaagtgatttataagttcgttggagtgcctagactttggaccgacgagctggatcggctcatcgacacagacgagaaaaaggcgctgctgaagaaatga

SEQ ID NO: 4018 - RNA, 3459 nt, synthetic construct
  misc_feature 1..3459: note = Cas9 variant
  source 1..3459: mol_type = other RNA
atgaacgccgagcacggcaaggaagggctgctcatcatggaggaaaatttccagtacagaattggactggacatcggcattaccagcgtggggtgggctgtccttcaaaacaattcccaggatgagcccgttcggatcacagacctgggagtgcgcatttttgatgtggccgaaaaccctaaaaatggcgacgcgctcgctgccccgagacgggatgcccgcacgaccagacggcgcctgagacggcgcagacatcggcttgagcgcatcaagttcctgctccaggagaacgggctgatcgaaatggactcttttatggagagatattacaaaggaaatctgcccgatgtctatcagctccggtacgaaggcctggaccgcaagctgaaagatgaggagctggctcaagtgctcattcacatcgccaagcatagaggcttccggagcacaagaaaggctgaaaccaaagagaaggaagggggagccgttctgaaagcgacaaccgagaaccagaagattatgcaggaaaaaggctatcgcacagtgggggagatgctttacctggacgaggcctttcacaccgaatgcctctggaatgagaagggatatgtcctgacgcctcggaacagacccgatgactacaagcataccatcctgcgctccatgctcgtggaagaggttcacgctattttcgccgctcagcgggcccacggcaatcaaaaagcgacagaagggctggaggaggcctacgtggaaatcatgacctctcagcgcagctttgatatgggacctggccttcagcccgacggcaagccttccccgtatgctatggaggggttcggagacagagtcggcaaatgtacatttgaaaaggatgagtaccgggcccccaaagctacctatacggccgaactgttcgtggccctccagaagattaaccatacaaaactgatcgacgagtttgggaccggaagattcttttctgaggaagaacgcaagacaatcattggccttctgctcagctccaaggaactgaaatacgggaccatccggaagaaactgaatattgatcctagcctcaagttcaactctctgaattattccgctaaaaaggagggagagaccgaagaggaaagagtgcttgacacagagaaggcgaaattcgccagcatgttttggacgtacgaatattctaagtgcctgaaagatcgcaccgaggagatgcccgtcggcgaaaaggctgacctcttcgatcggatcggcgagattctgacagcctacaaaaacgacgattccagaagctctcggcttaaggaactggggctctccggagaggaaatcgacggcctgctggatctcagccctgccaagtaccaacgcgtttccctgaaagctatgagaaagatgcagccctatcttgaggacgggctgatctacgacaaagcctgtgaggcggctggatatgattttcgggccctcaacgacggcaataagaaacaccttctgaagggggaagagattaacgccatcgtgaatgatattaccaacccggtggtcaagagatctgtgagccagacaatcaaagttattaatgctatcatccaaaagtacggctcccctcaggccgtgaacattgaacttgctcgcgagatgagcaaaaatttccaggaccggaccaacctcgaaaaggagatgaaaaagagacagcaagagaatgaacgcgccaaacagcagatcattgagctgggaaagcagaaccccacgggccaagatatcctgaagtatagactctggaatgaccaagggggatactgcctgtattctggcaaaaagattcctcttgaggagctgtttgatgggggatacgacatcgatcatattctcccctactccatcacattcgacgatagctatcggaacaaagtcctggtgaccgcgcaggagaatcgccagaagggcaacagaaccccctacgaatattttggggccgacgagaaacggtgggaagattacgaggcttctgttcgcctgcttgtgagagactataagaagcagcagaaactcctgaagaaaaatttcacagaagaggagcggaaggaatttaaagagcgcaacctgaacgacaccaagtacatcacaagagtcgtgtataatatgattcggcagaacctcgaactggagcctttcaatcacccggaaaagaaaaagcaggtctgggccgtgaacggcgctgttacgagctaccttcgcaaaagatggggactgatgcaaaaggatcggtccaccgacagacaccatgccatggatgcggtggtcatcgcctgttgcacagacggcatgattcacaaaatctctcgctacatgcaggggcgggagctcgcttatagcagaaattttaagttccccgatgaggaaaccggagagattctgaaccgcgacaattttacacgggaacagtgggatgagaagttcggcgtgaaagttcctctgccctggaactccttcagagacgaacttgatatccgcctcctgaatgaggaccctaagaactttctgctcacccatgccgatgtgcaacgggagctggactaccccgggtggatgtatggagaagaggaaagcccgatcgaggagggcagatacattaattatatccgccctcttttcgtctctcggatgcccaaccacaaagtgacggggtccgctcatgatgccaccattagaagcgcccgggactacgaaacacgcggcgtggttatcaccaaggtccctctgacagacctcaaactgaataaggataacgagattgaaggatattacgacaaagattctgacagactgctttaccaggctctcgtgcggcagctgctgctccacggcaatgatgggaagaaggcgtttgccgaggacttccacaaacccaaggctgatggaaccgaaggccctgtggtccgcaaagtgaagatcgagaaaaagcagacgtccggggttatggtgagaggaggcacagggatcgccgccaacggcgagatggtccggattgacgtgtttagagaaaacggaaagtattacttcgttcccgtgtataccgctgatgtcgtgcgcaaagttctgccgaatcgggccgcgacacataccaagccttacagcgagtggagagtgatggacgatgctaactttgtcttctccctttattctcgcgacctgatccacgtgaaaagcaagaaagacattaagaccaatctcgtgaacggcgggctgctgcttcaaaaggaaatctttgcctactatacaggagccgatattgctacggcctccatcgcgggcttcgctaatgactctaactttaaattccgggggctgggaatccagagcctcgagatttttgaaaagtgtcaggtcgatatcctgggcaatatttccgttgtgagacatgagaaccgccaggagttccactga

SEQ ID NO: 4019 - RNA, 3462 nt, synthetic construct
  misc_feature 1..3462: note = Cas9 variant
  source 1..3462: mol_type = other RNA
atgaagaacatcctgggcctcgacctggggcttagctccattggatggtctgtgatcagagagaatagcgaagaacaggaactggtcgccatgggctcccgggttgtgtctctcaccgctgccgagctgagctccttcacacaagggaacggagtgtctattaatagccagcgcacgcagaaaagaacccagcggaagggctacgatcgctatcaacttagacggacactgctccgcaacaaactggacaccctggggatgctccccgatgactccctgagctaccttcctaagctgcagctctggggactgagagcgaaagctgtcacacagcggatcgaacttaatgagctgggccgcgtgctcctgcacctgaaccagaagagaggctataagtctattaaatccgattttagcggggacaagaaaatcaccgattacgttaagacagtgaaaacccggtatgacgagctcaaggaaatgcgcctgacgatcggagagcttttctttagacggctgaccgaaaatgccttctttcgctgcaaggagcaagtctacccgagacaggcctatgtggaggagttcgattgtattatgaactgccagcggaaattttaccccgacatcctcacagatgagaccattagatgtatccgcgacgaaattatctactatcagcggcctctgaagtcttgcaaataccttgtttccagatgtgagttcgaaaagcgcttttatctgaatgctgccggcaaaaagacagaggctgggcccaaagtgagccctcggacctctcccctcttccaagtctgcagactgtgggagtccattaacaatatcgtggtgaaggatcgccggaacgaaatcgtctttattagcgccgagcagagagcggccctgttcgactttctcaatacgcatgaaaagctgaaaggatccgaccttctgaagctcctgggcctttctaaaacatacgggtatcgcctgggagagcagttcaagaccggcatccaaggcaacaaaacacgggttgaaattgagagagctctcgggaattaccctgataagaagcgcctgctgcagttcaacctccaggaggaaagctccagcatggtgaacaccgagaccggagaaatcattccgatgatctctctgtcctttgagcaggaacccctttatcggctgtggcacgtgctctacagcatcgacgatagagagcaactgcagtctgtcctgcggcagaaattcggcattgacgatgacgaggtgcttgaacgcctcagcgccatcgatctggttaaggctgggtttggaaataaatcctctaaggccattagacggatcctgcctttcctccagctgggcatgaactacgcggaggcctgtgaagctgccgggtataatcatagcaacaattacacaaaagctgagaacgaggccagagcccttctggaccgcctccccgctattaagaagaatgaactgcggcaacctgtggtcgagaaaatcctgaaccagatggtgaatgttgtgaacgcgcttatggaaaagtatggaagatttgatgagatccgcgtcgaactcgccagagagctgaaacagtccaaggaggaacggagcaatacgtacaaatctattaacaagaatcagcgcgagaacgaacaaatcgctaagagaattgtggagtatggcgtccccacccggtcccgcatccagaaatacaagatgtgggaagagagcaaacactgctgtatttattgcggccagccggtggacgttggggatttcctgagaggatttgacgtggaggtcgaacatatcattcctaagtctctctacttcgacgattcctttgccaataaagtgtgtagctgccggtcctgcaacaaggagaaaaacaatcgcacagcctacgactatatgaagtctaagggcgaaaaagctctgagcgattacgttgagagagtgaacaccatgtatacaaataaccagatctccaagaccaaatggcaaaatcttctgacgcccgtcgacaagatctctattgatttcatcgaccggcagctccgcgaaagccagtacattgccagaaaagcgaaggagatcctgacatccatttgttataacgtgaccgctaccagcgggtctgtgacatcctttctgcggcacgtttggggatgggataccgtccttcacgacctcaatttcgatagatacaagaaagtgggcctgacagaggtgatcgaagtcaaccatcgcgggagcgtgatccggagagagcaaattaaggactggtctaaacgctttgatcaccggcatcacgccatcgacgccctgacgattgcttgcaccaagcaggcctatatccagagactcaataacctgcgcgctgaagagggccctgatttcaataaaatgtcccttgagcggtacattcagagccaaccccacttctctgttgcccaggtgagagaagcggtcgaccgcatcctggtgagctttcgggccggaaagagagctgttacacccggcaagcggtacatccgcaaaaacagaaagcggatttccgtgcagagcgtcctcatccctcgcggggccctgtctgaggaatccgtgtatggagttattcatgtgtgggagaaagacgaacagggccacgtcatccaaaagcagagagctgtgatgaaatacccgattaccagcatcaatcgggagatgctggataaggagaaggtggtcgacaaaagaatccatcgcattctttccgggcggctcgcccagtataacgataatcccaaggaagcgttcgccaaacctgtttacatcgacaaggagtgtcgcattcccatcagaacagtgcggtgctttgctaaacctgccattaacaccctggtgcccctgaagaaagatgacaagggaaacccggtcgcttgggtgaatcctggcaacaatcaccatgttgccatctatagagatgaagacgggaagtacaaagagcgcacggtgaccttctgggaagccgtcgatcggtgtagagtgggcattcccgctatcgttacacagcctgacaccatctgggataacattctccaacgcaatgacatctctgagaacgtgctggagagccttcccgatgtcaagtggcagtttgtgctgtccctccagcaaaatgaaatgttcattctgggaatgaacgaggaagactatagatacgcgatggaccagcaggattacgccctgcttaataaatatctgtaccgggttcagaagctctctaaaagcgactattcctttcgctaccacacagagacctctgtggaagataagtatgacggcaagcctaacctgaaactcagcatgcaaatggggaagctgaaaagagtctccatcaagagccttctgggactcaatccccacaaagtgcatatttctgtgctgggcgagatcaaggagatctcctga

SEQ ID NO: 4020 - RNA, 3474 nt, synthetic construct
  misc_feature 1..3474: note = Cas9 variant
  source 1..3474: mol_type = other RNA
atgaactactataatggcttcatcattaccgagaacgccatgacaagcaagcaggaaaaacacggggctctgacgtttggactcgacatcggcattgcctccgtggggtgggcggtcctgggagagtctagaatcgttgatcttggcgtgcggtgcttcgacaaggctgaaaccgccaaagagggggaaagcctgaatctcacacgcagaatggcccggctgcttcgcagacggctgcgcagacgggcttggcgcctcaccaagctggccagactgctcaaacgggagggactgattgctgatgccaacctttttaagcataagatcgagaaaaatacacccgtgcctaagtcctcttggcaactgcgcgtcgacggcctcgatagacagctgaacgcggaagagtgggcccgggtgatctaccacctttgtaaacatcgcggcttccactggattagcagagctgaagagaaggccgctgagggggactccaaaggagaaggcgggaaggttaagcagggactggccggcaccaaaaagctcatgcaggagaaatcttatcggacagcggccgaaatggtgctggctgagtttccggatgcccaaagaaataagcagggggactacagcaaagctctgtcccgcatcctcctgggagatgaacttaaggccctgttcgagcatcagcggaaactcggcaaccccgtcgccaccgagaagctggaagctgcgattcttggcaatggggacaagaaatgcggactgttttgggcccagaaccctgctctcgccggcaataagctgctggagatgctcgggagatgtacgttcgagaaaaccggaggcgatgacgggaagggagagtatcgcgcccccaaagctagcttttctgccgaacggcacgtgtggctgacacaccttaacaatctgagaatcgttgtggatggcaccacacgccctctcaacgaggcggagcggagagtcgctctgcccatgccttaccaacaggccggcgacctttcctataagcagctcgggggagccctcattaaggaaggcttcctgcagaaagacgggtttaagttcgctggactgccgtaccccaccaaacaagccagcgaggaaaaggctaaagatcctgagacgtctgtgctctgcaagctgcccgcctggcatacacttcgcaagaccctggaaaaacacggcctcgagtccgagtggcagaagctgagcacagacgcgctggatgggaaacctcagcttctcgacaatatcgcctgggtgctgtctgtctacaaggatgacgatgaagttaaaaccgagctgggcaagctcaacctgcccaacaccgaaaagatgattgacgcccttctggatatccggtttgacaaattctccaatctcagcctgaaggctctgtccaaaatcgtgccgttcatggagcaaggacagagatatgatgaggctgtggccaacattcctgaatacggccatcactctcagcttcacaaggtcggggcgggagagcataaatatctgccccctttttacaaggaacgcgacaaaacaggccggatggtgttcaatgacgatatggacatccccagaaaccccgttgtgctgcgggccctgaatcaggctcgcaaggtcgtgaacgccctcattaaggagtatgggagccctcacgaagttcatatcgagatggctagagatctgtcccggccgcttgacgagagacgcgatattgaaaaactgcaaaaggagtttggagaacggaataaaaaggacaaagaactcttcgcccaggattttaacatcgtgggcacggtcaaggggaagcagttcgaaaaataccagctgtatagagagcaacagggcaagtgtatctaccccagcatggacgagaaacagggaatttgctgttactctctgaagcctcttgatctccaccgcgtgctgtatgaagagggctacgccgaaatcgaccatgctctgccctattcccggagctttgatgactctaaaaataaccgggtcctcgtgctggcgaaggagaatcgcgataaggggaacagaacccctttcgaataccttggagacaaagacaatagcgagccctggcggcagtttgttgccttcgtggagggcaacaaggcttatcgcctggccaaaagatcccggctcctgcgcaaggattttggggacaaagaagccaaggagttcagagaacggaatctgaacgatacacgctacatttgcaagtttttcaaaaactatgtcgagcaataccttcagctccacgaggactctgaagctaagagatgtgtggttctgagcggacagatgacctccttcctgcgggccagatggggcctcgtgaaagtccgcggggatagcgaccggcaccatgcgctggatgctgccgtggtggccgcttgctctcacggcatggttaagagactttccgactacagccgccggaaagagctggaacaggtcagagagggatttgtggatgtggacacaggcgaaatcgtcaatccggccatgttccaacaggtgcaggagcattttcctaacccctggcctcacttccgcgatgaggttaagctccggctgtctattgacgatcccaccctgcttagatccgaaatggagaaatttgggacgtatacacctgaaagcctggaggcgctccgccccctgttcgtgtcccgggctccgcaaagaagaaattctggagccgcccacaaggacaccatctacgctcagcctaagcgcctcgtcgcccagggcggggtgacccagaaagttgctctgagctcccttacactgaaggacctcgataaactgatcgacccccatagaaacgaacggctgtatgccgcgattcgcgccagacttgagcaacacggaggcaagggggataaggcttttcccgcctctaatcctctgcggaaaccggacagcgagggcaaccccaccggacctatcgtgagaggcgtcacaatggtgattgataagctctccgggatccccattcgcggaggcatcgctaaaaatgacagcatggttcgggtggatgtcttcacgaaggccaacaaatttcatctggtgcctgtgtacgtccaccattctgttctcgggctgcccaatcaggccattgtgggaggcaaggaagagtccgaatggacccagatcgacgatagcttcgactggcacttttctatctatcctaacgatcttattagagtgacactgaaacaggagggccgcttcgggtactatgctggatgtgaccggtccaccgcggccatccacctctgggctcatgacagaaatcaacaggtcggcaaggatgggctgattcgcagcatcggagtgaagacagccctgtctattgaaaaatttaacgttgacgtgcttggcaatcggtaccccgccccgcctgagaagagacgcgatctggcttga

SEQ ID NO: 4021 - RNA, 3486 nt, synthetic construct
  misc_feature 1..3486: note = Cas9 variant
  source 1..3486: mol_type = other RNA
atgaagaaaatcctgggcctcgacctggggagcgcctccattggatgggctcttgtggaggaaaccgagcagatgcaatacaacatcgtctctctgggcagcagaattatcccctataatgggacagaaggacaggagttcgaaaagggcacgggggagtcccggaactctctccgcaccaaagccagaacagcgcggaagggatacgatcgctatcagctgagacggaaaaatcttgagaagattctgctccagaacggcatgtaccctaatgaacaagttcgcgctctgcagaagctggagctctggaaactgagagccgacgccccgaacgtgcagatcagccttcccgaactgggccggctcctgttttggcttaatcagaagcgcgggtataaatcctctagaagcgatgctaacctggacaagaaagataccgagtacgtggccacagtcaagtcccggcaccaaaagatcaaagacgctggacagaccgtgggccagtatttctacgggcagattctcgagaatgaataccatcgcatcaaggagcaagtttttcctagagaagcctatattgaggagttcgatgcgatcgtggcccggcagaaagaatactatcccacaattctgaagcaggagctgatcgacaaaattcgcaacgaagtcatctactttcaaagaggactcaagagccagaaaggcctggtgtctgtttgcgagttcgaagggcgggagtttaatggacacttcggcggccctaaggtggctcccaagtccagccctatctttcagcttgggaaaatttgggaaaacatcaataacattaagatcgccgatattgagctgaccgctgagcagaaactcgtcttctttaattatctgaactgtcatgaaagaatcacggaggccaagatccgcgaacttctgaaactctctaaggactcccggctgaacggacaactgaagaatggcctcaccgggaacaaaacatacagccagattgcgtcttgcttcggaaataagatcggcgagtatgaaagactgtttaaattcgagcttgaggtgattgaatccgagaagctggaatacacctaccacccgaaaagccatatccccgtgggggagaagcgccggaagtatatttccgagaacgtcgaaaaagagccttactatagactctggcacacaatctactctatcaaggataaagacgaatgtcgcgccgctctgattaagaatttcggaatcgaggaagagattgccgagaaacttgctagcctggatttttccgccggcggcttcgggaacaagtgcgccaaggttatccggaaaattctcccctatctgatggaaggagacaagtacaatgtggctatggactatgcgggctacaaccacagcttttctcagaccaaagatgagaatctgcagagagtgctcctggactccatcaaccatcttcctaagaatagcctgcgccaacccattgtcgaaaagatcctcaaccagatgatcaatctggtgaacgaggttattaagcagtgggggcggccggatgaaatcagagtggagctggcccgcaaacttaagcagtctaagacggagcggaatgacgatgacaacttcatgagaaaacgggaacgcgagaacgaaattatcaaggctgatctcgccaaatacggactgaaggccacaagaaataacgtcattaaatggcggctgtatcacgagatcgacgataaggacaagaaactcaatgctagatgtatctactgcggccaacctattagcctgaccgaagccatccttgggaacaatgtggatgttgagcatattatccccaaggacaaactgtttgacgattcccagtctaacaagacactcgcgcaccgcagctgtaattccggcaaaggaaacaagaccgcttatgacttcatgaaggataaacctcagtttgaggaatacgtggcccgggtcgaggaactgtataagaaacacctgattagccttaccaagaaaagaaagttcctcatgtctgaggacaagatcccctccgattttatcgaccgccagctgagagagagccaatacattgcccggaaatctcgcgaaatcctgcagacagtgtgcagaaatgtctggtccacggatggcggggtgaccgctcatctccggaagctgtggggatgggacgatgttacaatgaaccttcagatgcccaaatataagggcattgggatgaccgagatcgtggaatgggagagcaatcacggcaaaaaccaacatacacaggaagtcattaaggactggtccaaacgcgatgaccacagacatcacgccatcgatgctctggtggttgcctgtacccggcagggatacatccagcgcattaatacgctcaactctagcgagacaaaggacgagatgcacagaaaggtggcggggtccctggtcgagttcaatcaaaaacataccctgcttaacaagtacctcatcaccgaaaaaccttttacaacctctgaagtggaggacgtggttagcaagattctggtctccttcaaagccggcaagaaggctgccacaccgggaaaacggaaggtgggcaaacgcgggaacaaacaggtggtccaggatggaatcattatccccagaggcgctctgcacgccgacagcgtgtctgggtccattaaacagtatgatcctacgggaaattttgaaaaccataatgttatcaagtacaaggtgggcgtcgggaaaggctatctcttcgacggaaaggatgacaaaaagaaaatcgataagaccattgactgcatcgtggataagaaaattcgggacctgatcaagcaaagagcggaggagagcaactactctcttaaaaagatgttcgaaacacccattctgtttaatcagcgcgccgttttctccgtgcggtgtaaaaccggcaacaaggctgtcgtgcctatcagaaatgggtatgttgtgcccgataacaatcaccacacagccatctacaagtatgacggaggcctcaaagagcagtgcgtcagcctgatgcaggctattgaacgcaagcggtacaacctgccgatcattatcaaaaatcctaaggagatttacgataaaatcaccgaaatcgccaacattaatcaacttctctttgactctctgcccaagctggactgggagttcgtgacgaccctccagaaaaacgatatgtttatcctggggatggactatagcgccacagaggaagctcttgcggatggaaattacagactgctctccgagtatctgtacaaggtgcagaacattagcgacggcatctatcgcctgtgccatcacaccattacaaagttcgatctttctaaagccaacaagcctgacaaacggttttacaatatccaatccctgaaggcttggaacaccctcaatccccagaaagtcaagattaacatcctggggcagatcgaaagacagtga

SEQ ID NO: 4022 - RNA, 3501 nt, synthetic construct
  misc_feature 1..3501: note = Cas9 variant
  source 1..3501: mol_type = other RNA
atgcacgtggagatcgacttcccccattttagcagaggcgattcccacctggccatgaacaagaatgaaattctccgggggtctagcgtcctgtaccgccttggactggacctcggctccaactctctggggtggttcgttacccatcttgagaaaagaggagatcggcacgaacctgtggctctgggccccgggggagtgcgcatctttcccgacggcagagatcctcagagcggcacatccaatgccgtcgaccggcgcatggcgagaggggctcggaagcgcagagatcggttcgtggagcgcagaaaagaactcattgccgccctgatcaagtataacctgctccccgacgatgctcgggagcgcagagccctggaggttcttgacccttacgctctgcggaaaacggccctcaccgatacactgcccgcgcatcacgtgggcagagccctttttcacctgaatcaacgccggggcttccagtctaacagaaagaccgacagcaagcagtccgaagatggggctattaaacaggccgctagccgcctcgccacagacaagggaaatgagaccctgggcgtctttttcgcggacatgcatctgcggaaatcttatgaagatagacaaacagccatccgcgctgagctcgtgcggctggggaaggaccaccttaccggaaacgccagaaagaagatctgggctaaggttcgcaaacggctgtttggcgatgaggtgctccctagagccgacgccccgcatggcgtccgcgctcgggcgacgattaccgggacaaaggcctcctacgattattaccccaccagagacatgctgcgggatgagttcaatgctatctgggccggacagagcgcccaccacgctacaattaccgacgaagcccgcacggaaatcgagcatattatcttttatcagagacctcttaaacccgcgattgtgggcaagtgcacactggatcctgctacccggcccttcaaagaagacccggaggggtacagagccccttggtctcaccccctcgcccagcgctttcggatcctgtccgaggctagaaacctggaaatccgcgatacaggaaagggcagcagacggctcaccaaagagcaatctgacctggtggtcgccgcccttctggctaatcgcgaagttaagttcgacaagctcagaaccctgcttaaactgcctgcggaggcccggttcaacctcgaatccgatcgcagagctgccctggacggggatcagacagctgcccggctgagcgacaagaaaggatttaataaggcgtggcgcggcttcccgcccgagagacagattgccatcgtggctcggctcgaggaaacggaggatgaaaacgagctgattgcctggcttgaaaaagagtgtgctctggacggcgccgccgctgcgcgcgtggccaataccacactccctgatgggcattgcagactgggactgcgggctatcaagaagattgtcccgatcatgcaggacggccttgatgaggacggggtggccggagccggctaccacatcgctgccaaaagagcggggtatgatcatgctaagctccccaccggcgaacaactgggacgcctgccttactatggccagtggctccaggacgccgttgtggggtccggagatgcccgggaccaaaaagagaagcagtacggccagtttcccaaccctacagtccacattgggctgggacagcttagacgcgtggttaacgacctgatcgataaatatggacccccgaccgaaatttctatcgagttcacgcgggctctcaagctgagcgagcaacagaaggccgaaagacagcgcgagcagcggagaaatcaagacaaaaacaaggcgcgcgctgaggaactggccaaatttgggcggcctgccaatcccagaaaccttctcaagatgcggctgtgggaggaactggctcacgatcctctcgaccgcaaatgtgtgtacacaggcgagcagatttccatcgaaagactgcttagcgatgaggtcgacatcgatcatattctgcccgtggccatgaccctcgacgattctcctgctaataagatcatttgcatgcggtatgccaaccgccacaagagaaaacagaccccctccgaagcgttcggaagctctccgacactgcagggccatcggtacaattgggacgatatcgccgctagagccaccgggctgcctcgcaacaagcggtggagatttgacgctaatgcccgcgaggagttcgataaacggggaggctttcttgccagacaactcaacgaaacagggtggctggctcgcctggcgaagcagtacctcggagccgtcacggaccccaatcagatttgggtggttcccggccggctgaccagcatgcttagagggaaatggggcctgaacggactcctgccttccgacaattatgctggcgtgcaggataaggccgaggagttcctggcctctacagacgatatggaatttagcggggtcaaaaaccgcgctgaccacagacaccatgccatcgatggacttgtgaccgcgctcacagaccggtccctgctgtggaagatggctaatgcctacgatgaggaacacgaaaagttcgttattgagccgccctggcctaccatgcgcgacgatctcaaagccgctctggagaagatggtggtcagccataaacccgaccacggcatcgaagggaaacttcatgaggattctgcctatggatttgtgaaacctctggacgcgacgggcctcaaggaagaggaggctgggaacctggtgtacagaaaggccatcgaatccctgaacgagaatgaagttgaccggattcgcgatatccaacttagaaccattgtccgggaccacgtgaacgtggagaaaacaaagggcgtcgccctggctgatgccctcagacagctgcaggctcccagcgacgattatcctcaattcaaacacggactccgccatgtgcggatcctgaagaaagaaaagggcgactaccttgttcccattgccaatagagcgtctggggtggcctataaggcttactccgccggagagaacttctgtgtcgaggtgtttgaaaccgctggcgggaaatgggatggagaggccgttcgccggttcgacgccaataagaaaaacgctggcccgaagatcgcgcacgcccctcagtggagagatgctaatgaaggcgccaaactggtgatgcggatccataagggggacctcattcgcctggatcacgagggcagagcccggatcatggtcgtgcatcgcctggacgctgccgcgggaagatttaaacttgctgatcacaacgaaacagggaatctggacaagcggcacgccaccaacaatgacattgatcccttccgctggctcatggccagctacaacacgctgaagaaactcgctgccgttcctgtgagagtcgacgagctgggacgggtgtggcgcgtgatgcccaattga

SEQ ID NO: 4023 - RNA, 3507 nt, synthetic construct
  misc_feature 1..3507: note = Cas9 variant
  source 1..3507: mol_type = other RNA
atggccagacccgctttccgggcccctcgcagagagcacgtgaacggctggaccccggacccccatcggatcagcaagccctttttcattctggtctcctggcacctcctgtctcgcgttgtgatcgatagctcctctgggtgctttcccggaacaagcagagaccatacggataaattcgcggaatgggagtgtgctgtgcagccttaccggctttcctttgacctgggcaccaattctattgggtggggactcctgaaccttgatcgccaaggcaagcccagagaaatccgggccctggggagccgcattttctccgacggaagagatcctcaggacaaagccagcctcgctgtcgcccggcgcctggctagacagatgcggcgcagacgggatagatatctgacacgccggaccagactcatgggcgccctggtgcgctttggccttatgccggcggaccccgccgctcggaagagactggaggttgccgtggatccttacctcgctcgcgaacgggccacaagagagcgcctggagcccttcgaaatcgggcgggcgctttttcacctgaatcagagacgcggatataaacctgtccggaccgccacaaagcccgacgaggaagctggcaaggtgaaagaggccgttgagagactcgaagctgccatcgccgctgcgggggccccgaccctgggagcttggttcgcctggcggaagacgcgcggcgagaccctgagagcccggctcgctgggaaaggaaaggaagccgcgtaccctttttatcccgctagacgcatgctggaggccgagttcgatacactttgggccgagcaagctcggcatcaccctgacctgctcaccgccgaggctagagaaattctgcgccacagaatctttcatcagcggccccttaaaccccctccggtgggccgctgcacactgtaccccgacgatggcagagcccctcgggcgctcccctctgcccagcgcctgagactgttccaggagctcgcttccctgcgggtcattcaccttgacctgagcgaacgccctctcacccccgccgagagagatcggatcgtggctttcgtgcaagggcgcccgcctaaggccggaagaaagcccggcaaagtccagaagtctgttccttttgaaaaactgcgggggcttctggagctccctcctggaacgggcttctccctggagagcgacaagagacccgaactgctcggggatgagacaggagcgcgcattgccccggcttttggccctggctggaccgccctgccccttgaagaacaggacgctctggtggaactcctgctgacagaggccgagcccgaacgggccatcgctgcgcttaccgccagatgggctctcgatgaggccaccgccgctaaactggccggggcgacactgcctgacttccatggacgctatggccggagagctgtggccgaactcctgccggtccttgagcgcgagacgagaggggatcccgacggacgggtgcgccctattcggctggatgaagccgttaagctcctgagaggcgggaaagaccactctgacttttcccgggagggcgctctgcttgatgccctcccctactacggagcggtgctggaacgccacgtcgctttcggcaccgggaaccctgccgaccccgaggaaaagagagtgggacgggttgccaatcctacagtgcatatcgctctgaaccagctccgccacctggtcaatgccatccttgctagacatggccggcccgaggagattgtgatcgaactggccagagatctcaagcgcagcgcggaggaccggagacgcgaagataaacggcaagccgacaaccagaagagaaatgaggaacgcaaacggctgattctgtcccttggggagagaccgacccctcgcaacctcctgaagctgagactctgggaggaacagggacccgtcgagaatcggcgctgtccttattctggcgaaacaatcagcatgagaatgctgctttccgagcaagtggatattgaccacatcctgccctttagcgtttctctcgatgactccgctgccaacaaagtggtctgcctgcgggaagctaatcgcatcaagagaaaccggagcccgtgggaggccttcgggcatgattctgagagatgggccggcattctggctcgcgcggaagcccttcctaagaataaacggtggagatttgctcccgacgccctcgagaagctggaaggagagggcgggctgcgcgcccggcacctcaacgataccagacacctgagccggcttgctgtggagtacctgcgctgtgtttgccctaaagtgagagtctcccccggacggctcacggccctgctgcgcagacggtggggcatcgacgcgattcttgctgaagccgacgggccccctccggaggtgcccgccgaaacactggatccttctcccgctgagaagaaccgcgccgaccatagacaccatgcgctcgatgctgtggttatcggatgtattgaccggagcatggtccagcgcgtgcagctggccgccgcttccgccgaaagagaggctgccgcgcgggaggataatatcagacgcgtgctcgaaggcttcaaagaggaaccttgggacgggtttcgggccgagctggaaagacgcgctcggaccatcgtcgtgagccacagacccgagcacggcattggaggcgcccttcataaggagaccgcttatgggcctgttgatccgcccgaagagggattcaacctggtggtccgcaagcctatcgacggcctctctaaagatgaaattaattccgtgcgggaccccagactgcgccgggccctgatcgatagacttgccattcgccggagagacgctaacgatcctgcgacagccctggctaaggccgccgaggacctcgctgcccagcccgcgagccgcgggatcagacgggttcgcgtgctgaaaaaggaatctaatccgattagagtcgagcacggaggcaacccttccgggccccggagcggcggaccctttcataaactcctgcttgctggcgaggtgcaccatgttgacgtggccctgagagccgatgggcggcgctgggtcggacactgggtgaccctcttcgaagctcacggcgggagaggagccgacggcgcggccgctcctccccggctgggcgatggggagcgcttcctgatgagacttcataagggagactgcctgaagctcgaacacaaaggccgggtgcgcgtcatgcaagttgtgaagctggagccttcctctaatagcgtggtcgtggttgagccgcatcaggtgaaaacagatagatccaagcacgtcaaaatctcttgtgaccagctccgggcccgcggggctagacgggtgacggttgatcccctgggacgcgtgagagtccatgcccctggcgctcgggtggggatcggaggcgacgccggccgcaccgcgatggaacccgccgaggatattagctga

SEQ ID NO: 4024 - RNA, 3513 nt, synthetic construct
  misc_feature 1..3513: note = Cas9 variant
  source 1..3513: mol_type = other RNA
atgagcaagtacaacgtgggcctggacatcgggattgcctccgtcggatggtctatcgttgatgctgacaaaaagaaaattatcgatctcggcagcagaattttctcctctgggaatgccgcggctaaccaggagcggcgcggatttagaggcacccggcgcctgatcagacggcgcaagaatagacttacagacgtgatcaacttctttggggaaaagaagttcattgatacgaaggtggtcgacaaaaatggacacgtgcattataagtttagcgttaacaataccgagtccccctacgaactgcgggtgaaaggcctctctgagatcctgacaaagcaagaacttgtcattgccctgtatcacatcgtgaaacatcgcggcattagctacgatctcggggacctggaggatgacggaacctccggcgttacagattataagaccagcatcaacattaatagacagctgctcaacgagaagacagtggggcagatccagctggaacggcttaatgagttcggaaaagtccgcggccaagtggaagagaacgagaatgtgaccctgctcaacgtctttccttctgccgcttacgttaaggaagccacgcagatcctgaccaaacagagagagttctatccggaaattacagacgattttatcgctaagttcatgctttttattacccggaaacgcgactacttcgtggggcccggaaatgagaagtccagaacagactacggcatctataaaaaggatggccggaccctggacaacctctttgatgaactgattgggatcgacaagatcaacggagagaaaagagccagcgcgtcttccctgacggcccagatttacaatatgctcaacgatctgaataaccttacagtgcctaataccgaggacggccgcctgacaatccaaaccaagaaagaaattctcgaggctgccaagaccacaaacgggctgttcggaatcgctcagatttgcaaaatcatcggctgtaagaaggatgacattaaagggttccggatcgataagagcgagaaaaagattatgcacacgctttctggatatagaaaatttcgcaaggaactggccgacgtcaatatcgaagcgaacgatctcaatattaacctggtgaataagatcgccgacattctgaccctcaacacagagaaagctgagatccggaagcagctggacaaatccaatatggatatcagcaacgaaatgaaggagattgttatcaataaaaacaaggagttccttgtggacggcagagccacctggcattccttttcttacaagacactgaacctcctgattcccgaacttctgaatacccctgaggaacagatgacgatcctcacacgcctgggcctggtcaaacccaacaataagaaatatgaggggctcaagaacattcctgctcggagaatcaccgaagagatctacaatccggtggttgcccgcgccacccgggaagctgtgaacgtcttcaatgcgattaccaaaaaggtgggaagagataacatcaaagacgtcattatcgagctgccccgcgaggataatgaagtggacattaagaagggcatcgttaaacggcaaaagcagaacgaggtggaaaaagagacagccgatgctcttgtcaagcagcacatgacaatcagcgactccgccctgattgcccaatatagaaaaatccgggggctcagccagaaggtgcgctactggtaccagcaggatacgatttgcccttattgtggaaagaaaatcgaagctgttcaactgattaataacaatgactcttttgaggtggatcacatcgtccccatctccgtgagcttcgacgattctcagaacaataaggtgctggttcatagccagtgcaaccaggccaaagagaagcaaacccctcttggctggctcaacaatgggggcggatttggccagtccaaagcggactacattgctagagtcaagtctaacaagaattatgccaaaaacaagatcgacaatctgctgaacgaaacagatctcaatgacattgccacccagcgggggttcatccagagaaacctgaatgatacacgctacgctagccggattgtgcttaacgagttttattccttctttagaagcaataacctgtctaccaaagtgaaggtcgtgcgcggaaaatggacgtcccaaatgagaaagaagtggaatggcgttgggggactcagcaaaacccgggacacataccaccatcacgccatcgatgcttgtattatcgcctgcttccccctgctgaaggcgtttgacaaagccatcaaacttattgatgtggacggcgaaaccggggagatcctccaggataaaaaggctattaaactggcccaggaagctgagatcgtcgagaagatttctgtgatcaagaacaaaaagttcgaaaatatggttaacgagatctataacttcccgctgtttaaacaggtggaactcgccaatgacattacaaacctggagaatcctgtcaagttctcccaccatgtggataaaaaggcgaaccgcgccgttgctaatcaaaccatctacggcacgagaattaaggaaaaagaggtgacaaagcggggcaaaaaggagaaaatccaggaacgctacacccttggaacaattaagaacatctatgacatcgatgggtttatgaatttcaagaaactgtacgacaagattagcaaaaacgacgatgtcaagtttctcatgcagaaaaatgaccccaagacctgggagaagctgatcgatattttcaactcctatcctgactctgaagaggtgacccaagtggatggaaaagtcaagagagttgccgtgagcccctttaaactgtactatcgggagaatggcttcatcacaaagtactccaaacacaacgacgggcccaaggtggtctctattaagtattacgatagcaaagtgggatcccatatcgacattacgcctaaggatgctcgcaataaagttatccttcagagcctcaagccgtggagaaccgacgtgtactttaactctatcacacagcagtatgaactgctgggcctcaaatactccgatctgaagttcaccaatggggtctatggcattacacgggacgcctacgagaaacttaagcacggagtgagcgaagacggcgttaccgcctggaagcccatctctaaaaactccgagtttcgcttcagcctgtatagaaatgatcgggtgagagtcattgacgaaaagggggattctatcgagctcctgtttgctagccgcacgacatccaacgagggatacgtggaactgaaacctatttataaggcgaaattcgacagcaaggaggaagttggcttctacgggcttgtgtctaacggacggctcatcaagaaaatgtccaagggcgggtacaaactgtataaggtcaataccgatatcctgggcaaaccctactatgtgaccagagagagcgacgaacctaagctctccctgtga

SEQ ID NO: 4025 - RNA, 3516 nt, synthetic construct
  misc_feature 1..3516: note = Cas9 variant
  source 1..3516: mol_type = other RNA
atggccaagtacagcgtgggcctggacatcgggatttcctctgtcggatgggctatcattgatatcgagaccaaacagattgttaacctcggcagcagaatcttcccctccgggaatgccgcgggaaaccaagaacggcgcggctttagagggatccggcgcctgattagacggcgcaagaatagacttacagacctgaaaaagctcctgggagagacgttcttttctgatcttaaaaagatcgacagcaacggctatgaatactatgatattgacttccagatcaatgctaacccttacgagctgcgggtgaagggcattaccgaaaaactctccaagaaagagctggccgtggtcctgcaccatatcattaagcaccgcgggatctcttatgatctcggagacctggaggatgacggcacaagcggggtgtccgattacaaaaatagcatcaacattaatagacagcttctgcgggaaaagaccgttggacagatccaactcgagcgcctgattgaatttaaccaggtgcatggccaggtcaagaaagccgaggacgtgtctcttctgaatgttttcccgtccagcgcttatagagatgaggccaacaagatcatgattaaacagcaagaattttactctgagatcacaaattccttcatggaacaggtggaccagctcgtcagccggaagcgcgactactttatcgggcccggaaacgagaaatctagaaccgattatggcatttacaagtccgacggccggacactggataatctgttcgctgaactcatcgggaccgacaaaattaacggagagaagagagccagcgcgtcctctctgacggcccaggtgtataaccttctgaatgatctcaacaatctgcacgtgagcaacaccgaggacggcaagctcacaacctccacaaagaaggaaatcattaaagctgccaagaccacggatggggtctttggaatcagccaaatctgcaaaattatcggctgtaagaaggaggaaattacagggttccgccaggacaaatctgagaagaaagttatccataccctggctggataccggaagattagaaaagccctcgcgacaatcaatattgaagccaacgagctgaatcctaccgtgtttgatcagatcgctgacatcctgaccctcaacacagagaaggccgaaattcgcaagcaactggataaagtgcagcttgacatcacggacgagatgaaggaactggtcattgataaaaataaggacttcctcgtggatggccgggctacctggcactccttcagctatcagacactgaacatgcttatccccgagctgctcaatacctctgaggaacagatgacaattctgaccagaatgggcctgatgaaaagcgacaacgagaagtaccgcgggctcaagaaaatccctgccgaaaagatcgcctccgagatttttaatcccgttgtggctaaatctacgcgggaagcgatcaaggtcttcaacgccattagcaaagagatcggaaagaataacattgagcacgtggttatcgaactgcctagagatgacaacgaggaagatgagaaacgcaagatccaaaaacttcagaaagctaatgaaacagagaaggaggccgccgacaacctggtgaaacataagctcggcatttccgatagcgctctgatcgcccactatcggaaatttaaggggctgtctcagaaggtcagatactggtaccagcaagaaacctattgcccgtactgtggaaaaattatcgaggcgacccagcttattaataacaatgacaacttcgaagtggatcatatcatccccatttccgtcagctatgacgattctcagaataacaaggtgctcgttcactcccagtgcaatcaagctaaagagaagcagacacctctgggctggatcaacaatgggggcggatttggccagagcaaaaacgaatacaccaatcgcgtgaagaacaataagaaatattccaagaacaaagtcgacaacctgctcaatgagacagacctgacggatattatcacccagcggtctttcattcaaagaaaccttaatgacacacggtacgccgcccgcaccgtgctggatgagttttatagcttctttaagtccaacgacctccccacaaaagttaaggtggtcagagggaagtggacctctcagatgcggagaaaatggaataacgtgggaggcctgcgcaagacgcgggatacccaccatcaccatgctatcgacgccagcattatcgcttccttccctctgcttagagcctttgatcgcgcgatcaaactcattgacgtggataaggaaacaggggagatcgttcagtacggaaaagccagcctgaatggcgacgtcattgaagagaagtctgtgatccaagctcccattatcaaaaacgaaaagttcgagaagctggtggatgagatctacaattttccgcttttcaaacaggtcgaactggccaacaatattgagaaccctgaaaatcccgtgaagttctcccaccatgttgacaaaaaggctaacagaaccgtggccaatcagacaatctatagcacccggattaaaaagacggagaagatcgtccgcaaaaaggtgacagcgaaagaggaagagtacgttattgggaccatcaaggatatctatgacgtgacaaactttgaaaaattcaagaaactttacgacgagtcttccaaaaaggatgacattaaatttctgatgcagaagaacgatcctaaaacctgggaaaagctcgtcgagatcatgaatacctatcccgactacgaggaaattagccaactggatggcaaggtgaaaagagttaaggtgtctcccttcaaactgtattttcgggagaacggattcatcacaaagtacgccaaacacaataacggccctaaggtcgtgagcattaagtactatgactccaaacttgggaatcacatcgatattacgccggtgaacgctaataacaaggtcatcctccagagcctgaaaccctggcgcaccgacgtttactataataacgaaacacagcagtacgagctgctcggactgaagtattctgatcttaaatttaccaagggcgtgtacgggatcacaagagaagcctatgagaaactgaagtacggatacaccgacggcgtgcctgcttggaagcccatttccaaagagagcgagttcaagttttccctctatcggaatgatcgcgtcagaatcattaacgaagccggggaaaagatcgacctgctgttcggctctcggaatgagacgagcgaaggatacgtggagatgaagcctatttttaaaacaaacttcgacgatgccgaggaggcttccttttatggcaagacctctaataagcgccttatcaaaaagatggcgagaaaagggtaccaaatctataaggttaacaccgacattctcggaaatctgtactatacagccaaagaaagcaacgaacccaagctggatctctga

SEQ ID NO: 4026 - RNA, 3519 nt, synthetic construct
  misc_feature 1..3519: note = Cas9 variant
  source 1..3519: mol_type = other RNA
atgagaaagccctacagcatcggcctggacattgggaccaactccgtgggatgggccgtcatcacagatgactataaagttccttctaagaaaatgcggattcagggcacgaccgatcgcacaagcatcaagaaaaatctcattggggctctgcttttcgacaacggagagaccgccgaagcgacaagactgaagcggaccacacgcagacggtacacccgcagaaagtatcggatcaaagagctccaaaagatcttttcctctgaaatgaatgagctggatattgctttctttccgcgccttagcgaatccttcctggtgtctgacgataaagagtttgagaaccaccccatcttcggcaatctcaaggacgaaattacgtaccataacgattatcctaccatctaccacctgagacagacactggccgacagcgatcagaaagccgacctccggctgatttatcttgctctggcccatatcattaagtttcgcgggcacttcctcatcgagggaaatctggattccgaaaacaccgacgtgcatgtcctttttctgaatctcgtgaacatctacaataacctgttcgaggaggacattgttgaaacagctagcatcgatgccgagaagattctgacctctaaaacgtccaagagcagacggctcgaaaatctgatcgcggagattcccaaccagaaacgcaatatgctttttggcaacctggtgtctctcgccctgggccttacacctaacttcaagaccaattttgaactgctcgaggacgctaaactgcaaatctccaaggatagctacgaggaagacctggataacctcctggcccagatcggggaccagtatgctgatcttttcattgccgcgaaaaagctgtctgacgccatcctcctgtccgatattatcacagtcaagggagctagcaccaaagctcccctttccgcctctatggtgcagagatacgaggaacaccaacaggacctggccctcctgaagaatctggttaaaaagcagattcctgagaaatataaggaaatcttcgataacaaggagaaaaatggctacgccgggtatatcgacggaaagaccagccaggaggaattttacaaatatattaagccgatcctcctgaaacttgacggcacagagaagctgatttccaagctcgaacgggaggatttcctgagaaaacaacgcacgtttgacaacgggagcatcccccaccagattcatctgaatgaacttaaggctatcattcggagacaggagaaattctacccttttctcaaggagaaccaaaagaagatcgaaaagctgttcacctttaaaatcccctactatgtgggacctctggcgaatggccagtcttccttcgcctggctcaagcgccagagcaacgagtctattacaccctggaattttgaagaggtcgtggatcaggaggctagcgcccgggccttcatcgaaagaatgaccaactttgacacatacctgccggaggaaaaagtgcttcctaagcactctcccctgtatgagatgttcatggtctacaatgaactcaccaaagttaagtatcaaacggagggcatgaaacgccctgtgtttctgtccagcgaggataaggaagagattgtgaacctgcttttcaagaaagaacggaaggtcacagtgaaacagctcaaggaggaatacttctccaaaatgaagtgctttcataccgttaccatcctgggggtggaggacagattcaatgctagcctgggaacatatcacgatctcctgaagatttttaaagacaaggccttccttgatgacgaggcgaaccaggatatcctggaagagatcgtctggaccctcacactgtttgaagaccaggctatgattgagcgccggctggtgaaatacgccgatgttttcgaaaagtctgtgcttaaaaagctcaagaaaagacactacacgggctgggggcgcctgtcccaaaagctgatcaacggaattaaagacaagcagaccggcaaaacaatcctcgggtttctgaaggacgatggagtcgccaatcggaacttcatgcagcttattaatgacagctctctggattttgctaagatcatcaaaaacgagcaggagaagaccattaaaaatgaatccctcgaggaaacaatcgccaacctggctggcagccccgccattaagaaaggcatcctgcaatccattaagatcgtggacgagatcgtcaaaattatggggcagaatcccgataacatcgtgattgagatggcgagagaaaatcagtctaccatgcagggaatcaagaacagccggcaacgccttagaaagctcgaggaagttcataaaaatacgggctccaagattctgaaagagtataacgtgtctaatacccagctgcagagcgaccggctctacctgtatcttctgcaagatgggaaggacatgtacacaggaaaagaactcgattatgacaacctgtcccagtacgatatcgaccacattatccctcagagcttcatcaaggataattctattgacaacaccgtcctgacaacccaggcctccaacagaggcaagagcgacaatgtgccgaacatcgagacggttaataaaatgaagtctttttggtataaacaacttaagtccggggctattagccagcgcaaattcgatcatctgacaaaggccgagcggggcgctctctctgactttgataaggccggattcatcaaaagacagctggtggaaacccgccagattacaaagcacgtcgcgcaaatcctcgacagcagattcaactccaatctgaccgaggatagcaaatctaaccggaatgtgaagatcattacccttaaatccaagatggtgagcgactttcgcaaggatttcggcttttacaaactgagagaagttaacgactaccatcacgcccaggatgcttatctcaatgccgtcgtggggacagctctgctgaagaaataccccaaacttgaggccgaatttgtgtatggagactacaaacactatgatctggccaagctcatgatccagcctgactcctctctgggcaaggctacgacccggatgtttttctacagcaacctcatgaatttcttcaaaaaggagattaaactggcggacgatacaatctttacccgcccccagattgaggtcaacacagaaaccggggagatcgtgtgggacaaggttaaagatatgcaaacgatcagaaaggtgatgtcctatcctcaggtcaatattgtgatgaaaacagaagttcagaccggaggcttctctaaggagagcatctggcccaagggggactccgataaacttattgcccggaagaaatcttgggacccgaagaaatacggcggatttgatagccctatcattgcttactccgtgctggtcgtggccaagaactgtaagcgcaaaaatagcaagaccaaaaactatcaaagaacatgcggcaacaagaataacgggacccggtga

SEQ ID NO: 4027 - RNA, 3522 nt, synthetic construct
  misc_feature 1..3522: note = Cas9 variant
  source 1..3522: mol_type = other RNA
atgagacccatcgagccttggattctgggcctcgacatcgggaccgatagcctgggatgggccgtgttctcctgcgaagagaagggcccgcccacagctaaagaacttctcgggggaggcgtccggctgtttgactctgggcgcgatgccaaggaccacacgagcagacaggcggagcggggagctttccgcagagcccggcgccaaaccagaacatggccttggcggcgcgatagactgattgccctttttcaggctgccggcctgacacctcccgctgccgaaacccggcagatcgcgctcgccctgcgcagagaggctgtttcccggcccctggcccccgacgctctctgggccgcgctgcttcatctggcccaccatcgcggcttcagatctaaccggattgataaaagagagcgcgctgccgctaaggccctcgccaaagctaagccggcgaaggccaccgctaaagccacagcccccgctaaggaagccgacgatgaggcggggttttgggaaggagctgaggccgccctgcggcagagaatggctgccagcggcgctcctaccgtgggggcccttctggcggacgatctcgaccgcggacaacccgtgcggatgagatacaatcagtccgatcgcgacggcgtcgtggcccctacgcgggctctgatcgccgaggaactggctgagatcgttgccagacagtctagcgcgtatcccgggctcgactggccggccgtgacccgcctggtccttgatcagcggcctctgagatccaaaggagctggcccctgtgccttcctccctggcgaagaccgcgctctgcgggcccttcccacagtgcaagattttattatcagacagaccctggccaacctccggctgcccagcacatctgctgacgagcctcgcccgctgaccgatgaggaacacgcgaaggccctcgctctgctttccacggccagattcgttgagtggcccgccctgcggagagctctcgggctgaaacgcggagtgaagtttacagccgaaaccgagcggaatggcgcgaagcaggctgccagagggacagccggaaaccttaccgaagctattctggcccctctcatccccggctggagcgggtgggacctggatcgcaaagacagagtcttctctgatctgtgggcggctcggcaggaccgctccgccctcctggcccttattggagatcctagaggccccacccgggtgacagaggacgaaacggctgaggccgtggctgacgccatccaaattgtcctgccgaccggccgcgcgagcctctctgccaaggctgccagagctatcgcccaggccatggctcctgggatcggatacgatgaggcggttacactggccctgggccttcatcactcccaccggccccgccaggaaagactcgctcggctgccttattacgccgccgctctgcccgacgtggggctcgatggagaccctgtgggacccccgcctgccgaggatgacggggcggctgccgaagcctattacggccgcattggaaatatcagcgtccatattgctctgaacgagaccagaaaaatcgtgaatgcccttctgcaccggcatggccccattctcagactggttatggtggaaacaacccgcgagctgaaggcgggggctgatgagcggaaaagaatgatcgccgaacaagccgagcgcgaacgggagaacgctgagatcgacgtcgaacttagaaagtccgatcgctggatggccaatgctcgggagagacgccagcgggtgagactcgcccggcgccagaacaatctgtgcccctatacgtctacacctattggacacgcggacctgctcggcgatgcctacgacatcgatcacgttattccgctggctagagggggacgggacagccttgacaacatggtgctgtgtcagtccgatgccaataaaaccaagggcgacaagaccccctgggaggcttttcatgataaacctgggtggatcgcccaacgcgacgatttcctcgccagactggacccccagacagctaaggcgctggcctggcggtttgctgatgacgccggcgaaagagtcgcccgcaaaagcgctgaagatgaggaccagggattccttcctcggcagctcaccgatacaggctacattgccagagtggcgctgcgctatctgtctctcgtcacgaacgagcccaatgctgtggttgccaccaacgggcggctgacaggacttctgagactcgcctgggacatcacccctggccccgctccgcgcgatctgctgcctacaccccgggacgcccttagagacgataccgcggcccgcagattcctcgacgggctgacgcctcccccgctggctaaggccgtggaaggagctgtccaagcccggctcgctgccctgggccgctccagagtggcggatgccgggcttgctgacgccctgggcctcaccctggctagcctgggaggcgggggcaaaaaccgggccgatcaccgccatcactttatcgacgccgctatgattgcggttacaaccagaggccttatcaatcagattaaccaggcctctggggctggacggatcctggatctcagaaagtggcctcgcacaaatttcgagcccccttaccccacctttcgggccgaagtgatgaagcagtgggaccatattcaccccagcatcagacctgcccaccgcgatggcgggtccctgcatgctgccacggtcttcggcgtgcggaacagaccggacgcgcgggtgctcgttcaacgcaaacccgtcgagaagctgtttcttgatgccaatgctaaacctctgcccgccgacaagattgctgaaatcatcgacggattcgcctctcctagaatggcgaaacggtttaaggccctcctggctcgctatcaggccgctcaccccgaggtgcctccggccctggctgcccttgcggtggccagagatcccgctttcggccctcgggggatgacagccaacaccgtcattgctggacgcagcgacggcgatggggaggacgccggactgatcacaccctttagagccaatcctaaggcggctgtgcggaccatgggcaacgccgtttacgaagtgtgggagattcaggtcaaaggccgccccagatggacccatcgggtgctcacaagattcgatcgcacgcagccggctcctcctccccctcccgaaaatgcccggctggttatgagactccgcagaggggacctggtgtattggcctcttgagtccggagatcggctgtttctcgtcaagaaaatggccgtggacggccgcctggctctgtggccggcccggcttgcgaccgggaaggccacagctctgtacgcccaactcagctgccccaacatcaatctgaacggagatcagggctattgtgttcagtctgctgaagggattagaaaagagaagatccgcaccacatcctgcaccgccctcggacggctgagacttagcaagaaagcgacgtga

SEQ ID NO: 4028 - RNA, 3525 nt, synthetic construct
  misc_feature 1..3525: note = Cas9 variant
  source 1..3525: mol_type = other RNA
atgggcaagtacagcatcgggctggacattggaatctcctctgtgggctggagcattatcgatattgagaaaaagaaaatcgtcgacctcgggtccagaatcttcccctctggaaacgccgctgccaatcaggatcggcgcggctatagagggacccggcgcctgattagacggcgcaagaacagacttgcggacgttatcaattttctgggagaagagaacttcattgatacaaaagtggtggaccaaaatggcaacatccactacaagctcctggtcaatagcacggaatccccttataaacttcgggtgaagggcctgtctaagatgctcaccaaacaggagctggttattgctctgtaccatatcgtgaagcaccgcgggattagctatgatctcggagacctggaagatgacggcacatccggggtcaccgattacaaaacaagcatcaacatcaatagacagcttctgattaagaagaccgtgggacagatccaactcgagcggctgaaagagtttggcaaggttcgcgggcatgtgaaaaaggacgaaaacattacacttctgaatgtcttcccgtcttccgcctatgtgaaagaggccacccagatcctcacgaagcagagagaattttaccccgagattaccgatgacttcatcacaaaatttatccctttcattagccggaagcgcgactactttgtgggacccggcaacgagaagtctagaaccgattatggcatctacaaaaaggacgggcggacactggataatctgttcgacgaactcattggaatcgataaaatttccggcgagaagagagctagcgcctcttccgtcaccgctcagatctataacatgctgaatgaccttaacaacctgacggttacaaataccgaagatgggaaactcacaacccaaaccaagcgcgagatcattgaagccgacaagacaacgaacggactgtttggcatcacccagatttgcaaaatcattgggtgtaagaaagatgacatcaagggattccggattgataaagtggagaagcctatcatgcacacacttagcggctacagacgctttcggaaggagctggcgaaaatcaatattgaagccaacgacctcgacatcaatctggtgaacaagattgctgatatcctgaccctcaatacagagaaagccgaaattagaaagcagctgaacaaatccaatatcgacgtctctaacgagatcaaggaacttattatcaataagaacaaagatttcctggtggacggccgcgctacctggcatagcttctcctataagacgctcaatctgcttattcccgagctgatgaacacaagcgaggaacagatcaccattctcacccggctggggctggttaaatctaattccgagaagtacaaaggactcaagaacatccctgccagacgcatcacagaaggcatttataacccggtggtcgcgaaagccacccgggaggctgtgaatgtttttaacgccatcgctaagaagattgggagagataatatcagcgacgtggtcattgaactgccccgcgaggataacgaggccgacatcaaaaagggaatcgtgaaacggcaaaagcagaatgaacttgagaaagaagccgctgatgcgctggtcaagcagcaaatgacaatttctgacagcgccctcgtggctcactacagaaaggttcggggcctgtcccagaaagtgcgctactggtatcagcaggggacgtgctgtccttactgcggcaagaacatcgaggccgtccaactgattaataacaatgattctttcgaggtggaccacatcattcccatcagcgtttcctttgatgacagccagaacaataaagtgcttgtccattctcagtgtaaccaggccaagggaaaacaaacccctctcggctggctgaataacgggggaggcttcgggcagaataagacagaatatgtggctaaggtgaaaaccaacaagaactactccaaaaataagatggacaacctgctcaatgatatggacctgagcgatattgttacacagagaggatttatccagcggaaccttaatgacaccagatatgcctctcgcatcgtcctggatgagttctactcctttttcaaaagcaacaatctctccacgaaggtgaagattgtgcggggcaaatggacctctcaaatgagaaagaaatggaacggggtcggcggactgaagaaaacacgcgacacctatcaccatcacgcgatcgatgctagcattatcgcctcctttcccctgcttaaggtgttcgacaaagccattaagctcatcgatatcgacagagaaacaggcgagattctgcaggataaggaagctatcaaaatgtctcaggaggccaagctgctcgagaaaattccggttatccagaatgaaaagtttgaggaactgattaacgagctttacgacttccctctgtttaaacaagtggaactcgctaatgatatcaccaaccccgagaatcctgtcaagttcagccaccatgtggacaagaaagccaaccggtccgttgcgaatcagacgatctacgggacacgcattaaggagaaagaaatcaacaagagaggaaaagtggagaaggtccaggaacggtatattctgggcaccatcaagaacatttacgacatcgatagcttcacatcttttaaaaagatttatgacaaaatgtccaagaccggggatgtgaaattcctgatgcaaaagaaggaccccaaaacctggggaaaacttgttgagatcctcaatagctaccccgattctgaagagatcacacaggtggacggcaaggtcaagcgcgtgaaagtgtccccttttgagctgtatagacgggaaaacgatttcattacgaagtacgccaagcacaatgacgggccgaaaatcgtcagcattaagtattacgattctaaaatcggcagccatattgacatcacccccatcaacgctaagaataaagttgtgctgcagtccctcaagccttggcgcacagatgtgtactttaacagcgagaccagacagtatgaactgcttggactgaaatactctgacctcaagttcacaaatggcgtctatgggattacctccgaggcctacgagaagctgaaacacggaatcagcgaagacggcacgaagacatggaaacccattgggaagaactccggatttcggttctctctgtatcgcaataacagagtgaaaatcgttgatgagaagggcgaaagccttgagctcctgtttgcttcccggaccacctctaatgaagggtacgtggagctgaagcctatttataaaagcaagttcgactccaaagaggatgtcggcttttacggacaaatgacaccctctggccagttcgtgaagaaaatggccagagttgggtacaagctctataaggtgaacaccgacgtcctgggaaatccgtactatatcacaaaagaaagcgatgaccctgagctttccctgtacaagaaatga

SEQ ID NO: 4029 - RNA, 3528 nt, synthetic construct
  misc_feature 1..3528: note = Cas9 variant
  source 1..3528: mol_type = other RNA
atggaggaaatgaagcagaccggcagaaagaacgaggcccccaagctgacagacctcaattaccggatcgggctggatattggaatcgctagcgtgggctgggccgtccttgaaaacaattcccacgacgagcctttccgcattatcgatctgggggttagaatttttgacacggcggaacaaccgaaaaccggagcttctctcgccctgccccggcgcgaggccagaagcgctcggcgcagaatccggcgcagacgggatcgcatcgagagaattaagaaacttttccaggccgaaggcctgatcaacattgacgagtttgaagctcggtataagatcgccgggctctccgatgtgtacaagctgcgctatgagggactggacagaaaactcacagatgacgagctggcgcaggttcttctgcatattgccaagcaccggggcttcaaatctaccagcaaggctgaagaggccgaaaatgagaacgatgctgccaaaaagaaggaagcgggcgccctcaaaaaggggatctccaataacaaaaagctgatggaggagaaaggatacagaacagtcggcgaaatgatgtatcttgacgagaattttcgcaccgattgcccttggaacgaaaatgggtacattctgacaccccggaacaagtctggagactataaacataccgtgctcagagacatgctggttgatgaggtgcgcgaaatcttcaagagccagcggtccctgggcaatatccacgctagcgaggagctcgaaaacgcctacctggacattatgctttctcaaagatcctttgatatggggcctggagctcccagcaagtacgccatggagggcttcgaagaccgcgtcggcctgtgtacgtttgaggggaaaaatggagaaaagcgggccgctaaagcggcctatacctctgaactcttcgtggctctggagaagatcaaccatacaaaaattgtttccgatgacggcgccaccagatttcttacaacctacgaacgcaagagcatcattgagctgatgcacaagcagcagacggtgaaatatgccgctgtccggaaggccatcgggctcgcggaagaggataaattctacaacctgaattattctcctaaggctggatccaaaaagagcccggaggacacagattttgtgaagctggaaaactaccacaaaatcagaaaggccctcggcgaggacattgtgtccgaacatctgcccgccgagaaaatcaaactttatgattctattgctaccatcctgacactcttcaaaaatgacgacagccgcattaagcggttcatcgaactggggatcggagaggagtgctttgatggccttctgtccctcagcccttctaagttccacaacctgtccctggtcgccatgggcaaaattatcccctttctcctggacgggaatacctacgataaggcttgtgaacttgccggatacgacttcaaagcggataacaagggcgagaaaagcgttctgctcaaggggaaaaatattaccgacatggtgaacgatatcacaaatcctgtggtcagacggtctgtgagccagacgattaaggttatcaacgccattatcctggaatatggatctccccaagctgtgaatatcgagctggcccgcgaaatgtccaagaactttgacgagagacggaaacttaagagcgatatggagtccagagaaaaagagaataacaatgtcattaagcgcgtgaaagaatacaagctcaacccgaccggccaggacatcgttaagttccggctgtgggaggaacaggatagacgctgcctgtatagcggggagaaaattgacatcaacgatctcttttctagagacggcggatacgacgtggatcatattctgccttattccatcacattcgacgatacctaccggaataaggtccttgtgaaagctagcgagaaccgccagaagggcaatagaacaccctatgaatactttatggccgagaaagacgatgacgaatggaacgtctacgagaccctggtgcggaatacggttaaggattataagaaagtgctcaagctgctgaaaaagcacatcacagaggacgaaaaatctgagttccgcgaaagaaaccttaccgataccaagtacattacacggatcatttataatatgatccgccaaaacctcgtcctgaagccttacctgtccctcgagaaagaaagaaagaaacaggtgatggcggttaatgggagcattacccactatctgtccaagcggtggggacttgagtctaaagaccgcagaacagatacgcatcacgcccaggacgctgtggtcatcgcctgtaccacagatggcatgatcaacaagattagccggtactccaaagggagagagctgctctattctcgcggatttaagttcgtggacgaagagaccggcgaaatcctgagccgggacaattttacaagagaggaatgggatgagaagtacggggtgaaaattcccatcccctgggagcatttccgcgacgaactggatattcggatgtccagatacaacggcaccggagacgatagcatcgacaagacgacccctcgcgatttcatcctttctcaccgggacgctcataaatggattaattatccggagtggatgtttgttgaaggcagacccgggcgccggggagtcctcgatggcatcttcgtgtccagaatgcctaagcacaaagtgagcgggcaagcccacgaggaaacagtccggtctgccaagtactataacgacggaggctccgtgtttgagagcgggggctacgttgtgaccaagaaatctattcaggatatcaagctgaaagacggagagattaaggagttctttaatcccgacagcgatcgcctgctctataacgctctggtcgacagacttaacaaattcgagaatgatcctaagaaggcgtttgccgaacccttctacaaaccgaaggctgacggcacacaggggcctatcgtgaaaaagattaaagtttttgagaagcagtccagcggagtgttcgtccgggatggcaaggggatcgccgccaacggagctatggtgcgcatcgacgtgttttgcgaggaagataaaggcaagaaaaagtattacttcgtgcccatttacaccgccgacgtcgtgaaaaagaagctgcctgatagagcggctacggccaataaactcatctctgagtggcgggtgatgaaggaagagaactttattttctccctgtatagcagagacctgatctacattgaatccgataaaggggtccaagttaaggacatcgatggcaaaatctctaagcccgtgaatcttttcgcctattacctcggagctgacacaagcaccgcctccatttctggcaaactgcatgacagctccgcgaactttcgctctatcgggattcagggactgcggagattcgataagtgtcaggtggacgtcctcggcaatatcagctttgtgaacaaggagaaacgcatgcctttcaattga

SEQ ID NO: 4030 - RNA, 3531 nt, synthetic construct
  misc_feature 1..3531: note = Cas9 variant
  source 1..3531: mol_type = other RNA
atgaacaaggtgcaggaggactgctacaaaaagatcaaagaaaagctggccgatagagagtatcggattggcctcgacctgggggtcggaagcatcggctacgctgttgtgtcccttaaaggggatatgcccgaagacgtgattctggccggatctcgcatcttcaagagctccattggcgcggctgagagacggcactttcgcgcccaaagaaatacccatcggcaccatcgcgaaagaatgcggtatctctggaagctgcttgccgagaaaaacctggctctccagctgcctgagaatctgtctaagaaagaaaacttcacagattttgacacgagccgcaagagattcccgatcgaggtcctccggaatgatccctacatcctgcgctataaagcccttgacgaaaagctgtccctctttcagctggggtacgctctttatcacattgccaaccatagaggaaccgcgtctgtgcggagcttcctggaggatgacgaggccaaggttaaagaaaataaggagacagctaaactcgccaagaacaccaaaaagatcatgtacgagaaaaagtaccgcacatttggcgaatatctgtacagagaacggattgagaagttcagacagaatgagcgcatgaaagtgaccaacaagaatgaaaacaaagagtttgctgtcacacgggatatcattgaaaaggaggtggaaatgatcctgggcgcccagaaaagatataataccgcggttctcgccgacgattacattgagcgcatcaagaaggctatcttctatgagacggaaaaactgattcctgagcccgaatactgtccttattttaaggacgacaaacggcttcccagatcccacaagctgaacgagtaccgccggatctacgaagccctcaataacaccagatattacattcctgagatcgaggagaaaacaggggaaattctgagccgcaaggaaaaggagcaactttctaaagaggaaaaggagaaactgttcaactttctcctgaagaataaagaactgaccgaggctaaggtgaagaaactcctgaacctttccgaaatggccaaggtccagctgcagggacgggataaaaagaatcagaaaatcaagggctatgccctcatcacactggagagccttccgttctggtctaaactgcccgagcaacagcaggacgagttcctctacgattggaacaagctgcctgacgaaaagctgaaagatagactccgcaattattacaagctgaccgacgatgaaattgacgagacgtttcaaaacatcgtgcttccctccaattatgctcctctggggaaaaaggcgatggaaattctcctggagtacatcaaaaacggactgagctacattgaggcccttgataaggctgccgacgaaaataagatcaaagtggagaagcacgaaatcaacgatctcctgccctattacggcaaaattctgcaggagtctacacagatgccgatcgggaaggccttctccaaacaatttgctgccaagaattataagaaacctgacattaacaagaatgaacaggagttcggacggatcgcgaaccccgtcgttcatcagaccctcaatgagctgagaaaacttattaacgaaatcattacagtgtttggcaagaaacctctggagatcagcctcgaaacctcccgggagctgaagaagtctcagaaagagcgcgaactgatcgctaagcaacaggacattgatgaggagaaaagaaagaaaatctggaagacctacattgaaccccaccttcagcagatcaaaagccggtccgacaagctcaagaaactgttcgtgtttgaactgtgggaggatcaaaagcataactgccccttctgtctcgagaaaattaatgtcgacgatatctatagcagaggcgtggacaaggaacacctgtttcctcttaaaaagtctgaggatgactccgaaaacaatctggttatcgcccacaacaagtgcaatgcccgcaaagctgagcgggccccgttcgatgcttttgggcatgaaagcatttggaacgacatcttctctaatgccgagaagaacctccccagaaaactgtggcgctttagacagggcagcttcgagaagttcctggaaaaacctcccatgcttaagcggtttgagacagataattcctacatttctaagatcagcgcgcgctatctcgcctgtctgttcgacaaaccttccaagatcttttgcgtgaaacccttcctgacggctcagctcagaattgcctggcagctggatgaaatcatgattcggcttgctgagaacatcattctggacagcgaaaaggactcttttaataaaggagggctccaaaagaagaaacgcatcgataacagacaccatgccctggacgcggtcgtgattgcctacgcttcccggggataccacaatttcctgaaccgcgttcatgccaagggctataaaatcaattacgatgagaagacctggcttagcgagacactcagaccgcctgggaacaaaaacctggaagactttaagtctggaatcattaatgtgatgatcaacgctaatatttccatcaagcacgatcacaacaataaaggccagctggtcaagagcaaagcctataagctctactattccgagattggcaaatacatcattaccacactgaagtctgtgagcgaaatccttttcaaacagaaggagaagccccaggacaccctgcggcgcgccctctgtaaatttgaggatagactgtccgacatcaaggataaaaagctgcggaaaaagctggaagacaacattacgatctataagtctattgagaatgaaagcgctctttccaaagcgaagcaagagctcgaagagttcgatctgaaagccaagaaagaggggaagaagggatacgagaaaatcacagacattctcatctacaagaaggcttgcagcatgcatggcgggaaatatatccacgtcaaaaacagaattgaaaataagtttttcgccctgaaggaacctaccgagatcgaaaccggatttggctacgatacagccgacaacctttctctggacctctatcatgataataacgggaaactgtgtggcgaggtgattcgcaagatcgacttcaatcggaacagagttcccaattacaaaaaggagggatatattctgcttgaacgcatctaccagggcgataccctggaggtggacatctccgatgacaaaattagcctcaagaacaaagtcgggtctgctcctgataagcggacattcgtgaaggttctgacgtttaccgaatccgacagatatctcaaaaacaagcgcgatcagatccaaattttcttttgcaatctgcttaaaagcacactgaagcacgacgattctagcaaacacgacgactccttctacgtgagctctatgcagaagtacaacgtccggaaggtgatcctcacctccctgggaattatcaaatatagaagcaagattctgaaaaataaggagatctga

SEQ ID NO: 4031 - RNA, 3531 nt, synthetic construct
  misc_feature 1..3531: note = Cas9 variant
  source 1..3531: mol_type = other RNA
atgctgttccccaagaaactcagcaaggaggaagtggcctacgtcctggttgagatcaactccaatcttaacaattctagcaactatctgggcaatatttccgacagatctaaagaactctactttaacaagcagaccatcgggcaattcctgtatacaaaacttaaggaggatcggcactacagcctgaagaataaagtgttttatcgccaggactacctcgatgaatttgagagaatttgggagacgcaggctatctttcataaggaactgaccgaggacctgaaaaagcagattcgggatacaatcatcttctatcaacgcagactcaaatcccagaagggactgatttctctttgcgaatttgagaacaaggagatcaccattgaaaaagagggcaagacagtgaccaaacagatcggggtccgggtgattcctaagagctccccgctgttccaggaatttaaaatctggcaaattctcaataacgttatctgtaagaaaaagggaacacgcaagaaaaaggccgtgacccccgcgcctctgcttttcgagctgtttggcacgcccagcgaaaccttcttttctctcgacatggagtgcaaacagctgctgttcgaggaactcaatctgaaggggaaccttaaagctgataaggtcatcagactgctcggatacattcctcaggagtgggaaatcaattacaaccagctggagggcaatcggacacaaaagtccctttatgaagcctacctgaaaattatcgagattgagggctatgacatcaagaccttcctccgcatcaaaagcgataaggaagactgggatctggaggaatctcccctgtccgccaaagagattagagaaaacatccagcacatttttgagacactcgggatcagcaccgctattctgtacttcgacgccacgcttcctatcaaggattttgagaagcaggcttcttatcaactgtggcatctcctgtactcctatgaaagcgacaactccccgtctggaaatgagacactttacaaactgctccaggacaagttcggctttaaacgggaacacgccgtgttcctgagcaacatctcctttcaggatgactacgggagcctgtctgcgaaggccattcgcaaaatctatccctacattaaggagaatcagtattccaccgcttgtgagctcgccggatacagacatagcaagctgtctcttacaaaagaagaactgaacaatcggcctctcaaggatctgatcagccccctgaaaaagaactcccttcgcaatcctgttgtggaaaaaggcctcaaccaaatgattaatgtcgtgaacgctctgatcgagaaaaattctgaaaaggacgccgaggggaacattatcaagtatttccactttgatgagatcagaattgaactggcgcgggagctcaagaaaaatgcccaggaaagagctgagatgaccctgaacatcaagaatgccaccattgaacaggagaaaatcaagagcattcttatctccgacttcggaatcaaaaaccccacaaagaacgatattacgcgctaccggctgtatcaggagctcgctcacaatgactacaaggatctgtacaccaacacagacatcccgaaagaactgctttttagcaagaatattgatatcgagcatattgtgcctaaagccagagtcttcgacgactctttttccaacaagaccctcgcctatcgcgatttcaatctgaaaaagggcgaaaacacagctttcgactttatcgatagctctctgggcgaggaggagctcaatcaatacatcgcgcgggttgagaacgccttcaagaccaaaaatatttccgctacgaagtatagaaacctgcttaaaaaggccacagaaatcaatgacgggtttattaaccgcgatctgcgggagacccagtacatcgccaaaaaggctaaggacctcctgttccagattaccagaagcgtggtgtccacatctggaagcatcaccgatcgcctgcgggaagactggggccttatcgatattatgaaagagctcaatatgcccaagtatagagacctggggctgacagagatcattgaacgccgggatggaagaaaagtcgaggtgatcaaggactggacgaaacggaacgatcaccgccatcacgccatggacgcgctcaccgttgcttttacaaagccttcctacattcagtatctgaatcaccttaacgccagaaaagacgaaaacaataagctgtacgccgatatcctcggcattgagcggaaggaaaccacaaaaatccatgacgagaacgggaatgagaagagagtgttcatcgaacccattcccggatttcgccaaatcgctaaaaagtacctggaggaaattctgatctctcacaaaaccaagaacaaggtcgtgacgaaaagcattaataagatcgccggcaccaacaaaaagcaggagacacttacccctcggggccagctccataaagaaacaatctatgggaagtaccactattactccaataaggaggagaaaattggaaccaagttcgataaagaaacgatcagcaaggtttctaacccgatttatagatacgctctgcagaaacgcctggaggccaatgaaaacaatcccaagaaggcgtttacaggcaaaaacgccctctccaagaatcctatctatctggacgatgctaaaaccaagattcttcccgagaaagtgaacctgatctacctcgaagaggacttcagcatcagaaagaagattgtctctgagaatcctacatccaaagaatttgtgcccaacagcatctctattgagaagatcgtcgatgaagggattaaacggatcctgaaggagcgcctggagacctacaacaatgacccgaaaaaggccttcgctgatcttgacaaaaaccctatttggctgaataaggaaaagggaatcagcatcaaaagagtgaccatttccggcgttaagaacacacaagccctccatagcaaaaaggatcacctggggaaacccatcctcgacaaggagggccaggaaattcctgtggattttgtctctacgggaaataaccaccatgtggcgatctatcgggaccagaagggcaatctgcaagagcagattgtttccttcttcgaagccgtggtccgcgctcagcaggggcttcccatcatcgacaaaacctacaagcaagaggagggatggcagtttctgttcacaatgaaacagaacgaaatgtttgtgttccctaatgagattaccggctttaaccccagcgaaatcgatctcctggacccgaagaataaaaagctgatttcccctaaccttttcagagtgcagaagatctctattaaagattatttcttccggcaccatctggagacaaatgttgaaaccaacaatatcctcaaggacatcacgtggaaacgcgggggactgagcctcctgaagggcattatcaaagtcagaattaaccaccttgggaatatcgtgtccattggcgagtactga

SEQ ID NO: 4032 - RNA, 3534 nt, synthetic construct
  misc_feature 1..3534: note = Cas9 variant
  source 1..3534: mol_type = other RNA
atgaacaaggtgcaggagatcgaatacaaaaagattaaagagaagctggccgacagagaatatcggatcggcctcgatctgggggtcggaagcattggctacgctgttgtgtcccttaaaaagtatgacgatctgtcttacctccccgaggacatcattctggccgggagccgcatcttcgcgtcctctatcggagctgtggaaagacgggagtttcgccttcaaagaaatagccaccggcatcgcagagagcggatgcgcttcctgtggaagctcctggccgaaaaacagctggccctccagccttccaaggatctggagaaaaaggaaaactctgctgactgcgagaccagccagaaaagatttccgattaatatccttaagaacgatccctatattctgcggtacaaggccctcgacgagaaactgtcccttttccaactgggctatgtcctctaccacgtggctaatcatcgcgggacagatagcatcagatcttttctggaagacacggatgacaagattaaagagaacaccaagacagccaaactggcgaccgaaacaaagaaaatcattgattccaagaagtaccggaccttcggagagtatctctacaaagaacgcatccagcagaatgagagaaagaaagttagcaaccggaagacagccggcaataaaaacaaggagtttgctgtgaccagagacatgatcttcaaggaaacggagaaaattctggcctctcagaagcaatattacaccaatgtccttacagacgaatatatcaaagagattgaaggcgctatcttttaccagaccgagaagctgattcctgagtccgggtattgtccctacttcaaagatgaaaagcgcctcccttgcagccacaagctgaacgagtaccggagaatctatgaagcccttaataacgcgcgctactctgcccccgtgctggacgagaaaacaggagaaatcctctcctatcaggagggcgaggaatttagctccgaggaaaagaaaattctgttcgatgaggttctgctcaaggggaaaaagctgaccgagtctgaaatcaagaaacttctgcatctccctgacggatgtgagattcagctgcaaggccgggataagagaacgcagaaaatcaaggggtacgctcttacagccctggaagctctcccgttttggagcaaactgtcccagcaacagcaggacgagttcctgtatgattggaatggactccccgaagagaagctgaaacctaaacttattgactgctacagcctgaccgagaacgaagtggatgagacattccagaagatccgcctcccctctaactatgcccctgtcggcaaaaaggccatggaaatcctgctgacctacattaaagacggctactcctataccgaggctcttgataaggcggtgagcgaagggaaatttaaggtggacaagcaaacaacgatctacgactctctcccctattacggaaaaattctgcaggagagcacccagaagctgatcggcaaagccttctccaagcagtttgctaaacggaattataagaagccgaacacaaatagaaacgagcgcgagttcgggaaaattgccaatcctgtcgttcaccaatctctcaacgagctgcggaaacttatcaatgaaattatcaccgtgtttggaaagaagcccctggagatcggcctcgaaacagccagagagctgaaaaagagctccaaggatcgcgagagcctggtgaaacagcagaacgaaaatgagtacaaccggaataagatttataaagactacgtcgaacctcacctttctcagatcaagtccagacaagagaaccccagccggtacattttcaaatttgagctgttcgaagaacagaagtctatctgtcccttttgcctgaaagaaattacccctgatgacatcatcaattccaaggtggatattgagcatatcttcccgattgaagagagcgaggacgatgctaagaacaatctggttatcgcccacaacgaatgtaacgcggacaaagggaagaaatccccctttgatgctttcggagacaagacgtctggcaaatatgtgtggaatgatattctccataacgccaagaagaatctgcctcacaaaatctggcgcttttaccagggcagccttgagaagttcctggaaaacaaacccatgctcaagagattcgggacagacaattcctatatctctaaaattgccgctaagtacctggcctgcctgtttaacaatagctccaagatcttctgtattaaaagctctcttaccgctcagctccggatcgcctgggagctgaactccattatgatccctctggcgaagaatatcctcagcgaaaaagagctggaggaatttaagacccttaaaaacaagaagattagaatggataatcgccaccatgccctggacgctatcacaattgcctatgctaaccggggataccacaatttcctcaacaaaatccatgccaagggctataaaattgactacagagagaagaattggctgtctaaaatcctgcttcccccgctcaaccgcgatctggaagactttaagatttccgtcaagaacagcatcgagaaagcgaatgtgtctatcaagcacgatcataaaaccaacgggagcctggttaagggaacagcctacaaagtgtattactccggcacggggaagtatattatcaccacactcaaaaatgtcgaagagattagcttcaaggagaaggaagaccctgaggataccctgagacgggctctttgcggctttgaagactctaacatcaaagatgagaagctgattaaaaagctcaaatacaattccgacctgtataagaagatcctgaacacaaaacccaaggccaaacaagagcttgaacaggctaatcaggagaccaaggaagagggaaagaagacgcaaaagatcaccgatgtgctgatttacaaaaaggcctgtagcctcgtcggcgaacagtatatccagtgcgcctcccgcctggagaacaaattctttgctgtgaaggagcctacagaaattagaaccgggatcggatacgacacaggcgataatctcttcctggacctttactatgataaaacccggaagctgtgcggggagattatccgcaagatcgactttaaccagaataaaattcccaactaccaaaaggaaggatatatcctcttcgagagaatttaccagggcgacacgctggaagcggatacatctgaggacaaaatcagcctgaagaataaaaccgggtccgcccttgataaccggacatttgttaaggtgctgaccttcaccgagtctgacaaatatttcgatggcaagaaggacaaaattcagatctttttcggaaatctcctcaagagcaactacaaacaggatgactccttttatatttctagcatgcaaaagtacaacgtccgcaaagtgatcctcacatccctgggcatcattaagtacagaagccagatccttaagaataaagaagtttga

SEQ ID NO: 4033 - RNA, 3540 nt, synthetic construct
  misc_feature 1..3540: note = Cas9 variant
  source 1..3540: mol_type = other RNA
atgagcaagaaagtgtccagacggtacgaggaacaggcccaagagatctgccagcgcctgggctctagaccctatagcattgggctcgacctgggagtcggctccatcggggttgctgtggccgcgtacgatcctattaagaaacagccgtctgaccttgtgttcgtcagctcccggatctttattccctctaccggagctgccgaacgcagacagaagcggggccaacgcaacagcctgagacaccgggccaatcgcctcaaattcctgtggaaacttctggctgagagaaacctcatgctgtcctatagcgaacaggatgtgcctgaccccgcccggctgcgctttgaggatgctgttgtgagagccaatccttacgagctccggctgaaggggcttaacgaacagctgacactctctgagctgggatatgcgctttaccatatcgccaatcaccgcggctccagctctgtcagaacgttcctggacgaagagaaatccagcgatgacaagaaactcgaggaacagcaagctatgaccgagcagctggccaaggaaaaaggcatctctacatttattgaggtgctgaccgctttcaacacaaatgggctcatcggatatcggaactccgaaagcgttaagtccaagggcgtgcccgtccctaccagagatattatctctaatgagattgacgtgctgcttcagacacagaaacaattttaccaggagatcctgagcgatgaatactgtgaccgcattgtgtccgccatcctcttcgagaacgaaaagatcgtcccggaggcggggtgctgtccctattttcctgatgaaaagaagctgccccggtgccatttccttaatgaggagagacgcctgtgggaagccattaacaatgctcggatcaaaatgcctatgcaggagggagccgctaagagataccaaagcgcctctttttccgacgaacagcgccacattctcttccatatcgcccggagcggcaccgacattacgcccaaactggttcagaaggagtttccggctctgaagacctctatcatcgtgctccaggggaaagaaaaggcgattcagaaaatcgccggattcagattccgccggctggaggaaaagagcttttggaaaagactttccgaggagcaaaaggatgacttcttttctgcttggacaaacacccctgatgacaagcgcctgagcaaatatctcatgaagcatctgcttctgacagaaaatgaggtggtcgatgccctcaaaaccgtgtccctgattggcgactacggccccatcgggaagacggccacacagctgctcatgaaacacctggaggatggacttacctatacagaagctctggagcggggcatggaaaccggggagttccaggaactcagcgtttgggagcaacagtctctgctgccttactatggacagattcttaccggctccacacaggccctcatggggaagtactggcacagcgcgtttaaggagaaaagagactctgaaggattctttaagcccaacacgaactccgatgaggaaaaatacggccggatcgctaatcccgtggtccaccaaaccctgaacgagctgcgcaagctcatgaatgaactgatcacaattcttggcgccaaacctcaggagatcaccgtggagctggccagagaactcaaggttggggctgagaagcgggaagacattatcaaacagcagacaaagcaagagaaagaagccgtgctggcttatagcaagtactgtgagccgaacaatctggataaaagatatattgagcgcttccggcttctcgaagaccaggcctttgtctgcccctactgtctggagcatatctccgtggcggacattgccgctggcagagccgatgtcgaccacatcttccctcgcgatgacaccgctgataactcttatggaaataaggtggttgcccacagacagtgcaacgacatcaaagggaagcggacgccctacgcggcctttagcaatacatccgcttggggacctattatgcattatctggatgaaacccccggcatgtggcgcaagagacggaaattcgagaccaacgaggaagagtacgccaagtacctccaatctaaagggtttgtgagccgcttcgaatccgacaatagctatatcgctaaggccgccaaagagtacctgagatgtcttttcaacccgaataacgtcacagctgtgggctctctgaagggaatggaaacctccattctccggaaggcgtggaatctgcagggcatcgatgacctgcttgggagccgccactggtctaaagatgccgacacatcccctacgatgagaaagaaccgggatgacaaccgccatcacggactcgacgctattgttgccctgtattgcagcagatctctggtgcagatgatcaataccatgagcgagcagggcaaacgggccgtcgagatcgaagctatgattcccatccctgggtacgcctccgagcccaacctcagctttgaagcgcaaagagagctgttccgcaagaaaattcttgaatttatggatctgcatgctttcgtgtctatgaagacagacaatgatgccaacggagccctcctgaaggacaccgtgtattccatcctgggcgctgatacacagggggaggaccttgtttttgtcgtgaaaaagaaaattaaggatatcggcgtgaaaatcggagactacgaggaagtcgccagcgcgattcggggcagaatcaccgataagcagcctaagtggtatcccatggagatgaaagacaagattgaacagctccaatccaaaaatgaggctgccctgcagaagtacaaagaatctctggtgcaggccgctgccgttctcgaggagagcaaccgcaagctgatcgaatccgggaaaaagccgattcagctttctgagaagacgatcagcaaaaaggctctggaactcgtgggaggctactattacctgatctccaataacaaacggaccaagacattcgtcgtgaaagagccttctaatgaggttaaggggtttgccttcgataccggaagcaacctgtgtcttgacttttatcacgatgcgcaaggcaagctgtgcggggaaattatcagaaaaattcaggccatgaatccctcctacaagcccgcttatatgaaacagggctacagcctctatgtgcgcctgtaccaaggagacgtctgcgagctccgggcctctgacctgacagaagctgagtccaaccttgccaagaccacgcacgtgagactgcctaatgccaaaccgggccgcacattcgttatcattatcacctttacagaaatggggagcggataccagatttatttctctaacctcgctaagtccaagaaaggccaggataccagctttaccctgacaacgatcaagaattacgacgtgcggaaagtccagctgtcttccgcggggcttgtgagatatgtgagccccctgctcgtcgataagatcgagaaagacgaggttgccctgtgtggagaatga

SEQ ID NO: 4034 - RNA, 3567 nt, synthetic construct
  misc_feature 1..3567: note = Cas9 variant
  source 1..3567: mol_type = other RNA
atgaagtacatcctgggcctcgacattggggtgagctccgtcggaatcgccgttatttctgaggaaaaccagaaaaagaccatcgagaatctggctgtgagaattgtgcccgaagatcctgacttccacggcaaattttatagcgggaacacagcctccaagaatcttgagcggacggcgaaacgcggaaacagaaagaataaccaacggttcaaggctcgcagagataaactgtaccagtctctcaaggaaaataacatgtttccgaccagcaatctgttcgacctttccgccgtcgagctgtatggcctccgggccaaagctgtgtctgagcaggttagcctgcaggaactggggcgcatcctcatcctgcttaaccaaagacggggatttctgtccaatcgcaagagcgtgtctgaggaaaactccacagagtacaaagagagaattgccggcctcgaaaaggctctgggcaataagaccatcgggcagaaactttatagcgagctgcaggaaaacaataacgtcttcgaggtgctcctgcgggaacgcacataccagagatcttcctataccgaggagtttgatcggatttgggacgaacaaaagaaatactacctgatcctcacaggaagctctaacgaggatgacaataagggcaccctgtatgatcttattcgcaacagaatcatttactatcagcggcccctgaaatcccagaaggggctcatcagcgaatgcctgttcgagaaacatcacaaggccgttgcgaagtcctctccttactttgaacttttcagaatctggcagaaaattaatgacctgagctggaagacgcccaacggagagctctttaaacctaccgatgagcaaaagcagaaactgaagaatgccctgtggaacggcgacaatctcaaccccaagcataaactgacagtgtccaagatcaaagaaattcttgggtataccagccgcgagaagatctacctgaatttcacagaactcgatggatctcggacctattccattctgagaaacgctcttatcgaggccggcatcgaaaaacctgagcagtacctgtttttcaatatggagacgaacgacgaaaagggcgggctctttgagctgtggcacattacatacagcctgccgatcgaaaaggaggtcattaatgctctcaaaaaccgctttggattcgacaagaaacaagccgagatcattgcgcggagagtgggctattctagcgattacgggtccctgtctacccgcgccatccggaaacttctggtgcatctcgaaaaaggactgggctatacagacgcttgtgataatatcgggtacgaccacagcggatataagaccaagattgatctgcagcccaaacttaagcagctcaaaagaaacgagctgcgcaaccctgtcgttgaacagatcctgaatcaagtggtgaacgccgtcaatctcattatcgagaagtacggcaaaattgacgaaatccgggtggagctggctagagagcttcgcaacaatgccaagacccggaaaaacatttccctgctcaatagcaagaacaagaaaaataacgatatcatcagaaagaaactgcaggaagagtatggctttaagttcgttaatgggcgggacgtgacacgctacattctgtgggaagagaactctaaagaatgcctttactgtaataagacgatcaacggatccgatatgctcaccggcaatgccgacattgagcacatcctgcccaagagcagatcttttaacaacgctatgaataactatattatcacacatcggaaatgcaattccgataaggggcagaaaaccgcgtacgacttcatgagctccaagggagaggtcatcctgcagcaatatattgaaaaagtgaacgacctctacaaggatggcaaggggtctatcagcaaaacaaagtttgagaatctgctttgtaaaggcgaagacattccttccgatttcgttgagagaatgaagaaagactctcagtatatcgccaaggaagctgtgaagatgctgaaaaccgtctgccccaacgtgtacacgacaaccggacaggtcaccgattttctccgcgaggagtggaagctgaaaaatctgcttcaggaactcacattcgagaagtataaagccattggccaagtgaaggaaaagatcatcaagaccaacaatgggcagacaaagacgtttaaagttattgccgactggagcaagcgggatgaccacagacatcacgctatcgatgccctgatttgtgcgctgaccgaccagaaaatcattttcaagctcaacaatctgaacaaaatctaccagtacgagcgcaatgctctttcccaaaaggagatcgaagagattgaagagtttctggaaggaaagttcagcatcaaagagttctctgcccagcagggcaacattatcgagtgctccattccgaatatcagaaaggatgcccaaaaacacctcgaaaacattctgatcagctttaagaaagagaactctaaggtgctgacaatgaatcggaaccagcctaagaattgtaaagaacagatcacctgggtcccccgcgctagacttcatgaggacacaattatggggcgggtgaagcgcatccctgaaaagaagatgaaactcaacgataaggtttccttcgagcagattaagatgatcgtgaatcccgagattaaagaaatcctgctgtatagactcgccaagtttggagacaaccccaaagtcgctttcgccaccaaggcgctgaaaaaggagcctatcttttaccgggaaaatgagcttaaggaagtgagcatttatgagtgggtgaacacgaaacgcgttgccctgaatgagaacatcaccgactctcaaattgaaaagatcattgatcaggctagcaaaagagccgtcaaggagcggctcaatggcgggaaaatcaaggaagtgttcaaaaacctgacagagaatccgatccagctgaagaacggcatgattcttaagaatgtgaccgtcacagacgagtccaaagtggaaaagatccgcaacggatttgctattaccggcaaaaatcaccatgccctggtttacaaggatgagaacgggaaatataacgacaaggtggtcagcttctgggaagcggtggccatcggactcagaaatgttacggagtacggcaacccctatcctattatcaatcggaaccacaatgatgaactgggggagttttacttctctatgcagattaacgacctctttgtgttcgatctgaagcattccgagaatccccaagaagagaacgaaatcaatttcttcgacgtcgagaacagaaaacagatcagcgataaacttttccgcgtgcagaaaatgtccaagaaatctaatggacagtttgttagcgacttccggcaccacctggaaacatccgtgattagaaacgatatgatcctcaagaatattacctggatctctattagcaagaactccgacctggagcgcctgacaaaaatccgggtcaatcatcttggcgagatcattaaggtgggggaatga

SEQ ID NO: 4035 - RNA, 3585 nt, synthetic construct
  misc_feature 1..3585: note = Cas9 variant
  source 1..3585: mol_type = other RNA
atggacttcaccgccgatgtgagcgagctgaacgaatcctttatgcagatccacacagagtctaagttcgaaattgacacggctaaagtccaagagatcagccagctcctgcttgataataagattaccagaatggaccggcagaaacaggttgccaacgtgctggcgaagaatagcggcgataaagaagctgacaagatcaacaagaaaattgccacagagttttgcaaggccgtgctcgggaataaagctaagttcaacgtcatcctgggagaggatgccgtggactctgattggagctttaaaatggacgatgaaaattccgacgaggaaatcgagattcttatgggccaaaccaacgggcagcagcagaatgttctgcgcatcattcatcaatggtactctcagatcacactcaacggaattgtgcccgatggccagatgatcagcgagtccatgattgacaagtatgaactgcacagaaagcatctgctcctgcttaaacagcaaatcaaggtcaccaaagacaagaaaaaggctcagcagctgcacgaggcctacgaacaatatgtgcatgggacaggagcgaaaaagaagctcacccaggatgacttctacagcaaagttacgaagaatctggagacctctgatttttccgacgaaatcaaaaagcagattaacgccgagacattcatgcctaaacagcggaccagcgctaatggcgtgatcccgcaccaacttcaccagcaggagctggataagattatcgaaaagcaggccaaatattacccctttctcgctgagctgaaccctgacacaaagcgccaaaatattgccaaatataagctggatgaactcatcgcgttcaaaatcccctactacgtcggccctctgattaccacggaggaccagaagaagacatctgggaaatcctttgcctggatggtgagaaaggaacccggaaaaatcaccccttggaacttcgatcagaaggtggacaaaatggctagcgccgatcagtttattcggcgcatgacaaccaaggactcttatcttatcaccgaggacgtcctgccggctgagtccctcatttaccaaaagtataaagttctgaacgaacttaatatgatcagagtgaacggcaataagctgacaaaacatgataagcagaacatctaccaacaggtgttcgagaaatataagacggtcaatgtgaaaaaggttcaaaactacttcctcaccgacgggcggtatcagcacgcccccaagattacaggactgagcgatgacaataaatttaactccaatctgtctacctacatcgatttcaagaaaatttttcaggacgtggtcgatgaccctcaaaagcagaaagatttcgaacgcatcattgagtggagcacaatctttgaagacagacatatttacgaggtgaagctcaaggagatctcctggctgaacgatgaacagcggaaagagcttaagaaaaagcgccaccagggctgggggagactgagcgccaaactcctgaccggaatcttcgacgaaaatggctattctattatggatcaactttggaacacgcagaagaattttatgcagatccaggctgaggagggcttcaacaagaaaattcaagcggaaaattccaagcacctggagaaaaacgactttgaagacatcctcgaggatgcctacacaagcccccagaacaagaaagctattcggcaggttatcaaggtggtcgaagacatccagaagaccatggggaccgcccctcagaaaatttctatcgagttcacacgcagcgccgataagaatcccagacggtccattgagagacagcgccagctggaagagatctattacaacgacgctaaagaaattgtgtctgagggaatgcaagataatctgcagaactttaccgacaataagcagacactcacggataaatatttcctgtactttacccagcttggcatcgacatgtatacagggaagaaaatcaacattgatgaaatcggaaattaccaaattgaccatatcctgccgcaggccttcattaaggatgacagcatcgataacaaggtcctcgtgtccagcgcgatcaataacggcaaatctgacaatgttcctctgtccatgtacgctagcgtgcggattaagtctgaggtccagaacaaatggaagaatttcgccgagcacgggctgatctcccagagaaaacttaacaatctcatgaccgaccccgaaagcattgataagtataaggcccgcggatttatcaaacggcaactggtggagacatcccaggttattagactggtggctgaaatcctcaacgagaagtaccagggcgaaaccgagattatcgaggtccgcgccaaaatgaactctcagctgcggaaggacttcgatcttctgaaaaatagaaacgtgaatgactatcatcacgctctcgatgcctacctgacgacctttatcggcaactatctgtaccgccggtatcctaagctgagaagctacttcacatacgggcattttaagaaaattgacgatgcgaagctcaaacaattcaattttctgcacgacatcgaaaacgataaggaccccaaatatgtgaatgataacggagagctgctctgggaccgcgaaaaggacattgcctacttcaagaaaatctataattttaagtacatgctggtttcccacgaggtctctacccggcagggcgctatgttcaaacagacaatttttcccgccgctgccgatgccaagagcaaacttatccctatcaagaacgacaagccgaccgcgatttatgggggatacacgaataacaatgatgcttatctggccatcattaaactcgctaagacaggccagttcaaagtggtgggggtcccccaaagagccatcgtgaagctgaaacaggcctacgacaaggagaccggcgattactccaacgttctgtataaagtgcttgaacctaagtttgtcaagaaaaaggtgaatcggaaaacaggagagattacctaccaggttgaaaagttcaaaatcgtggtccccaaggtgccttatcgccaactcgttatcgacggcgatcagaagttcatgctggggagctctacctacaaatataacgctaagcagctggtgctctccgagaacgcgattaaaatcctggacaagaaatcctttgatcagtctggatacaagtccagcgaccttgatacagtctatgacgaaattctgtctcaagtggatagatacttcagcatgtacgacaagaataaatttcgggagggcctccataacgggaagaaatatttccagagactgcccatgatcgacaatgtggagaagggaaaaattaaggaaaacggcaagtttaaactgcttaatgagatcctcattgggctgcacgccaacccgtccttcggcaatcttaagagcctcggaatctctacgccttttggcatgatgcagttcgcttccgggatcagcctgtccgaaaacgccattctttgttaccagtctcccaccggaatctttgagcgccgggtcgccctgaaagatctctga

SEQ ID NO: 4036 - RNA, 3588 nt, synthetic construct
  misc_feature 1..3588: note = Cas9 variant
  source 1..3588: mol_type = other RNA
atgcagaagaacatcaataccaaacaaaaccacatttacatcaagcaggcccagaaaattaaggagaaactgggcgacaagccctatagaatcgggctcgatctgggagtgggcagcattgggttcgctatcgtctccatggaagagaatgacggaaacgttcttctgcctaaggaaatcattatggtgggctctcggatctttaaagccagcgcgggggctgccgatcgcaagctctccagaggacagcggaataaccatcgccacacaagagagcggatgcgctacctgtggaaagtgcttgccgaacaaaagctggctctcccggtccccgccgacctggatagaaaagaaaattctagcgagggcgaaacgtccgctaagcggttcctgggcgacgtgctccagaaggatatttatgagctgcgcgttaaatctcttgacgaaagactgagcctccaggagctggggtacgtgctttatcatatcgccggacaccggggctccagcgcgattcgcacctttgagaacgattctgaagaggcccagaaggaaaatacagagaacaaaaagatcgctgggaatattaaaagactgatggccaagaaaaactaccggacctatggagaatacctctacaaggagttctttgagaataaggaaaaacataagcgcgagaaaatctccaacgctgccaataaccacaagttcagccctacaagagacctggtcatcaaagaagcggaggccattctgaagaagcaagctggcaaagatgggtttcacaaggaactcaccgaggagtatatcgaaaaactgacaaaggccattggatacgagtctgaaaaacttatccccgagtccggcttctgcccttatctgaaggacgaaaagcggctccccgctagccataaactgaacgaggagagacgcctttgggaaaccctgaataacgcccggtactctgatcctattgtggacatcgttacgggcgagatcaccgggtattacgaaaagcagtttacaaaagagcagaagcagaaactcttcgactatctgctgaccggatccgagctcacaccggcccaaaccaagaagctgcttggcctgaaaaatacgaactttgaagatattatcctccaggggagagacaagaaagctcagaagattaaaggatacaagctgatcaaacttgagagcatgcccttctgggcgcgcctgtccgaagcccaacaggattcttttctctacgactggaatagctgtcctgatgagaagctgctgacagaaaagctctccaacgagtatcacctgaccgaggaagagattgacaatgctttcaacgaaatcgtgctttcctcttcctacgctcccctgggcaaaagcgccatgctcatcattctggagaagatcaaaaatgatctgtcttatacagaagccgtcgaggaggcccttaaggaagggaaactcaccaaggagaagcaggcgattaaagaccggctgccttactatggagctgtgctgcaggaaagcacccaaaagatcattgccaaaggcttcagcccccagtttaaggataaaggctacaagacaccgcatacgaacaagtatgagctcgaatacgggagaatcgccaatcctgtggtccaccagaccctgaacgagcttcgcaaactggttaatgagattatcgacatcctcggaaagaaaccctgcgaaattggcctggagacagctcgggaactgaagaaatctgccgaggatagaagcaaactttcccgcgagcagaacgacaatgaaagcaaccggaacagaatctacgagatttatatccgccctcaacaacaggtgattatcacccggagagaaaatccccggaactacatcctcaagttcgagctgctggaggagcagaaatctcagtgtcccttttgcgggggacagatttcccctaatgacatcattaacaatcaggctgatatcgagcacctcttcccgattgccgaaagcgaggacaacggccgcaataacctggtgatctctcattccgcgtgtaatgccgataaggctaaaagaagcccctgggccgcttttgcctccgcggccaaggactctaaatatgattacaaccggatccttagcaatgtcaaggaaaacattcctcacaaggcttggagattcaatcagggggcctttgagaagttcatcgaaaacaagcccatggctgcccgctttaaaacagacaattcctatatttctaaggtggcccataaatacctggcttgcctcttcgagaagcctaacatcatttgtgttaaaggcagcctgaccgcgcaactgcggatggcctggggacttcagggcctcatgatcccctttgctaagcagctgatcacggagaaggaatccgagagcttcaacaaagatgtcaattctaacaagaaaattagactggacaatcgccaccatgccctcgatgccatcgtgattgcttatgcctccagagggtacggaaacctgcttaataagatggcgggcaaagactacaagatcaactatagcgaacggaattggctgtctaagattctcctgccgcctaacaatatcgtgtgggagaacattgatgctgacctggaatcctttgagagctctgttaaaacagcccttaagaatgccttcatcagcgtgaaacacgatcactccgacaacggggagctcgtcaagggaaccatgtacaaaatcttctatagcgaacgcggctacaccctgacaacctataagaagctgtctgctctcaaactgacagacccccaaaagaaaaagacgcctaaagattttcttgagaccgccctgctcaagttcaaggggagagaatccgagatgaaaaatgagaagattaaaagcgcgatcgaaaacaataagcggctgtttgacgtgattcaggataacctggagaaagctaagaaacttctggaagaggaaaacgagaagtccaaggccgagggcaaaaaggaaaagaatatcaacgacgcctctatttaccagaaggctatcagcctctccggagataaatatgtccagctgtctaagaaggagcccggcaaattctttgccatcagcaagcctacacccaccacaaccgggtacggatacgacacgggcgattccctctgcgtggacctgtattacgataataaagggaaactttgtggagaaattatccgcaaaattgacgctcaacagaagaacccgctgaagtataaagagcagggcttcaccctctttgaaagaatctacgggggcgatattctggaggttgacttcgatatccattctgacaagaatagctttcggaacaatacaggatccgcccctgagaaccgcgtgttcatcaaagtcggcacctttacagaaattaccaataacaatatccagatttggttcgggaacatcattaagagcacgggaggccaagacgattcttttacaatcaattccatgcagcagtataaccccagaaaactgattcttagctcttgcgggttcatcaagtaccggtcccccatcctgaagaataaagagggatga

SEQ ID NO: 4037 - RNA, 3594 nt, synthetic construct
  misc_feature 1..3594: note = Cas9 variant
  source 1..3594: mol_type = other RNA
atgagcaagcacgtgctgggcctcgacctgggggtcggatccatcggctggtgccttattgccctggatgagcaggaccaacccgctgaaatcctcgggatgggatctagaattgttcctctgaccacagatgaccttaacgagttcagccagggcaaagccatctccaagaatcagaaacggacgacccagcgcacaattagaaaggggctggatcggtaccaactccgcagaaaagtgctgtctgaaaagctggcgggacatggcatgctcccggacaaggatctgatgcagcttcccgtgctggacctctgggagctgcgggctcgcgccgccagccctggcgaaaaactttccctgcccgagatcgggagagtcctctatcacatcaaccagaagcggggatacaaacatgctaagtctgatgaggccgaagaggtgaccaaacgcggcaaggaacaggggtatgttgctacagtgaagggaagatacgccgagctgcaacgggagggcgcgaccgtcgggcagcactttgcctgtaaactgaaggaacatcgccaggagagcccttccggaggcttcttttataattacagaattaaagaccaggtgtatccccgggaggcttacatcgaagaatttgatcgcattatggaggttcaaagcgtgttttaccctgaggtcctcacaccggccttcatccaggaactgagagacaaggtgattttcttccagcggccccttaaatcttgcaagggcctggtgtccttttgtgagttcgaaaaacaagagagagtcgttcagctcaagcgcgtgaaccgggaagggaaggaggagctgcaggaaagaaaaatcaccattggacctaaggtggctcccaaaagctctcctatcgcccagctttgcaagctgtgggagtccatccacaatattcgcatctattaccccgatggcaaagaacggccgattacgctcgaggaaaagagaaagctgctggcgtatctccaaacccacgacaaactgacatttaccgcccttaagaaagagctgaagatcagcgacaaagagcgcctctggtgtgataagctgcttaagggaggaattaaaggcgacacaacccgggtcctgctcagaaaggctctggccgggtacaaacgctatgaacctctgctccggatggatctggagcttagagacttccaggaaatcgtgtctggaaagcgcctgatccggcccattgttgatgagtcctacctcagccagcctctgtatagactgtggcatatcctttactccattgaggaacgggaggctatgcgcagagccctcatcgaccagctgggctttctggaagaggatctcgacggcgggctgcttgataaactgtaccaaattgacttcgccaagcagggatattctaacaagagcgctaaattcatctgcaagctcctgccccatctgcagggcgggcacggatactcccaggcgtgtgaacttgccggcaaacggcacagcgctgggtctctcacgaaggaggagctggaagagagacccctgctcgaacacatccctctgcttcaatgcaatgagctgcgccagccgattgtggaaaagatcctcaaccagatgattaatctggtcaacgccctgcggcagaagtatggctccatcgatgaggtgagagttgagcttgcccgcgaactcaaaatgagcagagaggaacgggaggaaacatctaagcgcattagaagccgggagaaggagaataaagaaatcgctgagcgcattaaggaatacgagctgtatcccaccaaatccagaatccaaaagtaccggctgtggcaggaggccggagaacagtgtctctattgcggccgctctatcgacgtggtccaatttctgagaggggacggagtggagattgaacatatcattcctaaaagcatcctttacgatgactccagcgcgaacaagacatgtgcttgctctcggtgcaataaggataaaggcaaccgcaccgcctacgagtatattctggccgaagggagagaggctgagtacctcgaccggctggaaaccctgttccacgatggaaaactttcctatagcaaaagacgccggctccagtggaagaaagccgacatccccgtcgattttatcgagagacagctgcgcctgacacagtacattgctcggcaagcccaggaaatcctcagacagggcattcgccgggtgggggcgtctgagggctccgttacggccaagctgagacatctttggggatatgacgatatcctgcgcgaactcaatttcgagcggtaccagagcatgggcgagaccgaaattgtgtcccaagaggaaaaggacgggtctatcacaaaaagcgagagaatcaaggattggtccaaacggaaggaccaccgccatcacgctattgatgccctggtcgtggcttgtaccagacagggatatatccagcggctgaactctcttaacagcgaagaggactccctgcagatgcaagaggacagcaaacagatgcgcgaaaagatgggcgggcagaagagacctacagccgataaacactctattctcgagaattggctgatcctccaaccccatttttcccaccaggaagttaagagcaaagtggcggagattctggtctctttccggccgggaaagagaaccgtgtccacgggccgcaacacataccttcggagcgggaaaaaggtgacccagtctggcgttctgatccctagaggacccctcagcgaggaatccctgtacggccagatcctgcgcaatggggagcctacctatgtcaaaaaggtggcccttgaaagcctgtctgaggctcaaattgaacagatcgtggaccccaagctccggagagagatggtcgcccgcacacagccttccgagggagctaaactgaaccccaagctcctgcttgccaccccgttttacagcgatgccgctggcacacagcgggtgagatccgttcgcgtggcgattgaaaatgggaaaaactctatcgtccctctgagatataatgagagcggaaaggccattacgttcgtgaaccccggcaataaccatcacgttgggatctaccggacctccgaaggcaaactcgtggagtcttgcgtcacattttggcaagctgtggaccgcgttagatatgggattcccaccatcatccggaagcctcgcgaagtgctggatcagctgcttctgagagacgatattccggaggccctcctggcccacctccccgctagcgactgggagttcgtcgaatacctgcaggccaatgagatgtttcttatcggcctgacagatgaagagattcagaccgcgctggctgaatccgacctcctgacgctttctaaccatctgtatcgggtgcaaaagatgagctccgagtactacgtgttcagatatcacctcgagaccgaagtcgccgataataaaaacaatacagggatcattcctaagttttaccgcctgcggggacccaacgacacctatctcaaagccaaccctagaaaggttaaagtgaatctgcttggcgagatcagcctgccctga

SEQ ID NO: 4038 - RNA, 3615 nt, synthetic construct
  misc_feature 1..3615: note = Cas9 variant
  source 1..3615: mol_type = other RNA
atggagagaatcctgggcattgacaccgggacaaacagcctcggatgggccatcgtggataaggacgaaaatcagtaccacctggtcgctaaaggcacgaacattttctccgagggggttaagatcgaaaaaggaattgagtctagcaaggccgcggaacggaccgagcatcgctccgtgagaaaacactattggcggcgcaagatcagaaagatccggcttctgacaattctctctgataatgacctgtgcccccgccttaaacatgagcaactgagacagtggcggctcaagaaagtgtaccctaccgatgacacatttatggaatggcagcgcaccgaggataaggctcaggtcaacccgtataaattcagatacatctgtctgacacaaaagctggacctcagcgatattacccagcggtttatcctgggccgcgccctttatcacctgaatcagagacgggggttcctctccaaccgcaaggaagccacgaaagagtctgagggaaccgtgaaggaaggcattagctccctgagcaaagacatgaaggattctggctgcgagtaccttggggaatatttttaccagctgtaccaacagggaaagaagatcagaaatcattatacagctcggaaagagcactacctcaaggagttcaaggccatttgttccaaacaggaactggacgatgctctgatcgagaagctcgaaaaagccatctttgaccagagacccctgaaaagccaaaaaggccaggttgggacctgcacattcgagaagggaaagtctcgctgtccttccagccaccccctttatgaagactttcggatgtactctttcattaacaatatcaaagtgcaggtcgataccctgtatgacaagggcgagagatccctcacggatgaagagaaacaactgattatccctctttttaagcgcaaaagcaagcggacattcccctttgaggacattgcgaagaaaatcgccgggaagaacaattactgctatatcaaatccaacgaagagaaggcttacaaattcaattaccagatggatacccaggtgtctggaagccctgttaacgcccagctggaagagattttcggcgaagactggctctccagcgtgtgtgaggtctatacactggctaataacaagtctagatttcaaatcatgaacgatgtgtggcatgtgctgttcttttacgacgatgaggacaagctcaaagagttcgccaaggatcgcctgcagcttgacgacgaactggcggaaaaattttccaagattagcatcccgaatgattatgccgctctctctctgaaagccattcggaagatcatgccctaccttagagactatggcctgatctacagcgaggctgtcttcctcgccaacctggttgatgtgctgcctcagcacgtgtgggggattaaagagatgcgcgaagccgctatcgagaatgtcattgacgtgatgcattcctatgataagaacaatatcgacggaattaccctcgaaggctgcgttaagacctttctgaaagagcggtaccaggtgtctgatgacaaccttaagaaactgtaccaccccagcatgctcgatccttatcccagacaacgcccgaatgacgaaggggtcttccagctgggatcccctcggatcagctctgtgaagaaccccatggcgatgcactccctgtttagacttcggaaagttgtgaatctcatgctgaagaagggctacattacacctgatacgaaagtccatatcgagttcagccgcgacctgaacgatgccaataagagatgggctatccagacctggcagcgggagaacgaaaaagagagagaacgctgtcggaaggagattgaaaaatatatcgcctctccctccgacacagacattctcaagtaccaactgtgggaggagcagaatcacaagtgcctttataccggggatgaaatcagaattacagactttctgggagataaccccaaatacgacatcgagcataccatccctcgcagcgccggcggcgattccacgaagatgaatctcacactgtgttctagcagattcaaccgggacgaaaagaagaccaaactgccggctgagcttgtgaaccacgatgaaattctcgagcgcatctccaattggaaggagaagtatgaagacattgataaacagatcagaaagatttctaccaaaggggccacaagcaaggaggacaaagattccaagatccggcgcagacattacctgatcctgcagcgggactactggcgcggaaaatatcaaagatttaccatgacagaagtccccgagggcttcagccggcgccaggggacggatatttctgtgatctccagatacgcgcggatgtatctcaagagcgttttcaaacaggtgtacattgtcaaaggaatcgctacctctgactttagaaagatgtggggcattcaagacgagtatgccaaaaaggaacgcgtgaaccacgttcaccattgcatcgatgccatcacaattgcttgcatcgggaaagccgagtacgacaagctggctgattatcggcaccagtacgacgattaccttttccagggcaagaccaaacctacatttgacaagccctggccttccttcgtgattgatatcaaacatattcaggacgaactgctcatcgcccactatgcgaaggataatctggagaaatttaccaagaagaacctgagaggaaaagacggccgcattatccgggataagttcgggaataaacttcaaatgaagggagacacgagcagaaactctctccacaatgacaaattttacggcgccatcaaccatgaaggggagattaagtatgtctaccgcaccaatatcgaggctctggatgccaagagcattggaaacatcgtggaccccacagtgcggtccattatcgaaagcgctatcgccattcacggctctctgaaagcggccatcaataaggggatttggatgaacgaggaaaaacatatcccgattaagaaagttagagtcttccgcaatgatgtgaagaagcctatcgagctcaaagaccagcgggatctgtccgacaaggattataaacagcactactatgtgaccaacgacggcaattacatgatgcttatctttagcaagctgaacaacaaaggaagagaaattcggcagcatgtcgtgatcaattccctcgaggctacagaggttattaagtctcacaaacgcagccaagtgggcaaggtcgtgtgggaatcctactattctaaggaggggttcgatctgatctacaaacttaagagcggaaccatgattctgctctatgaaaacaatagagacgaggtttgggatctggacatccggaacctgcagaaacgcctctacattatcacgaagatgaaatatgatggcagaatctacatgatgcaccatcaggaagcccgggagaagaaggacctggaggaaaaatccgggtcttttaagattaatgaggactatagaccccttatcgtgaacagctacaatcagttcaacgctctggtccaagatctcgactttgaaattaatgatctgggagagatccgccggctgatttga

SEQ ID NO: 4039 - RNA, 3630 nt, synthetic construct
  misc_feature 1..3630: note = Cas9 variant
  source 1..3630: mol_type = other RNA
atgaagaaagactacatcctgggcctcgatattgggatcagctccgtgggatggggcctgcttgagctggacgataacaataacccctataagattatcgacgtcgggtctagaattttcacccctggagaagttgagaaaacaggcgatagccgggccaaggaacgcagagagaaacgcggggctcggagaatcgcccggcgcagagaatttcggctcgaccgcgtgaagaatctgctttacgagaacggatatctgaagggcaatatcaactccaatattgtgtctgagaaaaacgaagaactcagcatcattttcaataacatgatcaataactactataatggcaagaacacgaatccgtacattctgaaagtcgaagcgctggatagaaagctcaccgacgaggagctgtccatcattcttgtgcactatgctaaaaagcgggggtacaagtctaaccgcgaagaggccagcgataaagaatccggaaaggttctgacagccatcaaagagaacgaaaagatcatgaaagacaataactacagaaccattagcgagatgtatatcaaggatgacaaatttaagaataagattaaaaactctcccaatgattacaagatctccgtgacaaacgagatgtatctcgaagagattaataaagtcctggacagccagatcaagttcggccttatcaccgacgattttaaaaaccaatacctggaaatttataattctcggcgctcctacgctaaggggcctggaggcaacagcccctatgggggagacctcatcgagagaatgacaggcaagtgcaatttcgatggcaaccctcgggcccccaaaagagctttttcttccgaaatttacgtggccctgaccaagctggttaatctcaaatacaaggtgaacgacggggagtatatcaaactgagcgagaaggaaattaagaatatcatcgagaaagcgaaggagaaaaagtccatttcttacaaagatcttacgaagatgatcggaaacaacattgacttcaaggatctgaccctcagcaaaaaggagtatatcaaactgattgaagaacttaagaaaaagctgaatatcaaaaaggacacaaagattaacatcaatgagctctccagcgaagataaagagctgtacaacaagctgtgtaatgacaaactcctgtctaagacccttatcgaactgaaaggctatcatattctcaaggattccgtcatcaaggcctacagcaaagacatttgggacgaggtgaaggataacatgtatctgcttgacgatctggctctctactgcacaaattacaaagtgaacgaggacatcctgaataagattaaagaatctgagaacatcgataatatctttaacgacattcacttcgtcgaactgctccctaattttaaggatcatctgatgcttagcaccgagctgatccgcaagctcattccgatcatgtatgggggaaacacgtacgacaaagccatgaatattctgggctataaccactccgatatcaacggggacaaggagaaaaaggatctgcttgttcccatctgtgtggacgataatattacaaaccagcgggtgatcagatctctcacccagacacgcaaagtcattaatagcatcattaagaagtacggaatgcctaaaatcatcaacattgagaccgctcgggagctggccaagtccagacaggaacgcaatgagatcgcgaaaaacaatgtggaaaagcaagccgagaacgagaaaattaagaatcagctggttgaactcggcctgttcgtgagcaccgacaaaatctcttccacagaccttctgaagtataagctctggaaagagcagaacgaattttgcggctacagcatgaagaaaatttctatcgaggatctgttcgggaataacattgtccagatcgaccatatcctgccctattcccggacgtacaatgataactaccttaataagaccctcgtgtatacaaaagaaaaccaagagaagggaaacagaaccccttacgaatggttcggcaagacagacaaatgggatgagtatgagacctacattaataacctgacgatcagccagaagaaaaaggacaattatctgctcaaaaagctggattttgacacagaacgcgagatgcggtcccagaaccttaatgataccaagtacatttctaaagaactgagctccctcatcaaggcttatctgaacgttgagaaagtgaatatgtaccccggggccattaccgctaagctgagagcccgctggggattcaaccggcttacacactcttacctcagcaaaaattatatcctgccgaagaacatcaaggaggacattaataaagatagagacaaccatctgcaccacgccatggatgctctcgtcatcgcgtccattacccctagcctgcagcaaaagatcacactttacgaaaaattttctcggtatattgacggcctgacggagctccagatcaagaatatctcctacattaaaatcgaagacagcgaggggcagtattacaacgatgacaccgatgaagtggagacaattgacatccgcgagtatattaagcaacagctggccgaaaataacatctactacaatagacataacatttctaagctggagttcccccttccttatgaaaactttgataaagaggctaagctccgggtctacgaacaggacctggataccctgaaatggaatctcaagtcctataacacatacacccagaaagacatcgataatgtgcacacgctgatccccagcattgccaagaccaaagtttctggcaagatgcacgaggagacatattacggaatcaaggaaattggcaaagacgaggataagaaaatctataagacccttagaacacccattgaaaaagtgaagcgcaaggacctggacaacatccctgatcggctcgggggaagcaaagacgtctacgagtccctggtggaatggttcggcgattacgaggttggggaggaagtgctgaaggccaatggaaacaaatatccggtcagcaagtctgacaaagagcataaggaaatcaagaaacttaagctgtactccgagtataaaaataccggccacatgattaacaagagcaatgtggagaaagggggcatctacagaattgatgtgtttaagtccaaggacaaagaagatgacaagctctatttcgctgcctacgatatcctggagattaaaaagatcaacacgctcaaagaaaagaatcgcgttgacgataactttaatatcaaactggactatggacaaggcaagaactctaagattatgagctacacagatatcattaataactacgacctttatatctccctgaacaaaaatgacctcattaagatcaccacaaacgatgggaaagagtctgtcgcgtacgtggtgggatgtagctccggcatgctggaagtcaagtctaaactgggggacggatatgatattatcaagaccgaccttaatgagaacaatatcttcagcaagcagagagctcagtaccagattaccgtgtccacaatcaaagagattaagaaactgagcatctctgttctcggcgaaatttccgggctgtga

SEQ ID NO: 4040 - RNA, 3633 nt, synthetic construct
  misc_feature 1..3633: note = Cas9 variant
  source 1..3633: mol_type = other RNA
atgagaaccatcctgggcctcgacctggggacaaacagcattggatgggccgtgatcaattccgtcattaaggagcagacggaacggatctggattgagatggctggctctcgcatcatccccatggatgccgcgattcttggggacttcgataaaggaaacagcatctcccaaaccgctgaaagaacacggtttcgcggcgttagacggctgcgcgagagacagctcctgcggcgcgaaagacttcacaaggtgctgaaaattctcgggttcctgcctgagcattacctgaagggaatcgactttgagaaacacaccggcaagttcctctctggcagcgaaccgaagctgccctgggtgaaagatcggtgggggaagtattcctttcttttccagacagcctttaatgagatgctggccgacttcgctaaacatcagccttctctcgtctttgatggaaagaaaattccctacgactggaccgtgtattacctgcgcaagaaggcccttacagaaatgatcagcaaagaggagctggcttggattctcctgaacttcaatcaaaagagaggctattaccagctgcgcggggaagaggaagaggataacgccggaaaatccgttgaattttatgcgctcaaggtgctgagcgtcgaggccaccgacgagaaaaagggccgggatatctggtacaatgtgcaccttgaaaacgggtgggtttacagacggtcttccaatgtgcctctggactgggagggaagagtcaaagagttcatcgtgacgaccgatctcaaccccgacggcacacctaagctggacaagtatggcgaggtgaaacgcagctttcgggctccgaaggaagatgactggatgcttattaaaaagagaaccgaggccgatatcacagggacccataaaacgattggatcttacatctatgacgctctgctccaggagccccagcaaaagattatcggcaagctggtcaaaacagttgaacgcaagttctacaaagaggaactgaatttcatcctccagaagcagtgcgcctttcacgcggagctgcaggatcgggacctttatatgagatgtattgaagccctgtaccctgggaacgaggtgcaacgccggaatatcgctaacagagatttcatttatctcctgatcgacgatgtgctgttttaccagcgccccctgaaaaccaagaagtccctcattgccaattgcccttacgaggaaaacgagtatgtcaaccggaaaacaggagaaatcaagaccgctcccctgaaatgtatcgccaagagccacccgctgttccaggagtttagactctggtacttcctgtctaatattcgcgtgtatcaaaaagagcgggaagttaacggcacccttcatctggacgtggatgtcacaacggagtttctcaagaccgaagacgactacgtggccctgttcgattggcttaattccagaaaggagatcgaccagaaagcgtttcttcggtatcctgctttcgggctcaagaaagaaattaacaattaccgctggaactatgttgaggataagttttacccctgcaatgagacaagacacgccatcctgagccggctggaaaaagctggaattggcatcgacttcctctccgatgagaaggaaaccgccctgtggcatattctttactctgtgagcgacaaacaggagatcgaaaaggccctggctacatttgccgtcaagaacggcctcaatgagtccttcgtggaggtcttcaaaaagtttcctcccttcaaaagcgaatatggggcgtactctgctaaggccatcaaaaagctgctgccccttatgagatgtggaaagtattgggatatgtccctcattgacggcaccacgaaagagcgcatcgaacggattatcgccggggagtgcgatgaaagcattggagctaaggtgagagagaaagccatgaacctgtctgacatcagctgttttaagcgcctgcctctctggctggcttgctacgttgtgtataatagacactccgaggataaagaaatcacaaagtgggagaccccggccgacattgatgcgtaccttgccgctttcaagcagcactctctgcggaaccccatcgtcgaacaagtgattaccgagacactccgcgttgtgagagacatctggaaacaggtcggcaagattgacgagatccggatcgaactggggcgcgagatgaaaaatcctgccgataagagaaaacggatgaccacacagattctggaaaacgagaatgctaaccttcgcatcaaggccctcctggcggaatttgtgaaccccgagtatggcgtggagaatgttagaccttacagcccctcccagcaagaaattctgcggatctacgaggacgccgtcctcaagggagaagaacagattccggaagatatcgacgtgatcctgaaaaagttcaacacgagcaaacttcctaccaagtctgagtttctgcgctataaactctggctggagcagaagtacagatccccctatacaggcgaactgattcctcttgctaaactcttcaccgccgcttacgagatcgaacatgtgattccccagagccggtattttgatgactctttctccaataaggtcatctgtgagagcgccgtgaacaagctgaaagataatcaactggggtacgaatttattaagaaccaccatggacagaaagttgaggtgggcttcgggaagacagtcgagatcttttccgtggactcttatgaaagattcgttaaagagcagtacgccaagagcggaattaagatgaaaaagctcctgatggatgacatccctgaacagttcatcgagcgccaacttaatgattcccggtacatttctaaagtggtcaagggcctgctcagcaacatcgtgagagagaaaaatgactccggggaatatgagcccgaagctgttagcaagaacattctggtgtgcaccggctctgtcacggatcgcctgaagaaagactggggaatgaatgacgtgtggaactccatcgtgagcccgcggtttgagagacttaatgcgctgaccgaaacacagtgtttcggccactgggagaacaaggatgggaaaaaggtctttcagaccgccgttcctctcgagtaccaaaaaggattctctaagaagcgcattgaccatcggcaccacgctatggatgccatcgtgatcgcctgcgctacaagaaatcatgtgaactatctgaacaatgaatccgccagccgcaacgcgaaaatttctcggtacgacctccagagactgctttgcgataagagccggggcgacgggaatggaaactatcgctggatcattaaaaagccctggaccacgtttacacaggatgctagagaggccctgtccggcatcattgtcagcctcaaacagaatctgcggatcatcaacaagaccacaaatatttaccaacacttcgacgccaacgggacccgcgtgtatgaaaagcagaaaatcggcgattcttgggctattagaaagcccatgcataaagacaccgtttttggagccgtgaatctgcggaaggcgcttatccctcagcactacaacctgacactcttcatttccagctga

SEQ ID NO: 4041 - RNA, 3642 nt, synthetic construct
  misc_feature 1..3642: note = Cas9 variant
  source 1..3642: mol_type = other RNA
atggagaagagactgggcatcgacgtggggaccaacagcctcggatgggccattgtcgaagttgatgacgagggctgcacactgcttgatagaggggtggacatcttccaggaaggagtggctcgcgagaaaaatcaagaaaagcccgccgtccaggatagaacggacgcgcgggctctgcgcagacactactttcggcgcagactccggaaaattgccctgcttcgcgtgctggttagacatgatctctgtcctgccctgtccgaggagcagctgaacgcttggcagggcaaggggatctatccgctcgacgatgccttcattcggtggcaacgcaccgacgataatgctgacagaaacccctaccgggatcgctttagatgcctgacagaagaacttgacctggcctgtcgggaagagagatatgtgctcggacgcgcgctgtaccacctttgccagcggagaggcttcctgtctaatcgcaaagacgccggcaacgaggctgaagaggggaaggtcaagcaggaaatcaaaaccctcagcgccgatatggctgccgcgggatgtgagtatctgggcgaatacttttatcggctgtaccagagaaaggagaaaatccgcaagcattacacagcccggaatgagcactatctcgctgagttcagagccatttgccgcaaacaacggctggacgaggaacttagacaggctctggagaaggccatcttttaccagcgccctctcaagtcccagaaagggctggtgggaaagtgtaccttcgaaaaagataagtctcggtgccccgttagccatcctagatttgaggagttccggatgcttcaatttattaacaatgtgcgcgtcacaggccccggggacgccgaacctagaccgctgtcccccgaggaagtggagatcgtgcggcctctcttcctgagaaaatctaagccccactttgatttcgaagacattgctaaaaagatcgcgggaaagggcaactatgcctgtcgcggcgagctgctccaggctccttaccggttcaattgcgccgggaaaagcaccgtcacgggatcccccgttagcgccctgtttgcttctgtgttcggcgatgactggcagagagagatttgttccctttataccctgggggccggaaagaacgaagaacaaatcctcaatgatgtgtggcacgtcctgtttgcgttcgaagacgaggagcgccttcaggcttggctgcaggaaaaactccagctgagcgccgatgacgccaagacactggctgcctttagactcccgcaaggctacgcttctctgtcccttaacgtgatcaataaaattctgccttatctccggcgcgggtacagatacgacgaggccgttttctttgcgaacctgggaaaggtgctgcccgccgaagtctatgctgatcctgcccggcgcagagaggtggaacagggcatcagcgctcagatggacgatcttggcgacggggagaagacccggaaagaggaacgcattagagattacctccggcgctattggggagttgaggaaaagagactggagcggctgtaccatccctctatgatcgaagcctatccctccgcgagccctaacggccaggggctcctgcaacttggatccccgcggattcccgccgtgcgcaatcctatggctatgcgggccctgttcagactccgcgtcctgctgaacgagcttctccgggagggcaaaatcgacagagggacaaagatcaatattgaactggctcgcgagctgaacgatgccaataaacggaaggccatcgaaagataccagcgcgagcgggaagctgagaacagaaagtatgcggaggaaattcggcagcagtacgtggaggccaccggccactctatcgaacccagcgaggaggacattctcaaataccgcctgtgggtcgaacaaggacattgctccctttatacgggcaagacaatcgggatcagcgagtttctgggagatggcagacggtacgacattgaacacaccgtgcctcgctctagagggggagaggatgctcagtataataaaacactctgcgaagaggagttcaaccgggacatcaagagagataaactgccctccgaactggccaatcacaccgccattcttgcttgtgttgagagctgcggctggtttgaacgcatcgaggggctcgaacatcgggtgtggggcgccgacagacgcgcgaagtctgctaccacaaagagcgccaaagacttcgccattcaggatcggcactactggagaatgcatctggactattggcgccggaagtgtgaggcttttacgatgaccgaggtcccggaaggattctccaacagacagggcgtggatgttgggatcattggacgctacgccagactgtatctccaaacagtgttcgaccgggtctacaccgtgaaaggcgcgacaaccgctgcctttcgcagaatgtgggggctgcaggaggaatacgccgctaaggagcgggtgaatcacgttcatcactgcatcgatgccatcacgattgcttgtatcggatctcgcgaatatgccctttgggcgcagtacgtcagacaagacgagctgtatcggtggggcgaggccgataaacctagatgcgggaagccctggcctacattcaccgaagacgtgcgcgctaccgccgatgagctcctgattagccaccatacacccgacaacatgcctaaacagtcccggaagagactgcgcgtgcggggcaaggtccagagaaatgatcggggagaagtgaaatacatgcagggcgacaccgctcgcggggcccttcaccaacagacattttatggagccatcgagagagatggcgagattcggtacgttgtgcgcaagagcctcgaccagctgctgcccgctgacgtcgagaaaatcgtggatgaggcggttagacagaaggtgcgggaagccgtcgaggcttatgggttcaaagaagccacggacccgaccaagcatacagtgtggatgaacgaggagaagcaaatccctattcgcaaagttagaatcctcaccggagtgaagaatcccattctgcttaaaccccaccgggatgtctctgtgaaggaatacaaacgctactatcacgtggtcaacgacggcaactactgtatggccatctatgaggggagagatcggcagggcagactgaagcgcacatttgaaattgttaataagctcgaggctgcccggtacttcaaaagatccgcggaccgcgaaagccggcctgatctggtgccgctgtctgacgtgaacggatattcccttaagtacctgctcaaaaccggcacgatggtcctgttttatgagaatagccccgatgagctctacgaatgctccgtgggggagctggctaagagactttacaaagttgtgggaatggcccaggacggccgcgtccagttcctgtttcatcaagaagcccgggatcagaaggctgtgaccgccgagtgtgggatgggaatctctgttttcgacgcgagacaccctgctcccaagctccgcatccgggtgagcaactttaaaatgttcgtcgaaggctatgactttgagctgacagtgaccggcgaggttaagttcaaaagatga

SEQ ID NO: 4042 - RNA, 3642 nt, synthetic construct
  misc_feature 1..3642: note = Cas9 variant
  source 1..3642: mol_type = other RNA
atggagaagagactgggcatcgacgtggggaccaacagcctcggatgggccattgtcgaagttgatgacgagggctgcacactgcttgatagaggggtggacatcttccaggaaggagtggctcgcgagaaaaatcaagaaaagcccgccgtccaggatagaacggacgcgcgggctctgcgcagacactactttcggcgcagactccggaaaattgccctgcttcgcgtgctggttagacatgatctctgtcctgccctgtccgaggagcagctgaacgcttggcagggcaaggggatctatccgctcgacgatgccttcattcggtggcaacgcaccgacgataatgctgacagaaacccctaccgggatcgctttagatgcctgacagaagaacttgacctggcctgtcgggaagagagatatgtgctcggacgcgcgctgtaccacctttgccagcggagaggcttcctgtctaatcgcaaagacgccggcaacgaggctgaagaggggaaggtcaagcaggaaatcaaaaccctcagcgccgatatggctgccgcgggatgtgagtatctgggcgaatacttttatcggctgtaccagagaaaggagaaaatccgcaagcattacacagcccggaatgagcactatctcgctgagttcagagccatttgccgcaaacaacggctggacgaggaacttagacaggctctggagaaggccatcttttaccagcgccctctcaagtcccagaaagggctggtgggaaagtgtaccttcgaaaaagataagtctcggtgccccgttagccatcctagatttgaggagttccggatgcttcaatttattaacaatgtgcgcgtcacaggccccggggacgccgaacctagaccgctgtcccccgaggaagtggagatcgtgcggcctctcttcctgagaaaatctaagctgcactttgatttcgaagacattgctaaaaagatcgcgggaaagggcaactatgcctgtcgcggcgagctcctgcaggctccctaccggttcaattgcgccgggaaaagcaccgtcacgggatcccctgttagcgccctttttgcttctgtgttcggcgatgactggcagagagagatttgttccctgtataccctcggggccggaaagaacgaagaacaaatcctgaatgatgtgtggcacgtcctttttgcgttcgaagacgaggagcgcctgcagacatggctccaggaaaaactgcagctgagcgctgatgacgccaagaccctcgccgcttttagactgccccaaggctacgcctctctttccctgaacgtgatcaataaaattctcccgtatctgcggcgcgggtacagatacgacgaggctgttttctttgccaacctgggaaaggtgcttcctgcggaagtctatgccgatcccgctcggcgcagagaggtggaacagggcatcagcgcccagatggacgatctcggcgacggggagcagacacggaaggaggaacgcattagagattacctgcggcgctattggggagttgaggagaaaagactggagcggctctaccatccttctatgatcgaggcttatccctccgccagccccaacggccaagggctgcttcagctgggatcccctcggattccggcggtgcgcaatcccatggccatgcgggctctcttcagactgcgcgtcctgcttaacgaactcctgcgggagggcaagatcgacagagggaccaaaatcaatattgaactggcccgcgagctcaacgatgctaataagcggaaagccatcgaaagataccagcgcgagcgggaagccgagaacagaaagtatgctgaggaaattcggcagcaatacgtggaggcgacgggccactctatcgaacctagcgaggaggacattctgaagtaccgcctttgggtcgaacagggacattgctccctgtatacaggcaaaaccatcgggatcagcgagtttctcggagatggcagacggtacgacattgaacacacagtgccccgctctagagggggagaggatgcccagtataataagaccctgtgcgaagaggagttcaaccgggacatcaaaagagataagctgccttccgaacttgctaatcacaccgccattctcgcctgtgttgagagctgcggctggtttgaacgcatcgaggggctggaacatcgggtgtggggcgctgacagacgcgccaaatctgcgacaaccaagagcgctaaggacttcgccattcaggatcggcactactggagaatgcatctggactattggcgccggaaatgtgaggcctttacgatgacagaggtccccgaaggattctccaacagacaaggcgtggatgttgggatcattggacgctacgctagactctatctgcagaccgtgttcgaccgggtctacacagtgaagggcgccaccacggcggcttttcgcagaatgtgggggcttcaggaggaatacgccgccaaagagcgggtgaatcacgttcatcactgcatcgatgctatcacaattgcctgtatcggatctcgcgaatatgctctgtgggcccaatacgtcagacaggacgagctctatcggagaggcgaggcggataagccgcgctgcgggaaaccttggcccaccttcaccgaagacgtgcgggccacagctgatgagctgctgattagccaccatacccctgacaacatgcccaagcagtccagaaaacgccttcgggtgagaggcaaggtccagcggaatgatcgcggagaagtgaagtacatgcaaggcgacacagccagaggggctctccaccagcagacgttttatggagccatcgagcgggatggcgagattcgctacgttgtgagaaaaagcctggaccagctgctccctgccgacgtcgaaaagatcgtggatgaggctgttcggcaaaaagtgcgcgaagcggtcgaggcctatgggttcaaggaagctaccgaccccacaaaacataccgtgtggatgaacgaggagaagcagatcccgattagaaaggttcggatcctgacaggagtgaaaaatcctattcttctgaagccccaccgcgatgtctctgtgaaagaatacaagagatactatcacgtggtcaacgacggcaactactgtatggccatctatgaggggcgggatagacagggccgcctcaaacggacctttgaaattgttaataagctggaggccgctagatacttcaagcgctccgccgaccgggaaagcagacccgatctggtgcctctttctgacgtgaacggatattccctgaaatacctcctgaagacgggcaccatggtcctcttttatgagaatagcccggatgagctgtacgaatgctccgtgggggagcttgcgaaacgcctgtacaaggttgtgggaatggctcaggacggccgggtccaattcctctttcatcaggaagccagagatcagaaagccgtgacagctgagtgtgggatgggaatctctgttttcgacgcccgccaccccgcgcctaagctgcggatcagagtgagcaactttaagatgttcgtcgaaggctatgactttgagctgaccgtgacaggcgaggttaaattcaagcgctga

SEQ ID NO: 4043 - RNA, 3651 nt, synthetic construct
  misc_feature 1..3651: note = Cas9 variant
  source 1..3651: mol_type = other RNA
atgaccaagatcctgggcattgacacagggacgaacagcctcggatgggccatcgtggataaaaccgctgacaattacaacctgcttgataagggcgtcaatattttccaggagggggttaaaatcgaaaagggaattgagtcctctaaagccgcggaaagaacagagcaccgggctacccgcgtgagatattaccggatcaagctgcgcaagatcagactcctgcggattcttagcgacaaccatctgtgtccccctctctcccaagaagaactgtctacatggcgcctgaaaaaggtgtatccgaaaaatgagctctttatgcagtggcagagaaccgatgacgatacagaaaagaccccctacgcctatcggcacaaatgcatccatgagaagctggaccttagcgatgtcacggaccgctacattctgggcagagccttctatcacatcattcagcggcgcgggtttctctccaacagaaaggaacaaggaggcgaggattctggcaaagtgaaggaggggatcagcaccctgacacatgaaatgaatgaggctggatacgaataccttggcgactatttctacgccctgtataacaaaggggagaagattcggaaacactacaccgctcgcaatgaacactttctctccgagttcaaggccatctgcgagaaacaggatctggaaaaggagctgggaagcgaagttgtgagaaacatcgagaaggcgatttttgaccagcggcctctcaaatctcagaagggccaagtcgggaaatgtgtgttcgaaaagaataaaacaaagtgcccctccagccatcctatgtatgaggagtttagaatgctgaccttcatcaacaatattaagatcaaaacgcccaacgacgatgttcttcgccctctgaatacaggagaacgggagaagattatgccgctctttttcagaaaatctaagaaacagtttgacttcgaagatatcaccaagaagctggcccccaaaaagatgtacggcttctataaaaaggaggaagacgctgagatgccttttcttttcaactaccccatggatacatccgtgagcggctgtcctgtcaccgccgctctgaaagacgtgtttggggatgactggatcaccgccatttgcgagacatacacgctcggagaaggcaagtctcgcttcgatatcgtgaacgacatttggcacgcgctgtatttttactccgataaggacaaactggccgagttcgctatcaatcggctccagctgagcgaagacgaggccaagatcttttccgagatttctcttcccgctgattatgccagcctgtccctcaaagccatctgtaagattctgccgtaccttagacgcgggctgatctatagccatgctgtcttcctcggaaacctgtgcgaagttatgcctaaatacgagtggtctattaaggaaatgcgggagaccatcattgacaatatcattatggaaatggataaatgtgacacaaaggataagagaacctttgaggtgtgcatcaaagactatctgaagggccagtacaacgtgtccgataatagcctcaaaaagctgtaccacccctctatgatcgagacatatcctcgcgtccaatacaccaacgaacacggggtgtatcagcttggaagcccccggattgactccgttagaaatcccatggcgatgcgctctatgttccggctgagaaaactcgtgaaccggctgctggtcgagggcaagatcgatcagaatacggaagtgcatattgagtttgcccgcgaacttaacgacgctaataagagaaacgccatcgccctcttcgttaaagagaatcaaagcgctaacgatgaggcccggaagcagattatcacactgtttaaaaaggaaaccggcaccgacatcgagcctacagataaagacattctgaagtacgtgctctgggaggagcagaatcacatctgtctgtataccgggaagcagattagaatctccgacttcattggagcgaacccgaaattcgatatcgaacatacaatcccccgcagcgtcggcggggactctacgaagatgaaccttaccctgtgcgattcccggtttaatagagaggtgaaaaagacaaaactccctgtcgagctgcccaaccacgacgaaattatggagcgcatcaaggaatggaagaaaaattacgagctgcttgatattcaaatcagaaagaacaaaaagctcagcaaaggagctaccacaaaggagcagaaagacaccattatccggaagcgccatctgctggaactcagacgggattattggcgcggcaagtacgagagattcacgatggaatctgtgcctgaggggttttcccggcgccagggcaccgacatcagcgttatttccaaatacgccagactgtatcttaagtctctgttcaatcgggtgtacacagtcaaaggaatcgccaccagcgattttcgcaagatttggggcatccaggacatttattccaaaaaggaaagaatcaaccacgtgcaccattgcattgatgctatcgttatcgcctgtattgggctcgacgagtacaataagctgggagcttattaccacgatgaggaaaacaataaatggtatggcatgtctaaggccagcttcaaaaagccctgggcgacatttgtggaggacatcaaaaagattcaagacgaaatcctggtctaccattacaccccggataacatgcctaagcaggggcggagacgcattaaaatcgacggaaagaaaatcctttgcaagggcgatgccgctcgggggtccctccacaatgacacgtattacggcgccattgagaacgatggagctgtgaaatatgtgaagagaatcgacctggccagcctggaagagaaggatgttaaaaatattgtcgacgatacagtgcgctctatcattgaggcggccatcaaggaaaaaggcttcaaggacgctatggcctccaccatctggatgaacgaggaaaaacgggtgcccattaagaaggtcagatgttttacacctagcatcaccaaacccctcaatattcgcaagcagcgggatgtgtctatcaaagagtacaagcagcaatatcacgttgctaacgactccaactacctgcttgccctgtatattgggaccgacaataaaggaaaggaaaagagagagttcgagatcgtgaacattctccaggccgctcagtactaccgcacaagcaatgataaagaagtcgtggaccggcatatcgttcctatcaagtctgagcacgattatccctttgcgtacacgctgaaaattggcaccatggtgctgctttatgaaaagagcccgaacgaggtctgggacgccacaatcaaagagagaaatcggcgcctctacaaggtgaccgggctgtccacaatgagaatgaaaggacggaacggcgaatatgcttacgccaccgttaagctgattcataatgaggaagcccgccctagcaaggatatcaaagctaagaacggggagtatgaacagggcgaggagttcagacccgccattatcatgctccacacgcaactgaatgcgcttgtgcagggatacgactttgaaatcaacgagctgggcgaaattcggagactccgctga

SEQ ID NO: 4044 - RNA, 3654 nt, synthetic construct
  misc_feature 1..3654: note = Cas9 variant
  source 1..3654: mol_type = other RNA
atggagaagcagagaatcctgggcctcgaccccgggaccaacagcctgggatgggccgtgcttgatttcgacaattccaaacaagaatacaacctggtccggaagggcgaggttatttttgaagagggggtgggaaaatctgaacgcggcgagttcagcaaggctgcctatagaacattttacaaatccacgcggaagcactatttccgcagacggctccgcaagatcgaggtgctgaaagtccttgtgaagtacgatttttgcccttatctgtctgacgatctcctgaaacagtggcatgaaaagaaaatttacccggcggttaaggagttcatggactggcagagaaccagcgatgctgaagggaagaatccctattacgaccggcactgttgcctgaacgagaaactcgatctgtcccttaagtctgaccgctacatcctgggcagagccctctatcatctgacacagcggcgcggatttaaaagcaatagacttattcaaaacaatgatgagaacgaagagggcaaggtgaaaaaggggatctccgaactgagcaccgagatgcaggaagccaattgtaactacctcggagactatttctacaaactgtatacagagaagggcaataccgtccagatccggaagcgctacacagatagagagaaacactataagaacgaatttaatgctatttgcgagaaacaggaactgaacgagaccatcgtgaaggaactcgacaaagccattttctttcaacggaagctgaagcctcagagacatggggttggaaaatgtacgttcgagcccaataaccgccggtgcgctatctctcaccctgactttgagagattccgcatgctttgtttcattaacaatatcaagattaaaaccccctttgaagagaacctgcggcctctcaataacgaagagaaggccctgatcgaaccgcttttctacagaaaatccatcaagaattttgatttcgaggagattgcgaagaaactggccggcaagaacaattactgctatatcaaagacgatagctctaagcagtacaaatttaactatcgcatgtcccagggggctagcacatgtcaaaccattgccaagctcaagtctatcttcggagaagagtggaaaaatggcattgctgaaacatacaccaaccggagaaagaaagagggcctgaagaaacaggccgagatggtggacgatatctggaatgtcctgtattccgtgagcgaatgcgacgtgctcaaggattttgcgatcaacaaactgcagcttgacgagaagacggccgataatttctccaagacaaaactggctcaagggtttgccaccctctctctgaaggctattcgcaaaatccttcccttcctggaacagggatttggctacacagaggccgtcttcctcgccaacattcctaccgttgtggggaaggaatattggaataacgaggacatccggaacgatattatggaggaaatcaaaaccatcttttaccacaatacactgaagacgaacgacagccataataccattctgttctgtatcaaggacattctctccaacaatttcgatctggctcccggagcgatcgacaaactttaccaccctagcatgattaacgtgtataaggatgtcatccccaatgaggacggcattctgcagctcgggtctccgaaaatcgatgccgtgaagaaccctatggctatgagatccctgcatatcattcgcaaagttgtgaatgaactgcttcgggagggaatcattaacagcgacacagaagtcagaatcgagtacgcccgggagctcaatgatgccaacaagcgccacgctattgccgactggcagaagaaacaatatggcaagcaccagaaatacagaaaggaaatcaaagagctgtttaaggcggaaaccggcttcgagatcgaacccaatgagacagatattctgaagtttgagctctgggaggaacagaaccatatctgcctgtataccgggcaggaaattggaatctctgagttcgtgggcgagaatcctaaatacgacattgaacacacgtttccccggagccttgggggagattccacaaagatgaacatgaccctgtgcgagaacaaattcaatagagaaaacaagcagaaaaagctcccctctgagctggctaatcatagcgaaatcctggagcgcatcgacgattggaaaaagaagatttatatccttcagaaaaagtacgactccattcggacccacaacggcatggacaaagagaataaggataaaaagatcgttagcagacataagattaaactcgaactggactactggaaggggaaatataaccgctttacaatgaccgagatccctgaaggcttctctagacggcagggaatgggcatcgggctgatttcccgctacgccggactctatctgaagacaatctttcacaaaaaggataatccgcaaaagagcaacgtgtacattgtcaaaggctctatcacggccgagttcagacggatttggaatatccaagacgattatgaaaagaaatgtcgcgacaaccacattcatcactgcatcgatgctatcgtggtcgggtgtattggaaagagagagtacgaccttatggcccagttttatcgggatgaggaaaaataccgctgggagaagaagaaaaagcccttctttaaaaagccttgggaaaccttcacacaggacatgctgtccctcaaagatgaggtgctgaccgttcatttcaatcccagcaactttacaaagaaggctcacaaaaaggtgttcacccctaaaggcatctttgtcgcccagggggactgcgcgagagtgaagctgcacaaaggctcctacttcggagccattgaacaaaagggcgagatcaaatatgttatgcggaaggagctttctgctctcaagattgaagatatcaaaaatatcgtggacgccgtcgtgaaggagaaagtgctggctgttgtcaagaaaaaggggtttaagcaggccatggcggaacccatttacatgaacgaggacaaacgcatcctgattaagaaagtgagactcttcgtgagccaggccaatccgctgatcgtcaagaaacatcgggatctttcctctaaggagtataagcaaaactactatgtggacaacgaaggaaatctgatgattgctatgtacgagggcgttaaaaagaacgggaaaatcgatagagaaatcacggtggtcaataacctcgaggccgctaagtttttccgccagagccagaaaaataacgccgaaaagcagctgatttcccacctgagccctaagaatggatatccccttaaaaccgtgctcacacaaaagcagctggttctgatgtacgaggactctcctaaagagatcaagctccgggataccaaaaacatggtgaagagactgtaccaggtctttggcattgaaaaagacgggcgcgtgaaacttaagttccatcaggaggcccggtccgaaggcctgaatatcaacagcgctgcgtttaagattcaagatacacccgagtctctctatagacacaccaagtccaatctgaaagttctggtgaacggagtcgacttcaagatcaatattcttggcgaaatcagcctgatctga

SEQ ID NO: 4045 - RNA, 3654 nt, synthetic construct
  misc_feature 1..3654: note = Cas9 variant
  source 1..3654: mol_type = other RNA
atggagaagcagagaatcctgggcctcgaccccgggaccaacagcctgggatgggccgtgcttgatttcgacaattccaaacaagaatacaacctggtccggaagggcgaggttatttttgaagagggggtgggaaaatctgaacgcggcgagttcagcaaggctgcctatagaacattttacaaatccacgcggaagcactatttccgcagacggctccgcaagatcgaggtgctgaaagtccttgtgaagtacgatttttgcccttatctgtctgacgatctcctgaaacagtggcatgaaaagaaaatttacccggcggttaaggagttcatggactggcagagaaccagcgatgctgaagggaagaatccctattacgaccggcactgttgcctgaacgagaaactcgatctgtcccttaagtctgaccgctacgtgctgggcagagccctctatcatctgacacagcggcgcggatttaaaagcaatagacttatccaaaacaatgatgagaacgaagagggcaaggtcaaaaaggggatttccgaactgagcaccgagatgcaggaagccaattgtaactacctcggagactatttctacaaactgtatacagagaagggcaataccgtgcagatccggaagcgctacacagatagagagaaacactataagaacgaatttaatgctatctgcgagaaacaggaactgaacgagaccattgttaaggaactcgacaaagccatcttctttcaacggaagctgaagcctcagagacatggggtgggaaaatgtacgttcgagcccaataaccgccggtgcgctatttctcaccctgactttgagagattccgcatgctttgtttcatcaacaatattaagatcaaaaccccctttgaagagaacctgcggcctctcaataacgaagagaaggccctgattgaaccgcttttctacagaaaatccatcaagaattttgatttcgaggagatcgcgaagaaactggccggcaagaacaattactgctatattaaagacgatagctctaagcagtacaaatttaactatcgcatgtcccagggggctagcacatgtcaaaccatcgccaagctcaagtctattttcggagaagagtggaaaaatggcatcgctgaaacatacaccaaccggagaaagaaagagggcctgaagaatcaggccgagatggtcgacgatatttggaacgtgctgtattccgtgagcgaatgcgacgtcctcaaagattttgcgatcaataagctgcagcttgacgagaaaacggccgataacttctccaagacaaagctggctcaagggtttgccaccctctctctgaaagctatccgcaagattcttcccttcctggaacagggatttggctacacagaggccgttttcctcgccaatatccctaccgtggtggggaaagaatattggaacaacgaggacattcggaatgatatcatggaggaaattaagaccatcttttaccacaacacactgaaaacgaatgacagccataacaccatcctgttctgtattaaggacatcctctccaataacttcgatctggctcccggagcgattgacaaactttaccaccctagcatgatcaatgtctataaagatgtgattcccaacgaggacggcatcctgcagctcgggtctccgaagattgatgccgttaaaaatcctatggctatgagatccctgcatatcatccgcaaggtggtcaacgaactgcttcgggagggaattatcaatagcgacacagaagtgagaattgagtacgcccgggagctcaacgatgccaataaacgccacgctatcgccgactggcagaagaagcaatatggcaaacaccagaagtacagaaaagaaattaaggagctgtttaaagcggaaaccggcttcgagatcgaacccaacgagacagatatcctgaagtttgagctctgggaagaacagaatcatatttgcctgtataccgggcaggaaatcggaatttctgagttcgttggcgagaaccctaagtacgacatcgaacacacgattccccggagccttgggggagattccacaaaaatgaacatgaccctgtgcgagaataagtttaacagagaaaataaacaaaagaaactcccctctgagctggctaaccatagcgaaatcctggagcgcatcgacgattggaagaaaaagatttatatccttcagaagaaatacgactccattcggacccacaatggcatggacaaggagaacaaagataagaaaatcgtgagcagacataagattaagctcgaactggactactggaaagggaagtataatcgcttcacaatgaccgagatccctgaaggcttttctagacggcagggaatgggcatcgggctgatttcccgctacgccggactctatctgaaaacaatcttccacaagaaagataacccgcaaaagagcaatgtctacattgtgaagggctctatcacggccgagtttagacggatttggaacatccaggacgattatgagaaaaagtgtcgcgacaatcacattcatcactgcatcgatgctatcgtcgtggggtgtattggaaaaagagagtacgaccttatggcccagttctatcgggatgaggaaaagtaccgctgggagaaaaagaagaaaccctttttcaagaaaccttgggaaacctttacacaggacatgctgtccctcaaggatgaggttctgaccgtgcatttcaaccccagcaatttcacaaagaaggctcacaagaaagtctttacccctaagggcatcttcgtggcccagggggactgcgcgagagttaaactgcacaagggctcctactttggagccattgaacaaaaaggcgagatcaagtatgtgatgcggaaaaagctctctgctcttaagattgaggatatcgaacatatcgtcgacgccgtggtgaaagagaaggttctggctgtcgtgaaaaagaaagggttcaagcaggccatggcggaacccatttacatgaacgaggacaagcgcatcctgattaaaaaggtgagactctttgtcagccagacgaatccgctgatcgtgaaaaagcaccgggatctttcctctaaagagtataagcaaaactactatgttgacaacgaaggaaatctgatgattgccatgtacgagggcgtgaagaaaaacgggaagatcgatagagaaatcaccgtcgtgaataacctcgaggctgccaaattctttcgccagagccagaagaataacgctgaaaaacagctgatttcccatctgagccctaagaatggatatccccttaagacagttctcacccaaaaacagctggtgctgatgtacgaggactctcctaaggagatcaaactccgggatacaaagaacatggtcaaaagactgtaccaggtgttcggcattgaaaaggacgggcgcgttgagcttaaatttcaccaggaagcccggtccgagggcctgaataagaacagcgccgctttcaagatccaagatacccccgaatctctctatagacatacgaaatccaatctgaaggtgctggtcaacggagtggactttaaaattaatatccttggcgagattagcctgatctga

SEQ ID NO: 4046 - RNA, 3654 nt, synthetic construct
  misc_feature 1..3654: note = Cas9 variant
  source 1..3654: mol_type = other RNA
atgaagtacaactatgtgctgggcctcgacatcgggattagctccgtcggatggggcctgcttgccctggatgagaataacaatccctacaaaatcattgacgttgggtctagaatcttcagccctggagaagtggagaagaccggcgattccaaagctaaggaacggcgcgagaaaagagggacacggcgcgtgattagacggcgcgaatttagactcgaccgggtccgcaacctgctttatgagaagggatacctgaagggcaatatcacgtctaacatcgtgagcgttaaaaatgaggaactcaccattatcttcaacgatatggtgaataactattacaagtccaaagacacaaatccgtataagctgaaagtcgaggccctggatagaaagctcaccaacgacgaactgtctattatccttgtgcactacgcgaagaaacggggctacaagagcaatcgcgaggagtccagcgataacgacaatgggaaagttaaggaagctattaaagagaacacaaacctgatggaagagaagaaatatagaaccatctctgaaatgtacattaagaatgagaagtttaaaaacaagatcaaaaatggacccgatgactataagctctccgtgacaaacgagatgtacctggaagagatcaataaagtccttgatagccagattggcttcgggctgatcgacgacaactttaagaatgaatatctcgagatttacaactctcggcgccattattccgaaggacctggctactactatgccaaggatgccaatgggaacaaagtgaaggtgagaagcccctacggaggcgacctgatcaaaaagatgaccggcgtctgctctttcgataaaaaggctcgggcccctaagtatgctttttccagcgagctgttcgtttccatttctaaactcgtgaatctgagatacaagatcgacgatgacagctataaacaacttacgaaggagcagatcaacgaactgattgatgaggccaaaaataagaacaaggtgacctacaaatccctcatcaagattctggggatcaaaaatattaaggtcaaagaccttaacctgagcaagtctgaatatatcaaagtgatcgatgagctcaagaagaaactgaacatttccaaggaagagaaaatcgacatttacagcctggatgaggaaaataagaaaatctacgacgacatttataacgagaagctcttttctaagacactgatcgagttcaaaggatacaatcttctgaagaaagcgattaccctcagctataactccggcacatggaatgatgttaaggacaacatcgaatttctggatgagcttgccctgtactgtaccgactataaagtgaataacgaaatccaggagcacattcataattctctcatcattgatagccgcttcgacgattccaactttgtcgaaaatctgcccaacttcaaggaccacctgatgctcagcacggatatcattcggaagctgatccctatcatgcttgaggggattacatacgacaaagctatggataagatcggatataatcattctaacctgtacaaagacaccattaaggaagatctcctggtgccggtttacgtgtccaaaaatatcacaaaccagagagtcattcgcagcctgacccaagcccggaaggtgatcaacgctatcattaagaaatatggctctcccaagatcattaatatcgagaccgccagagagcttgcgaaaacacagaaggaacgccggattatcgagaaaaaccagcaggacaagcaatacgaaaatgagagaatcaaaaagcacctcgtcgaactggagctgttctccgacgagagcaagattacggggaacgatctcctgaaatataaactttggcaggaacagaaagagttttgcggatactccatgaagaaaatcaagctggaagacctcttctctaataacattgtgcagatcgatcacattctgccttatagccgcacctacaatgacaactatctgaataagacacttgtttacaccaaatacaaccaagataagggcaataaaacaccctatgagtggtttggcaagaccgacaaatggcaggaatacgaggccttcatcaactccctctctattagccagaataagaaggataactatctgctgaaaaatctcgaccaagatgctgagcgggaaatgagagagcagaacctgaacgacacgaagtacatctcccgcgaacttctgagcctcatcaaagcctatctgaatgtggatgaggtcaacgcttttcctggggccattacagccaagctgcgggctagatggggattcaatcggcttacccattcttacatctccaaaacctatattatgcccgaggacatgaagaagggcatcaacaaagatcgcgacaatcacctccatcacgcgatggacgccctggtgattgctagcatcacaaagtctctgcagcagaaaatcaccctctacgaaaagttttccagatacgttgatgggattacaaagaacgagctgggaaagatcagcacgggcaatattaacgacgatctttataattactatgacgaagagaccggggaaatcaaggagctggagctccggcaatacattaaaaaccaggtggcccagaataacatctatttctctaagcacaatgtcagcaaactgatctttccgacaccttacaacaatttcgtggaagaggccaagctgagagtgtatgaacgcgatcttgaggttctcaaatggaacctgaagaatctgggcacctacacatccagcgaactcaaccggattcatgtcctgatcccctctgtggctaaaaacaagatttccggaagacttcacgaggagacctactatggcctgaaggaagtggggatcggagaggacaaagtcacgtacaagaccctcaaaacacctattagcaaggtgaaaaagaaggatctggacaatatccccgattgtaaaggcgggtccaaggacatttataacgccctggttaaatggtttggaaattgcgaaaccggcgaggaagcgcttaagatgcatgatgggaaataccccgtgaaccctaatgacaaggagcagaaggagatccgcaaaatcaaggtctatacaaaatacaacgctaccggccacgtggttaataacggaaatgtggaaaagggcgggatttatagaatcgacgtcttcaaatctaagaacaaggaggataataaactgtactttacgagctacgacattttcgaaatcgagcaaattaaggcctatgagaaaggaaagaacatcaatttctccatcaaactcgaatacggccaggggaagaacaataaaattctgctctataaggatgtgaagaacgagtacgacctgatcatgtctatttataaaaacgatcttatccggattaagacaaaaaccggaaataagagcacagcctacgttgtgggcttttccgggggcaaactggaaatcaagtctaccatcggagacggctatgatattatcgggaacaataacattttcgacaagagcatggagcgctacagagtcacctccagcacaatcgtgaaaattgataagctctctatctccattctgggagaagtgagcggcctgtga

SEQ ID NO: 4047 - RNA, 3657 nt, synthetic construct
  misc_feature 1..3657: note = Cas9 variant
  source 1..3657: mol_type = other RNA
atgaacaagagaatcctgggcctcgacaccgggacaaatagcctgggatgggccgtggtcgattgggacgagcacgctcagtcctacgaacttattaaatatggcgatgttatcttccaagagggggtgaagattgaaaaaggaatcgagtctagcaaggccgcggaacggtccggctacaaagctattcgcaagcagtattttagacggcgcctgagaaagatccaggtgctcaaagtcctggtgaagtaccatctttgcccctatctgtctgacgatgacctccggcagtggcatctgcaaaaacagtaccctaagagcgatgagctgatgctctggcagcgcacgtccgacgaggaagggaaaaacccgtattacgatagacaccggtgtctgcacgagaagctggacctgaccgttgaagccgatcgctacacactcgggagagccctgtatcatcttacccagcggcgcggcttcctgtctaatagactcgacacaagcgctgataacaaggaggacggcgtggtcaaatccgggatcagccaactgtctaccgagatggaagaggccggatgcgaatacctgggcgactatttttacaagctctatcacgagcaggggaataaagtgcggattcgccagagatacacagatcggaagaaacactatcagcatgagttcgacgctatctgtgaaaagcaagagctgtccagcgaacttattgaggatctgcagagagccatctttttccagctccccctgaaatctcaacgccacggagttggccggtgcacctttgaaagagggaagcctcgctgtgcggactcccatcccgattacgaggagttccggatgctttgctttgtgaacaatattcaggtcaagggacctcacgacctggaactcagacccctgacgtacgaggaacgcgagaaaatcgaacacctgttctttagaaagagcaaacctaacttcgattttgaggacattgccaaggaactcgctggcaaaaagaattatgcctggatccatgataaggaggagcgggcttacaaattcaactatcgcatgacccagggcgtgccggggtgtcccacaaccgcccagctgaagtctatcttcggagacgattggaaaacaggcattgcggaaacctacacgcttatccaaaagaaaaatgggtccaagagcctgcaggagatggtggacgacgtctggaacgttctctattccttttctagcgtggaaaagctgaaagagttcgcccaccataaacttcagctggatgaggaaaatgctgagaaatttgccaagattaaactctcccacagcttcgctgccctgtctctgaaggccatccggaagtttctccctttcctgagaaaaggaatgtactatacacatgcttcctttttcgcgaacattcccaccatcgtgggcaaggaaatctggaataacgagcagagccgcaaatacattatggaaaacgtcggggagcttgtgtttaattaccaacctaagcaccgggacgttcagggaacaatcgagatgctgattaaagatttcctcgccaacaattttgaactgcccgctggcgccaccgacaagctgtatcacccgtctatgatcgagacctaccctcatgcccttagaaacgagttcggcattctccagctggggagcccccggacaaatgctatccgcaaccctatggccatgagatccctgcacgtgctccggagagtcgtgaatcagctgcttaaagaatctatcattgatgaaaacacggaggttcatgtggagtatgcgcgcgaactgaatgacgctaacaagcggagagccatcgccgatcgccaaaaggagcaggacaaacagcacaagaaatacggagatgaaattagaaagctctataaagaggaaaccggcaaggacatcgagcccacacagaccgatgtcctgaagtttcaactgtgggaggaacagaatcactactgcctttatacaggggagcagattggaatcaccgacttcattggcagcaaccccaaattcgatatcgaacatacgatccctcaatccgtgggaggcgacagcacacagatgaatctcaccctgtgtgacaaccggtttaatcgcgaggtcaagaaagctaagctgccgaccgagctcgccaaccacgaagagattctgacaagaatcgaaccctggaaaaacaagtacgagcagcttgtgaaggaacgggataaacagcgcaccttcgctggaatggacaaggccgttaaagatattagaatccaaaagcggcataaactgcagatggagattgactactggcgcggcaagtatgagagatttacaatgacggaagtgcctgaggggttctctcggcgccagggaaccggcatcgggctcatctccagatacgcgggactgtatcttaagagcctttttcaccaggccgattctcggaataaatccaacgtctacgtggttaagggcgtggctacagccgagttcagaaaaatgtgggggctccaaagcgaatatgaaaagaaatgccgcgacaatcattcccaccactgtatggatgctattaccatcgcctgcattggcaagcgggagtacgacctgatggcggagtattaccatatggaagagacatttagacagggacgcggctctaaacccaagttcagcaagccttgggccacctttacggaagatgtcctgaacatctacaaaaatctcctggtggtgcacgacacccccaacaatatgccgaagcatacaaagaagtatgttcagacctccaaagggaaggtccttgctcagggagatacagcccggggctctctgcacctcgacacctactatggggctattgagagagatggagaaatccgctacgtggtgcggagacctctgagctccttcacgaaccccaaggagctggagaatatcgtcgacgaaacagtgaaacgcaccattaaggaggccatcgccgacaaaaactttaagcaagctattgcggaacctatctatatgaatgaggataaaggcattcttatcaagaaggttcggtgcttcgccaacagcgtgaaacagcccatcaatattagacagcatcgggacctctctaagaaagagtacaagcaacagtatcacgtcatgaacgaaaataactacctgctggctatctacgaggggctcgtgaaaaacaaggttgtgcgcgaatttgagattgtctcctatatcgaagccgccaagtactataaaagaagccaggatcggaatattttctcttccatcgtgcctacacacagcaccaagtacggcctgccccttaaaaccaagctgctcatgggacagcaagttctgatgttcgaggagaacccggacgaaattcaggtggataatacaaaagacctggtcaagcgcctttataaggtggtgggcatcgagaaagatgggagaatcaagtttaaacatcaccaggaagctcggaaggagggactgacgatttactctaccccttataaaaacaatgacgattacgtccccatcttcagacagagcattaagaacatcaatattctcgttgacggcatcgattttaacatcgacattctggggaaagtgacactcaaggaatga

SEQ ID NO: 4048 - RNA, 3657 nt, synthetic construct
  misc_feature 1..3657: note = Cas9 variant
  source 1..3657: mol_type = other RNA
atgaacaagagaatcctgggcctcgacaccgggacaaatagcctgggatgggccgtggtcgattgggacgagcacgctcagtcctacgaacttattaaatatggcgatgttatcttccaagagggggtgaagattgaaaaaggaatcgagtctagcaaggccgcggaacggtccggctacaaagctattcgcaagcagtattttagacggcgcctgagaaagatccaggtgctcaaagtcctggtgaagtaccatctttgcccctatctgtctgacgatgacctccggcagtggcaccttcaaaaacagtaccctaagagcgatgagctgatgctctggcagcgcacgtccgacgaggaagggaaaaacccgtattacgatagacatcggtgtctgcacgagaagctggacctgaccgttgaagccgatcgctacacactcggcagagccctgtatcatcttacccagcggcgcggattcctgtctaatagactcgacacaagcgctgataacaaggaggacggcgtggtcaaatccgggatcagccaactgtctaccgagatggaagaggccggatgcgaatacctgggcgactatttttacaagctctatgatgctcaggggaataaagtgcggattcgccagagatacacagaccggaacaagcactatcagcacgagttcgatgccatctgtgaaaaacaagagctgtccagcgagcttattgaagacctgcagagagcgatctttttccagctccccctgaagtctcaacgccatggagttggccggtgcacctttgagagagggaaacctcgctgtgccgattcccaccccgactacgaagagttccggatgctttgctttgtgaataacattcaggtcaagggacctcatgatctggaactcagacccctgacgtacgaggagcgcgaaaagatcgagcctctgttctttcggaaaagcaagccgaatttcgactttgaagatattgctaaagccctcgctggcaagaaaaactatgcctggatccacgacaaggaggaaagagcgtacaagttcaattatcgcatgacccagggcgtgcccgggtgtcctacaatcgcccagctgaaatctattttcggagatgactggaagaccggcatcgctgagacatacacccttattcaaaagaagaacgggtccaaaagcctgcaggagatggtggacgatgtctggaatgttctctattccttttctagcgtggaaaagctgaaggagttcgcccaccataaacttcagctggacgaagagtccgctgagaagtttgccaaaatcaagctcagccactctttcgccgctctgtccctgaaagcgattcggaagtttctccccttcctgagaaagggaatgtactatacgcatgccagctttttcgctaacatccctacaatcgtgggcaaagaaatttggaataaggagcagaaccgcaaatacatcatggaaaacgtcggggagcttgtgtttaattaccaacccaagcaccgggaagttcagggaaccattgagatgctgatcaaagatttcctcgccaacaattttgagctgccggccggcgctacagacaagctgtatcatccttctatgattgaaacctaccccaacgcccagagaaatgagttcggcatccttcagctcgggagccctcggaccaacgcgatccgcaatcccatggctatgagatccctgcacattctgcggagagtggtcaaccaactcctgaaagaatctatcattgatgagaatacagaagtgcacgttgagtatgcccgcgagcttaacgacgccaataagcggagagctatcgccgatcgccagaaggaacaggacaaacagcataagaaatacggagatgagattagaaagctgtataaagaagagacgggcaaggacatcgaacccacccaaacagatgtgctcaagtttcagctgtgggaggagcagaaccaccattgcctgtacaccggggaacaaattggaatcacagacttcatcggcagcaatcctaaattcgatattgagcacaccatcccgcagtccgtcgggggcgacagcacgcagatgaaccttacactctgtgacaatcggtttaaccgcgaagtgaagaaagctaagctgcccaccgagctggccaaccacgaggaaattctcaccagaatcgagccttggaaaaataagtatgaacagctggtcaaggagcgggataaacaacgcacattcgcgggaatggacaaggccgtgaaagatattagaatccagaagcggcataaacttcagatggaaatcgactactggcgcggcaagtacgagagatttaccatgacagaggttcccgaagggttctctcggcgccagggaacgggcattgggctgatctccagatatgctggactctacctgaaaagcctgtttcaccaagccgattctcggaacaaatccaatgtgtatgtcgtgaagggcgttgctaccgccgagttcagaaaaatgtgggggcttcagagcgaatacgagaagaaatgccgcgacaaccattcccaccattgtatggatgcgattacaatcgcctgcattggcaagcgggaatatgacctcatggctgagtactatagaatggaggaaacctttaaacagggacgcggctctaagcctaagttcagcaaaccctgggccacatttaccgaggatgtgctgaatatctacaagaacctgctcgtcgtgcacgacacgccgaataacatgcctaaacacaccaagaaatacgtgcagacatccatcgggaaggttctggctcaaggagataccgcccggggctctcttcatctggacacatattacggggccattgaaagagatggagagatccgctatgtcgtgcggagacccctcagctccttcaccaagcctgaggaactggagaatattgtggacgaaacggtcaaacgcacaatcaaggaggctattgcggacaaaaactttaagcaggccatcgctgaacccatctacatgaatgaggagaaaggcattctgatcaagaaggtgcggtgcttcgccaaaagcgttaagcagcctattaacatcagacaacaccgggatctttctaaaaaggaatataaacagcagtaccatgtgatgaatgagaacaattatctcctggccatttacgaagggctggtcaagaacaaggtggttcgcgagtttgaaatcgtgtcctacattgaggctgccaaatattacaagagaagccaggaccggaacatcttctcttccatcgtccccacccacagcacaaaatatggcctcccgctgaagaccaaacttctgatgggacaactcgtgctgatgttcgaggaaaatcctgatgagattcaggttgacaacaccaaggatctggtgaagcgcctttacaaagtcgtgggcatcgaaaaggacgggagaattaaatttaagtatcatcaggaggcgcggaaagaaggactgcccatcttctctacaccctacaagaataacgatgactatgctcctatttttagacagagcatcaataacatcaatattctcgtggatggcatcgacttcacgattgatatcctggggaaagtcaccctcaaggagtga

SEQ ID NO: 4049 - RNA, 3657 nt, synthetic construct
  misc_feature 1..3657: note = Cas9 variant
  source 1..3657: mol_type = other RNA
atgaacaagagaatcctgggcctcgacaccgggacaaatagcctgggatgggccgtggtcgattgggacgagcacgctcagtcctacgagttcattaaatatggcgatgttatctttcaagagggggtgaagattgaaaaaggaatcgagtctagcaaggccgcggaacggtccggctacaaagctattcgcaagcagtatttcagacggcgccttagaaagatccaggtgctgaaagtcctcgtgaagtaccatctgtgcccctatctttctgacgatgacctgcggcagtggcacctccaaaaacagtaccctaagagcgatgagctgatgctgtggcagcgcacgtccgacaaaaaggggaagaacccgtattacgatagacatcggtgtctccacgagaaactggaccttaccgttgaagccgatcgctacacactgggcagagccctctatcatctgacccagcggcgcggatttctttctaatagactggacacaagcgctgataacaaggaggacggcgtggtcaaatccgggatcagccaactctctaccgaaatggaggaggccggatgcgaatacctgggcgactatttctacaagctgtatgatgagcaggggaataaagtgcggattcgccagagatacacagaccggaacaagcactatcagcacgaatttgatgctatctgtgagaaacaagaactctccagcgagctgattgaggaccttcagagagccatcttctttcagctgcccctcaagtctcaacgccatggagttggccggtgcaccttcgaaagagggaagcctcgctgtgcggattcccaccccgactacgaggaatttcggatgctgtgcttcgtgaataacattcaggtcaaaggacctcatgatcttgagctgagacccctcacgtacgaagaacgcgagaagatcgaacctctgtttttccggaaaagcaagccgaattttgacttcgaggatattgccaaagctctggccggcaagaagaactatgcttggatccacgacaaagaagagagagcctacaagttcaattatcgcatgacccagggcgtgcccgggtgtcctacaaccgcgcagctcaaatctatctttggagatgactggaagacaggcattgccgaaacctacacgctgatccagaaaaagaacgggtccaagagccttcaagagatggaggacgatgtgtggaatgtcctgtattccttctctagcgttgaaaaactcaaggagtttgctcaccataaactgcagcttgacgaagagtccgccgagaagttcgctaaaattaagctgagccactcttttgccgccctctccctgaaggctatccggaaattcctgccctttctcagaaagggaatgtactatacacatgcgagcttctttgccaacattcctaccatcgtgggcaaagaaatctggaataacgagcagaaccgcaagtacattatggaaaatgtgggggagctggtcttcaactaccaacccaaacaccgggaagtgcagggaacaatcgagatgcttattaaggattttctggctaataacttcgagctcccggccggcgccaccgacaaactgtatcatccttctatgatcgaaacctacccccacgctcagagaaatgagtttggcattctgcagcttgggagccctcggacaaacgccatccgcaatcccatggcgatgagatccctccacatcctgcggagagttgtgaaccaactgctcaaggaatctattatcgatgagaatacggaagtccatgtggagtatgctcgcgagctgaacgacgccaataagcggagagccattgctggatggcagaaagaacaggataagcagcacaaaaagtacgttgacgagatccgcaaactttataaggaagagaccggcaaggatattgaacccacacaaaccgacgtgctgaaattccagctctgggaggagcaggatcatcactgcctgtacacaggggaacaaatcggaattaccgacttcatcggcagcaaccctaagtttgatatcgagcacacgattccgcagtccgtcgggggcgacagcacacagatgaatctgaccctttgtgacaacagattcaatcgggaaatcaaaaaggccaaactccccgctcagctgtctaaccatgaggagattctggcccgcatcgaaccttggaagaacaagtatgagcagaaaattaaggaaagagataaacaacggacctttgcgggaatggacaaggccgtgaaagatctccgcatccagaagagacacaagctgcagatggacatcgattactggcggggcaaatacgagcgcttcacaatgaccgaagtccccgaggggttttccagacggcaaggaacaggcattgggcttatcagccgctatgctggactgtacctcaagtctctgttccatcaggccgactccagaaataaaagcaacgtgtatgttgtgaagggcgtcgctacggccgagtttcggaaaatgtgggggctgcagtccgaatacgagaagaaatgcagagataatcactctcatcactgtatggacgcgattaccatcgcctgcattggcaagcgcgaatatgatcttatggctgagtactatcggatggaagagacattcagacagggacgcggcagcaagcctaaattttccaagccctgggccaccttcacagaggacgtgctcaacatctacaaaaatctgctggttgtgcacgataccccgaacaatatgcctaagcatacgaaaaagtacgtccaaacctctaaggggaaagtgctcgctcagggagacacagcccggggcagcctgcaccttgatacctattacggggccatcgaaagagacggagagattcgctatgtggttcggagacccctgtccagctttacaaagcctaaagaactcgagaacatcgtcgacgaaaccgtgaagcgcacgattaaagaggctatcgcggataagaatttcaagcaggccattgctgagcccatctacatgaacgaagacaaaggcatcctgattaagaaagtgcggtgctttgccaagtctgtcaaacaacctatcaatattagacagcatcgggatctgtccaagaaggagtataaacagcagtaccacgtggttaacgaaaataactatatgcttgtgatctacgaggggctcgtcaagaataaagtggttcgcgagttcgaaattgtgagctacatcgaggccgctaagtattacaaaagatctcaagaccggaacattttctccagcatcgtccccacacattctgccaagtatggcctgccgctgaagaccaaactcctgatgggacagcttgtgctgatgtttgaagagaaccctgatgaaatccaggttgacaatacaaaggatctcgtgaaacgcctgtacaaggtcgtgggcattaaaaaggacgggagagtgaaattcaagtttcaccaggaggcgcggaaggatggactgcttatcttcagcaccccctataaaaacaataacggctacgtccccatttttagacactccaagaaaaatatcaacattctggttgacgggaaggatttcaccatcgacatcctcggaaaagtgacactgaaggagtga

SEQ ID NO: 4050 - RNA, 3660 nt, synthetic construct
  misc_feature 1..3660: note = Cas9 variant
  source 1..3660: mol_type = other RNA
atgaaggaggaagtgagaggcaaaaaccggagccagacctgggccatcctggctaagttctttgtctggtccgagaaagaatctgtttggaatgagaaggaagcccgcacagaggagagagtgaaagaatacaagctcgtggggctgaagcgggacacgaaaggaaacgagcttaagctggaaaattatcgctggagagtccaagcgctcagcgagcagctgaaccccgagattgtggctatcgttcttcaggaaattaatggccagatctccgcctctagcgggtacctgggagccatttccgatcggtctaaacaactctatttcaaccgccagaccgtgggccagtacctgatgagcgagctggaaaaggaccctaatgtctccctcagaaaccgggtgttttatcgccaggattacctggacgagttcgatagaatctgggaaaaacaagctgagtttcacgaggaacttacagttgagctgaagaaggaaatccgggacattatcattttctatcagcgcagactcaaaagccagaaggggctgatctctttttgcgagttcgaaaaacgggaggtggtcgtggaggaagatggacgcaagaaaaataagaccgtgggctgtagagtcattccgcggtcccatcccctttttcaggagttcaaaatctggcaaacactgaacgacattgaagtttttgcctgggataagcagagcaagagaaagaaggctgacaaatcttccatcctcttcgataatagcgaggacgccctgctggtggaaggcaagcgctttctctaccaggaggagaaagaactgcttgcgaaggagctgttcgtgaaggaatctatgaaaaaggccgaggtcctcaaactgcttttcgagaactaccaagaactggatctcaattttaagcagatcgacgggaaccacaccggattcgctctgttttccgcctatagcaaaatgattgagaagtacggctatgaacctgtggacttcaagcggtccgctgatgagatcattgaaaaactggagacaatctttaccaatctcgggtggaacacggagctgctttctattgacctgagcaaggaagataaagagctcgaaagacagtcctacttccgcctgtggcatcttctgtatagctttgagggagacaacacccccacaggcaatgggaagctcctggagaaaatcatgcagctgtgcgatgttgagaaggagtacgccgtggaactcgcgaacgtctctttccaagaggactatggatccctgagcgccaaggctatcaaaaagattcttccttacctgaaagaaggcaatcagtacgatgtggcctgtgactatgctggctaccggcactctagaagctccctcaccaaggatgagatcgaaaacaaaattctgaaggacaaactggagatccttcccaaaaattctctccgcaaccctgttgtggagaagattctgaatcagatggtcaacctgatcaatacactcatcgatacctatgggaaaccggacgaaattcgggtggagctggccagagaacttaagaaaaacgccaaggagcgcgaggaactgacgaaaagcatcgctcggaatacaagagagcatgacgaaattcgccagctcctgcggaccgagtttggaatgatgaacgtctccagaaatgatatcattcggtacaagctgtatgaagaacttaaggacaacggctacaaaacactctatagcaatgagtacatcccccgcgaaaagattttctctaaagagatcgatatcgaacacgtgattcctcaagcgagactgtttgacgattccctgagcaacaagaccctcgagtaccgggccatcaacattgaaaaagggaataagaccgcttatgacttcgttaaggagaaatacggaaacgatggcctggagaagtttcttaatagatgcgaaacactgttcaaagacaagcgcacgaaactccggaagctgaagatggaggaaaaagatatccccgaggggttcattgacagagatctgcgcaacacccagtatatctctaagaaagcctttgccatgcttaatgaaatctccagacgggtggtcgctacaaccggaagcattacagacaagctccgcgaggattggcagctggtggacctgatgaaagagctcaacctgcctaagtacgaaaaacttggcatggttgagatgttcgaagacaaggatggcagaaagatcaaaaagattaccgactggacgaaacggaatgatcaccgccatcacgccgtggacgcgctgacagtcgcttttaccaaggatgtgttcatccagttttataacaataaaaacgccgcctggatgcccgcttccaaggagcatgccaatattaccgggatcaaggctagatacttcgagaacggaaaagccctcgcgccgatgcctctggcccaatttcgggctgaagccaagcgccacctggagaatcttctcgtgtctatcaaagctaagaacaaagttattacaagcaatgtcaacagaaccaagaacaagaatggcgaaaaccggaaactgcagcagacaccccgcgggcagctgcacctcgagacggtgtatggatcccatagacaatacgccaccaagatcgaaaaagtgaatgcggccttcgacgtcacaaagattgctaccgtgtctaaactggcctaccggaacgcccttctgaagagactcgaggcttttggcaatgatcctaagaaagccttcacagggaagaacaccctggagaaaaatcccctgtatcttgacgaaaaccagacggagatggttcccgaaaaggtgcagaccgtcgagtttgaaacagtgtacaccatccgcaaacctattgatccgaatctgagcatcgacaaggttgtggatgtcaagatccggtccgtgctcgagaaaagactgaaggagtatggcggagacgctaaaaaggcgttcgttaacctcgatgaaaatcccatttggctgaacgaggccaaaggcatcagcattaagcgcgtgtctatccgggggatttccaatgctcaaagccttcacgagaaaaaggacaaggacggaaacctgatcctcggcaaagaagggagaaagattcctgtcgattttgtgaatacaggaaacaaccatcacgtggccatctacaaaaagcccgtcctggacaaagttggccaggtggtgctggatgaagaggggaatcctaagtatgagcttgacgaagtcgtggtttctttcttcgatgccgtgacccgcgctaacctgggccagcccatcattgacaaggattaccggagatccgagggatggcagtttctcttcagcatgaaacaaaatgaatattttgtcttcccgaacgacaagacgggctttaatcctaaagaggtggatctgctcaaccccgagaattacgccctgatctctcctaaccttttccgcgttcagaagtttgcgtacaaaaattatgtgttccggcatcacctggaaacaaccattaaggacacaagctccaccctcaaggggatcacctggacagattttagaagctctaaaggactggacaagattgtcaaagtgcgggttgaccacatcggccagatcgtgtccattggggagtactga

SEQ ID NO: 4051 - RNA, 3663 nt, synthetic construct
  misc_feature 1..3663: note = Cas9 variant
  source 1..3663: mol_type = other RNA
atgaagagaatcctgggcctcgacctggggagcgcctccattggatgggctcttatcgaggaagatgagaaaggcattcggatcattgccctggggtctcgcatcatcccctacaacggaaccgaaggccaggacttcgcgaagggggctggagagagcagaaattccctccggacacaagcccgcacgaccagaaaaggctatgatcggtaccagctgcgcagaaagtatcttattaacgtgctggagaaaaatctcatgatgccttctgaagacctgcggaagatgccgaagatgaacctgtggcagctccgcagcaaagccgtcacagagtacatctccagacaggaactgggccggcttctgctctggctgaatcaaaagcgcgggtataaatctagcagatccgatgctaaccttgacaagaaagataccgactacgttaaggaggtcaagagccggtttgataaaattaaggagaaaaatcagacaatcggacagtatttctacgaatctctgcagtgcgacgagtactttcgcgtgaaggaaaacgtgttccccagagaggcctatattgctgaatttgatgccatctgttcccggcaaaaagaccacctcggcctgagcgaggaactgattgcggagatcagaaatgagatcatttactatcagcgccctctcaagtctcagaaagggctggtgtccgtttacgatttcgaaggaaagtggatgaaccagaatggcaaggagctttttatcgggcccaaagtggcccataagagctctcctctgttccaactcgctaaaatttgggaatccgtcaacaatatcaagctgagcaccaaatatggagacacaattgagcttaccctggaagagaagaagcagctcgtggagtttctggacaacaatgaaaaactgacgaccgccgctctcttcaagatcctgcggaaagataagaaagagtacatccttcccaagcagctggaaaagggcctccaaggcaacattacaaaatgcaagatcgccgacattctggggtccaaatataaccagcttctgcagctcaatctggagaagcaggaagttggaaccccttgttacctgtacacaaaatctaccggcgaggtgctcggggagaagccgctgcaatatatcgataagagcgtcgaaaaagagctgttttaccagctttggcacacgatttattccatcagcgacgaagatgagtgctgtaaggcgctccagaaaagattcgacatcgatgccgagacagctggacgcctggccaagattgacttttctaaatacggcttcgggaacaagtccgctaaagccatccggaagattctgccctatcttatggaaggagataagtacagcgacgccatgtgctatgctggctacaatcattctaacagcctcaccaaagaggaaaatcacgagagaaagctgaacgataaactgaagctcctgaccaaaaattcccttcgccagcctatcgtggaaaagattatgaaccaaatgatccagctggtgaatacaattatcgacaagtacggcaaacccgacgagatccggctcgagctggcgagagaactgaagcagtctaaagaggaacgcaacgatgccgacaaggctatgagcaaacggcagagagagaataaggaagccgagaagaaacttgaggaacatgggattcgcgccacccacaacaatatcctcaagtatcggctgttcgaggaaatgggagagaaaaagcacgaagctatttgtatctactgcggcaaccctatttcctttagcgccgcgatgaatggggatgaggtcgacgttgagcatatcatccccagatctaaactgttcgatgactcccaaagcaacaagacactcgctcaccggaagtgtaacgccaataaaaacgatatgacggcctatgactttatgaagaccaaatctaagcaggatttcgacaaatacgtggaacgcgtgaatcagctgtatgctgatagaattatctcccggagcaagtacaacaaacttctgatgtccgaggacgatattccgtctaattttatcgacagacagctccgcgaaagccaatatattgccacaaaggctcgggagatcctgcagaccatctgctacaacgtctggtccacatctggaaccgtgacggccgagctgagacatctttggggctgggacgatattacaatgaatctccagatgcctaagtacaaagaactggggctgaccgagatggttgaatggaccagcgaccacggcaagaacgtgcactccaaagaggtcatcaagggatggacaaaacgcgatgaccatagacaccatgcgattgatgccctcaccatcgcttgtacaaagcaaggcttcattcagcggtttaatacgctgtctagctccaagacccgcgacgatatgcagaaagaacttgagaagtgcagcatccagttcagagagaaacggtctctgctcgaaaagtatatcatttcccaacgccccatcagcgtgtctgacgttgccgaggctgtgagccggattctgatctcctttaaagccgggaagaaggtcgcgacaattggaaaaagaaaggtgaaaggcaaggtcgtgcagcaggggatcgttgtgcctcgcggagccctgagcgaaggctctgtctacgggaaaattagaaccatcgtgcggaagatgcccgttaagtatcttttcgagaaccccgatctcatctttaaaccttacattaaggctctggtgaaagaacgcctggccgagttcgacaatgataacaagcaggctctcgcctccctgaaaaagaatccggtctatcttgacaaggagaaaacaaagctgctcgaatacggaacctgctttaaagatgagtatgtgaagaaatacgacgtgaaccccaatttcacgaagatcgccgacgttattgatggcaaagtcaagcaaatcctggaagacagactgagcaagttcggcgggaaacctaaggaggcttttaaagatgtggtgaaggacggaaaaacccttaagtggtacgaagatgagggcctggagcggcccattagatccgtccgctgtctcacagggctgtctgcggtggttcctgtgaagaaagacgaaaacggaatggatatcggcttcgtcaagcccgggaacaatcaccatgtggccatctatgttggcgctgacggaaaaggccaggagcacgtgtgcaccttttggaacgccgtcgaacggaagaaatacgggctcccgattatcattaaggatgccaatgaggtgtgggacaagatcacaatggctggagatgacgtttatcctcagagcttcctgtcccttctgcccaaacctgactggaccctcaagctgtctatgcagcaaaacgagatgtttattctgggcatggaagaggatgaagtgaaattcgccatcgagagcaaggactacaaacttctgtccgatcacctctatagagtccagaagctgtctagctccgactacaattttatccatcacctcgaaacggatgtgcagaagaaaacaatgacctatcgcgtgcggagcctgtctgggcttttcgcgctgagaccctttaaggtccgcattgactgtctcggaaacatcattccttcctga

SEQ ID NO: 4052 - RNA, 3669 nt, synthetic construct
  misc_feature 1..3669: note = Cas9 variant
  source 1..3669: mol_type = other RNA
atgaagaaaagaatcctgggcctcgacagcgggaccaactccctgggatgggccgtggtcgatcgggacgagaataaccagtactctcttattaagtatggcgatctgatcttcgaagagggggttaaaattgaaaagggagtggagagctccaaagctgccgaacgcacatctcacagagcgctccggaagctgtactttcgcagacggcttcgcaagatcgaggtgctgaaagtcctcgtgaagtataatctgtgcccccaagttagcgaggaggaactgcatctctggcacacgagaaaactgtaccctcagaacaaggaccttctgcagtggcagcggaccgatgaaaaagctggcaagaatccgtatatttaccgctatagatgtctccatgaggagctggacatgtccgtgtctgccaaccggatgacagtcgggcgcgccatgtaccaccttgctcaaagacggggattcctgagcaatcgcctcgataacgaagaggacgaaaatcagatcggcgccgtgaagtgcggcatctccaacctgaccgaggaaattcagagctctgggtgtaaatacctgggagagtatttttacaagctctataatgagcatggcaacacagttagactgcggaccagatacacatcccgcgagttccactataaaaaggaattttacgctatctgcgaaaaacagaagctggataaaaagctgattgaggaactcgccagcgcgctgtatttccaacggccccttaagtctcagagacacaccgtggggcgctgtacgtttgagcctaataaaccccggtgcgccgactcccatcctgcttacgaggagttcagaatgctgagctttatcaacaccattaaggtccagggaccctacgatacagaactccgcgtgctgaataccgaggaacgggactctatcacaaaactgttctgtagaaagtccaaacctaactttgatttcgaagacattgccaaggagctcgctggccgcaacaattattgctacatcggggacgtggtcgataaggcctataaatttaactaccggatgagccagggagtttccggctgtccgaccacgacatatctgatcaatgtgttcggccaagactggcagaccgggattgcggagtcttaccaggccatcgatacaaaacttggacaaaagagcgtggacgctatgattgatgacgtctggaacgtgctgtattccttcagctctaaggataaactcagagactttggccgcaagaagctgcagcttggggataaagaagccgacaccttcgctaatatcaagctgacccacaaatttgcctccctcagcctgaaggccattcggaaaatcaacatcttcctgagaatgggactcgtttactctcatgctgtgacactggcgaatattcccacgatcgtcggcaccgatatttggcagcggaagcgcaactttatccttgccgagctgctccctctgattgaaaatttcaaccccaaggagacaaaactgcaggagacccttgacttttgcgtgaaggacttcctccaaaataactttgaactgaaaaatggggctgttgataagctgtaccaccctagcatgatcgaggcctatcccgacgccggactcaactccaatggcatcctgcagcttggctctccgagaacaaacgctattcggaaccctatggccatgagaagcctgcacgaaatccgcaaagtgattaatcagctcctgaaggataaaatcattaaccaggacaccgagatccatgtcgaatacgcgcgggagctgaatgatgctaacaagagaaaggccatttccatctggcaaaagagccaggagaaacttcacaaaaagtatgtggaagagatcacgaatctctacaaagaagagacagggaaggccattgtccccaccgacaccgatatcctgaagttcaaactgtgggaggaacagaaccatatttgtctctatacaggacagcaaatcggcattgctgagtttctgggggccacccctaagtacgacatcgaacacacaatcccccagtctgtgggaggcgattccacggacatgaatcttaccctgtgcgatagccgcttcaacagagagattaaaaaggctcagctccccacacagctggggaatcatgccgacatcctggttcggattgcgggctggaaaaactcttatgaaaaactttccaaggatatcgaccgcattagaacccacagcggaatggccaaggacatcaaggatcggctcatccaaaaacgccatctgctgaagctcgagagagactactggcggggcaaatacgaacgctttacaatgaatgagattcctgaggggttctccagacggcagggagtgggcatcgggctgatttctaagtatgctggactttaccttaagagcctcttccacgataaaaacgaacgcaataagggccacgtctttgtggttaaagggaccacgaccgccgagttcagaaagatgtggggcctgcagaacgaatatgagaaaaagtcccggaataaccatgtgcaccactgcatcgacgctattacaatcgcctgtatcggaaaacatgagtacgcgcaaatggcccagtattaccacgatgaagctgagtatctgtaccatcacggcattaagccgatctttcccaagccttggaaaaccttcacagaagaccttctcgatctggagcattctctgtttgtcgtgcaccacagccccaacaatatggccaagcaggctagaaaacgcattatcacctccacggggcagcattgggcccaaggagacagcgcccacggctctctccataacgatacatactatggggctattgaacgggacggagagatcaagtacgtggttagacgcgcggtctccagcttcgagcagatgtctgatgtggactccattgtggatgacgtcgtgaaagaaaccgttcggaaggccctggagggcaagaattttaaagaagctgtgaacgcccctatctatatgaataaggagaaaggggtccttatcaagaaagtgagatgctacgccaagagcattaagaaacccatcgacattcgcacacaccgggattctagctccaaggaatataaaagaaagttccatgttagcaacgacatcaattacctgattgctatctatgagggcaccgtgaaaggaaaggtcaagcgcgattttgaggtggttaaaaacatcgaagccgcgaatttctttaagcggtctcaggacagacgggattacccgaccattgtgcctgagaaatccatcaagcacggcttccccctcaaaacaacgctgaccaacgggacaatggtcattctgtacgaagagaataaggaagagatcgactttaccaagaaagaggatatttgtcgcagactttataagctggtgggaatgagctccatgatcgtgtctggctgcgaatacggggtcctcagcctgcggcaccatcaggaggctcgcccttccaaagacatcaagtctaaaaacggagccttcaagaatggcgaagccctcagacccgctattacaatgctgcacacccaattcaacgcccttgttgagaatatcgattttaacattgacgtgacggggaacatcgagctgatttga

SEQ ID NO: 4053 - RNA, 3669 nt, synthetic construct
  misc_feature 1..3669: note = Cas9 variant
  source 1..3669: mol_type = other RNA
atgaagaaaagaatcctgggcctcgacagcgggaccaactccctgggatgggccgtggtcgatcgggacgagaataaccagtactctcttattaagtatggcgatctgatcttcgaagagggggttaaaattgaaaagggagtggagagctccaaagctgccgaacgcacatctcacagagcgctccggaagctgtactttcgcagacggcttcgcaagatcgaggtgctgaaagtcctcgtgaagtataatctgtgcccccaagttagcgaggaggaactgcatctctggcacacgagaaaactgtaccctcagaacaaggaccttctgcagtggcagcggaccgatgaaaaagagggcaagaatccgtatatttaccgctatagatgtctccatgaggaactggacatgtccgtgtctgctaaccggatgacagtcgggcgcgccatgtaccaccttgcccaaagacggggattcctgagcaatcgcctcgataacgaggaagacgagaatcagatcggcgctgtgaagtgcggcatctccaacctgaccgaagagattcagagctctgggtgtaaatacctgggagagtatttttacaagctctataatgaacatggcaacacagttagactgcggaccagatacacatcccgcgagttccactataaaaaggaattttacgccatctgcgagaaacagaagctggataaaaagctgattgaggaactcgctagcgccctgtatttccaacggccccttaagtctcagagacacaccgtggggcgctgtacgtttgagcctaataaaccccggtgcgcggactcccatcctgcctacgaagagttcagaatgctgagctttatcaacaccattaaggtccagggaccctacgatacagaactccgcgtgctgaataccgaggaacgggactctatcacaaaactgttctgtagaaagtccaaacctaactttgatttcgaggacattgctaaggagctcgccggccgcaacaattattgctacatcggggacgtggtcgataaggcttataaatttaactaccggatgagccagggagtttccggctgtccgaccacgacatatctgatcaatgtgttcggccaagactggcagaccgggattgccgaatcttaccaggcgatcgatacaaaacttggacaaaagagcgtggacgccatgattgatgacgtctggaacgtgctgtattccttcagctctaaggataaactcagagactttggccgcaagaagctgcagcttggggataaagaggctgacaccttcgccaatatcaagctgacccacaaatttgcttccctcagcctgaaggccattcggaaaatcaacatcttcctgagaatgggactcgtttactctcatgccgtgacactggctaatattcccacgatcgtcggcaccgatatttggcagcggaagcgcaactttatccttgcggaactgctccctctgattgagaatttcaaccccaaggagacaaaactgcaggaaacccttgacttttgcgtgaaggacttcctccaaaataactttgagctgaaaaatggggccgttgataagctgtaccaccctagcatgatcgaggcttatcccgacgccggactcaactccaatggcatcctgcagcttggctctccgagaacaaacgccattcggaaccctatggctatgagaagcctgcacgaaatccgcaaagtgattaatcagctcctgaaggataaaatcattaaccaggacaccgaaatccatgtcgagtacgcccgggagctgaatgatgcgaacaagagaaaggctatttccatctggcaaaagagccaggaaaaacttcacaaaaagtatgtggaggaaatcacgaatctctacaaagaggaaacagggaaggccattgtccccaccgacaccgatatcctgaagttcaaactgtgggaggagcagaaccatatttgtctctatacaggacagcaaatcggcattgccgaatttctgggggctacccctaagtacgacatcgagcacacaatcccccagtctgtgggaggcgattccacggacatgaatcttaccctgtgcgatagccgcttcaacagagaaattaaaaaggcccagctccccacacagctggggaatcatgctgacatcctggttcggattgccggctggaaaaactcttatgagaaactttccaaggatatcgaccgcattagaacccacagcggaatggcgaaggacatcaaggatcggctcatccaaaaacgccatctgctgaagctcgaaagagactactggcggggcaaatacgagcgctttacaatgaatgagattcctgaagggttctccagacggcagggagtgggcatcgggctgatttctaagtatgccggactttaccttaagagcctcttccacgataaaaacgagcgcaataagggccacgtctttgtggttaaagggaccacgaccgctgagttcagaaagatgtggggcctgcagaacgaatatgagaaaaagtcccggaataaccatgtgcaccactgcatcgacgccattacaatcgcttgtatcggaaaacatgaatacgcccaaatggcgcagtattaccacgatgaggccgaatatctgtaccatcacggcattaagccgatctttcccaagccttggaaaaccttcacagaggaccttctcgatctggaacattctctgtttgtcgtgcaccacagccccaacaatatggctaagcaggccagaaaacgcattatcacctccacggggcagcattgggctcaaggagacagcgcccacggctctctccataacgatacatactatggggccattgagcgggacggagagatcaagtacgtggttagacgcgctgtctccagcttcgaacagatgtctgatgtggactccattgtggatgacgtcgtgaaagagaccgttcggaaggcgctggaaggcaagaattttaaagaggccgtgaacgctcctatctatatgaataaggaaaaaggggtccttatcaagaaagtgagatgctacgccaagagcattaagaaacccatcgacattcgcacacaccgggattctagctccaaggagtataaaagaaagttccatgttagcaacgacatcaattacctgattgccatctatgagggcaccgtgaaaggaaaggtcaagcgcgattttgaagtggttaaaaacatcgaggctgccaatttctttaagcggtctcaggacagacgggattacccgaccattgtgcctgaaaaatccatcaagcacggcttccccctcaaaacaacgctgaccaacgggacaatggtcattctgtacgaggaaaataaggaggagatcgactttaccaagaaagaagatatttgtcgcagactttataagctggtgggaatgagctccatgatcgtgtctggctgcgagtacggggtcctcagcctgcggcaccatcaggaagcgcgcccttccaaagacatcaagtctaaaaacggagctttcaagaatggcgaggccctcagacccgccattacaatgctgcacacccaattcaacgctcttgttgagaatatcgattttaacattgacgtgacggggaacatcgaactgatttga

SEQ ID NO: 4054 - RNA, 3678 nt, synthetic construct
  misc_feature 1..3678: note = Cas9 variant
  source 1..3678: mol_type = other RNA
atgagcaagagaatcctgggcattgacgtggggaccaactccctcggatgggccgtcgttgatcggacagactgcgataattacacgctggtgaaacgcggcgacgtgatcttccaggagggggtcaacattgaaaagggaaatatcgagaaatctagagctagcgaacggaccggccaccgctccacaagaaagcattattttcggcgcagaatgcttaaaattaaggtgctggagatcctcgttgaacaccaactgtgtccctacctttctcatgaggagctgcaccagtggatgacccggaaggtgtatcctacaaacgaagatttccgcctctggctgagaaccaatgacgccaacgatcagaatccgtaccatgaccggcacgtctgcctgcacgagcgcctcgatctgagacttcaggaaaaccggtatcgcctggggagagcgctctaccatctggctcaacggagaggatttcttagcaatcgcctggagcagaactccaaaacagacgagaccggcgccgtgaagtctgatatcagccagctcaatgaagagatgaaaaaggccggctcccagtatctgggggactacttctactggctgtatcaagaatacggaaaccaggttacgctccggattagatataccgatcgcaaacagcactaccagaaggagtttgaagctatctgtcaacggcagcagctgagcgacgaccttgtggataagctgagacgcgccatttatttccaacggtctctcaaatcccagagagctggcgtcgggaagtgcacatttgagcccgacaaacctcgctgtgccctgagccatccccggtacgaggagttcagaatgctttcttttctgaataacgtgaaggtgaaaggaccttccgatgacagcctccgccccctgtctccttccgagaaggaaaagatcaagccgctgttcctcagaaagagcaaagcgaattttgatttcgaggacattgccaaggctatcgccggcaaagggaagtatgcttgcattcgggataaagaaggagcccagaagccctaccagtttaactacgcgctgtcccaaggcgtctctggctgtcctgttaccgccaaacttatcgctgtgttcggggagagctgggagcggaacctggtgaatgcctatcgctccagaaacgacatgcggaaaagcgatgaagagatcgtcaatgaagtgtggaacgttctctactctttctccagcaaggagaaactgagagcttggggaatggaaaaacttggcctggacgaggcctgcgccggggagtttgctgatattacactccccaccgcgttcgccgctctgtctctgaaggccgtgaataagatcctcccttttctgcgccagggattcatttatagccacgccgtcatgcttgctaacatcccctacattatcggcatggaccggtggaatgaaccgagacagcgccagtttatcatggacaacctgcaagagctcctggataatttcacggcctccgacaaggcgctgcagcagacacttgatttttgtattaaagacttcctcctgaacaattatgaactggctcctgggaaggccgatagactctaccacccctctatgatcgagacctatcctgacgccaaagctgatggacagggcatttaccaactgggcagccccgccacaaacgctatccggaatcccatggccatgcgctcccttcatattctgagacgggtggttaaccagctcctgaaggagaaaaccatcgacagcgaaaccgaggtgcacatcgaatacgcgcgcgagctgaatgatgccaacagacggtgggctattaaccagtggcagcgcaagcaagaaacacagagaaaggactatgccgagaaaatccggaaggtctacgctgatgagtttgaaaaagtgattgagcctacgcaggaagaacttctcaagtatcaactgtgggaggaacagcagcatctgtgcctctacaccggggagcagatcggactgacagacttcattggcccgaatccccgctatgatatcgaacacaccattcctcaatctatgggaggggactccacaagaatgaaccttaccctgtgtgagcggacgtacaatagaacagtcaaaggcaaccgcatgcccagccagctcgccgaacatgagtctatcctgacccggatcaagccttggaaagacaagtatgaggaactgaccgtgaagattaataaacttagaacacaccccgggatggataaggcgtccaaagacaacatcattcgcaagcggcacctcctggagctggaaagagattactggtttcagaaataccagcgcttcaccatgacagaggttccggaaggctttagcctccggcaaggaacgggcatcgggctgattggaaagtatgccggccttttcctgaagtccctcttccatcacgtgaaagagagaaatcgcaagcaggtctacgtgatcaaagggcctatcaccgctgagtttcggagactgtggggactgcagaacctttatgaacagaagtctcgggacaatcatgcccaccactgcattgatgctatcgttattgcctgcatcaaccccgccgagtacgctcgcatggcgagctattacagacaagaagaggacttccggctcaataaaggcaacaagcctgtgtttcccaagccttggacaaccttcacacaggatctgcaggccctggaagctgagctcctggtcgtgcatgagacccgcaataaccttacgaaaaaggccagaaaacgggtgagaaccaaagggggcaatgttctgtccgaatctgacagcgcccgcggatccctccacaacgatacatattacggcgctattcaaaaggacggggtcatccggtacgtggtgagaaaggccctgagctctctgtccgagaaggatgtcaaagacatcgtggataagaccgttcgcgaaaaagtgcaggcggctattcaggagaagggagccaaagaagcccttgctggcacaatctatatgaacgaggagaaggggattaccatcaaaaaggtccggtgttttacgaagattgccagccccctggcgatcagacgccatcgggacgcttctgccaaagaatacaagagaccgtattacgtgacaaatgagtccaactatgttatgggaatctacgaaggctgcattaaagagaagaccaaacgcgagttcatcctcgtgaataacctggaagccgtcagacagctcaaggctgcccggaagcaaggggtggttagctctattctgcctcccgtgagcgctaaatcccagtttccccttaagtatcgcctgtacacaggcaccctcgtcctgctgtacgagaatagccctgaagagatcgacttcaccaaccaggtggatatttgtaaaagactttataaggtgacaggactgtcttccatgacggtcaccggcaatcagtacgggacaatccaactccggtatcaccaggaagcccgccaggcgaaagacctgaaggcccagaacggagcttacaaggagggcgaggaacatagaccggccattatgatgctccacacccaatttaaagctctggttgaggggacagatttccggatgaatatccttggagaaatcgagcccctgagaaagtga

SEQ ID NO: 4055 - RNA, 3690 nt, synthetic construct
  misc_feature 1..3690: note = Cas9 variant
  source 1..3690: mol_type = other RNA
atgggcgacagaaagtacaacctggggctcgatatcggaaccagctccattggcttcgccgctgtggacgagaataaccagcccatccgggtcaaagggaagacagccattggagttcgcctgtttgaagagggcaaaacggcggctgatagacgggggttccgcaccacaagacggcgcctttctagacggcgctggagaatcaatctgctcaacgaaatttttgacgcccacctggccgaggtggatcctaccttccttgctcggctgaaggaaagcaatcgctccaacctcgacccgaaaaagtcttttcaaggaagcctgctgttccccgagagaaaggattatcagttttacgaggaatatcctacaatctaccatctccggaaagccctgatggagaaggaccgcaaattcgatatcagagaaatttatcttgctgtgcaccatatcattaagtaccggggcaattttctgaacggcacccccatgagatccttcaaagtcgagaatatcgagctcaacacactgtttgaccagcttaatcagctgtatgccgaaattgtgcctgataacgagctcgcgttcgacctggcccaagttgctgatgtgaaggacgtcctgtctagcaccacgatctacaagatggacaaaaagaaacagctcgtgaagatgatgctgcttcccgcctccaataaagctctgcagagcgaaaacaagaaaattgttacccagtttgtgaatgccatcctcaactacaagttcaagctggatgtccttctgcaagtggagacagacgcggattggtctctcaaactgaacgacgaaggggccgatgacaagctggaggagttcaccggagatctcgacgaaaatcgcctggagatcattgatcttctgcagcggctccacaactggttttccctgaatgaaatcacaaaagacggcaacagcctttctgctgccatggtggagaagtatgaaaatcatcaccaccatctggggctcctgaaaaaggtcattgagaaccaccctgatgctaagaaagccaaggccctgaaagagacctacacggcttatgttggaaagacagacgacaaaacccagaatcaggatgacttctacaaggcggtggaaaagaacctcgatgactccccggatgccaaaggcatcaagagactgattcaacttgaccagtttatgcccaaacagcgcacagggcaaaatggagctatccctcatcagctgcaccagcaggagctcgatcaaatcattgaaaagcagagcaaatattaccccttcctggccgagcctaaccccaatgtgaagcggagaaaggacgccccgtataaactggatgaacttatcgcttttaagattccttactacgtcggccccctcgtgacccctgaggagcaggcccagaacaaagaaaatgttttcgcgtggatgaagcgcaaagctgccggccccatcaccccctggaactttgacgagaaggtggatcggatggaatctgccaatagattcattcgccggatgacaacgaaagacacctatctgtttggggaggatgtcctgcctgctgagtccatgatctaccaaaagttcgtggttctcaacgaactgaacaatcttaagatcaacggaagacacctgagcctcaaagacaagcaggacgtgtataatgatctgtttaaacagcagaagacagtctccattaaagccctgcaaaactactatgtgaccaagaagaaagctgccacagcgccgaccgtcggcgggcttgccgaccccaagaaattcctctctagcctgtccacgtacatcgattttaagaatatgttcggagagcgcgtgaacgaccctcagttccaggaagatctggagcagattgttgaatggagcacaatctttgaggaccggggcattttcaaagctaagctccaagccctggggtggctttctgagaagcagatccagcaactggtggctaaaagatataagggatggggccggctctccaaaaagctgctgaccggccttaaaaatgccgaagggtacagcattctcgatgagatgtggcgctctaccgaaaactttatgcagatccagagcagacccgagttcgcggccctgatccagcaagctaatgaaaagcagtttgagggaaacgaccctgataatgtctgggagaacattgaaaatatcctgggcgacgcctacacatctccccagaacaagaaagctattagacaggtggttaaggtggtccaagatatcgagaaagccgtggggaatccgcctgaaaagattgccatcgagttcacccgggaagctgcggccaacccccagcgcacacagtcccggctcagaacgctggagaaactttatgagagcgctgaagaggtggttgacgccggactgaccgccgaactcgctgagtttaaggagaacaaacatgtcctgtccgataagtactatctgtacttcacacagcttggccgcgacgtgtataccggggacacaatcagcctcgataagctgaatgactacgatgtggaccacattctgcctcaatcttttatcaaagatgactccctcgataacagagtcctgaccattcgggccgtgaataacggcaagagcgacaatgttcccgcgaaaatgttcggaaagaaaatgggctctttttggcgccatcttctggataacgggatgatctccaagagaaagtataataacctcattacggaccctgataatatcagcaaatacgctcagaagggattcatcaaccggcagctggtggaaacctcccaagtcattaaactgacagccaatatccttaacggcatttacgacaaggacaccgagatcattgaagtgcccgccaaaatgaactctcagatgcgcaagatgtttgatctggttaaggtgagagaggtcaatgactatcaccatgctttcgatgcctacctcacaatcttcatcgggaattatctgtacaaatgctatccgaagctccggccttactttgtgtatgacaacttcaaaaagtttggaaacaaagaagatattggccacaagcgcttcaattttctggggaagatcgagagagagaaaaaggttgtggcgcccgaaaccggcgagattctttggagcaacgtcgctcccaatgaaacgatcaaacagattaagaaagtgtacaactacaagttcatgatcgtgtcccgggagattacaacccgcagagccgaactgtttaatcagacagtctatcctaagaactaccggggaaaactcatcccgatcaaggaggacagacccaccgatctgtatggcgggtactctggaaataccgacgcctatctggctattgttgcccttgaggataaaaagaaaggcaagtacttcaaagtggtggggatccctacacgcgctgccgcgaagctggaaaagctcaaacaacaggacagccagcagtatctgcaagccctccacgaggtcattgctccccagtttacgaagtccaccaaaaagggaatcaaaaagacagagttcgaaattgtgctggataaggttcattaccggcagcttgtgcaggacggccctgtcaaaatgatgctggggagctctacctacaagtataacgccaaacaactcgtgctgtccgaaaaggctctgtga

SEQ ID NO: 4056 - RNA, 3696 nt, synthetic construct
  misc_feature 1..3696: note = Cas9 variant
  source 1..3696: mol_type = other RNA
atgatcacccggattctgggcctcgacacagggacgaacagcctggcctgggctgtggtcgatagagacgccaatggaaactacacccttgttaagcgcggcgatgtgatcttcacagagggggtgaaaattgaaaagggaatcgagtcctctaaagcggctgaaagaaccgcccacaaggccctgcgggtccattatagccgcagacggctccacaaaattgacacactgaaggtgcttgttgagctggatctctgcccctacctgtccaatgaacagctgaacctctggaaggctaaaaagacctatcctctgacagacgattttatgctttggcaacgctctggcagcgccgaggagaataacccgtactattgtagacatcggtgcctgacccagaaactcgacctgacggatcagtcccagcgcttccttctggggagagctttttaccacctcgcccaacggcgcggattcctgtctaatagactggacaccagcgcggattccgacgaaagcggcaaggtgaaatctggcatcgccgagctctccgtcgaaatggagaaggctgggtgtgagtttctgggagaatatttctaccagctttacaagcagcatggcaacacaatcaaactgcggagccgctataccgatagagaggaacactacaagaaagagtttctcgccatttgcgaaaagcaggagctggaccccaaatgggtggaggctctccaacgggccatctatttccagagacctctgaagtctcagcgcaaaggggttggaaagtgtacatttgaacccaagaaacctcggtgcgcggagtcccaccccgactacgaagccttcagaatgctctgttttctgaataacgtgaagattcagacccctaatgatacgagcctgcgcccgctcaacgaggacgaacgggagaaaatctggcccctgttctttagaaagtctaaacctaatttcgatttcgaggacattgctaaggcccttgctggcaagaacaattatgcctggtacaaagatgccggggaaaagccctttaaattcaactatcgcatgcaacagggagtctccggctgccctgtgacagctcagctgatcgacatttttggcagcgattggcaaaccgcgatcgccgagacatacaccgctgtggaaaagaaaaacgggaccaagacaatcgacgagatggccgatgacgtctggaatgttctctactccttctctagcaaggataaactgaaggcctttgctacggaaaaacttcagctggacgaggcctccgcgaccaagttcgctaacgccaaactcccccatggatttgccagcctgtctctgaaggctattcggaatatcctcccgttcctgagacagggctttatttatgcccacgctgtgcatcttgccaagatccctgacattgtgacaaaagcggtctggaacgatgccgacaagcgcgagatgatcctgtccgggctcatggaaatcattgagaattacaaccccaaagatcggggagtggaaggcaccatcgacttctgtattaagagccatctgcaggatgttatcgacctgagacctggggctgccgatgctctttatcacccctctatgattgagacataccccgacgccaaactcaataagatgggagtgtttcaactgggcagccctcgcaccaacgcgatccggaatccgatggccatgagatccctgcacatcctccggtctgtcgtgaaccagctgcttcgcgatggcattatcgacagaaatacggaggttcacgtggaatatgctcgggagctgaacgatgccaataaaagaaaggctattgccgactaccagcgcgaacaggagaagaaacggaagcaatatagagatgacatcattgccctctacaaaagcgaatgccataaggagatcgagcccacagacaccgatattctgaaattccagctgtgggaagaacaggaccacctttgtctctacaccgggacacagatcggaatctgcgattttctgggcgacaaccctaagttcgatattgaacataccgtcccccgctccgtgggaggagacagcacacaaatgaatctgacgctctgcgatgctaccttcaacagacaggtcaagggcgcgcagctgccttctcagctttccaaccacgccgacatcctggtgcggattgatcactggaaaagcaagtgtgaggacctccgcaaacaactggataagatcagaacatatgggggcatggaaaaagctatgaaggaccggctgattcagaagcgccatagacttaaaatggatctcgactactggcagggaaagtattctcggtttaccatgacagaggttcccgagggcttctcccgcagacaaggggccggaatcggcctggtgagcaaatacgccgggctgtttctcaagtccctgttccacaatgaacagaacccgaataaatctaacgtctatgtggttaagggagtgaccacggctgagtttcggcgcatgtggggccttcagggggaatacgagaagaaaagcagactgaatcattgccaccactgtatcgacgccattaccatcgcgtgcattggcaaggctgaatatgataaaatggcccagtactaccatgacgaggagcttttccaatggcggggaacaaccacaaagcctcactttaacaaaccctggcctaccttcacggaagatgtcctggccatcgagcagtccctgcttgtgaagcatctcacaaaagacaatatgcccaagcaggctaagaaaagagtgcgcaccgccacaggcaagtatctggcgcagggggataccgctcggggatctctgcacaaagacacctactatggcgccattgaacaagatggggagatcagatacgttctccgcaagcctctgaacaaatttgagaatgaagccgagcttgaaaagatcgtcgaccaggctgtgaaggagaaaattaaggaagccatcgctgggaaaaacttcaagacagccattacggagcccatctttatgaataaagagaagggcattcggatcaacaaggtgagatattacgtcaaagcgcaggaacgcctgaagatccggcagcaaagagatctcagctccaaagagtataagcagttcttttgtgtggaaaatgagagcaactacctgctggccatttacgaaggggagcttaaaggcaagaaggagcgcgacttctgcgttgtgaataacctggaatctgctgcctgtctcaaacggtccaacaagggaaaagctgccccgctggtccctgagagaagcgaggagcggaatctccccctgcttgccgtgctgaagcgcggcacccaggttctcttctatgaaaactctcccgaggagatcctgtttgataatcctcaagacctggtgagacggctttacaaagtcacagggattaacaccaagaaggacgtgaaaaatggaaagacatatctgtacggcaacatcgaactccgcttccatcagaatgctcagaaaaaggatgacgttaaaatgcagtccggggtgtataagaacaatgaggtcctgagacaaggaattgtgctcagccacaaacagtttaaggcgctggtggaaggcgtcgatttcgagtttaacgttcttggggagatcaagaaaaaggaacggcacgcctga

SEQ ID NO: 4057 - RNA, 3699 nt, synthetic construct
  misc_feature 1..3699: note = Cas9 variant
  source 1..3699: mol_type = other RNA
atgaccaagacaagaatcctgggcctcgacacggggaccaacagcctgggatgggccattgtggatcgggacgaggtctccggccagtacgaacttgttgatcgcggggacctgatcttcacagagggagtgaaaattgaaaagggcatcgagtctagcaaggcttccgaaagaacccaacaccgggccctccgcaagcagtattttagacggcgcctgagaaaaattgaggtgcttcgggtcctgacattctaccatctctgtccccctgtgtctgaggaagaactgcacctgtggcatgttaagaagatctatccggtggaaaatcacgagtttatgatctggcagcgcaccaacgataatgaggggaaaaacccctactattacagacatatttgcctccacacaaagctgaatcttaccctgatgaaagaccggtatatcctcggacgcgcgctgtaccaccttagccagagacggggcttcctgtccaaccgcctcgatcaatctcaggacgaagatgacaagggcacggtcaaaaccgggattagctccctgagcaaggatatgaatgacgctggatgcacatacctgggcgattatttttacaagctctattctgagaacgggaatagagtgcggatcagaaaccattacaccgcccgcaatgaacactatctggccgagttcgaagctatttgtcaggttcagaaacttgagcctgagctggtggaagccctccggagagctatctttttccaacgccccctgaagtcccagcggaaaggagtcggcaagtgcacatttgagcctagaaaaccccgctgtgccgacagccatcctgactacgaagagttccggaaactttgctttattaacaatatcaaaatccagacctctgatgacgatacgatgagaccgctgaacaaggaagaacgccagcggattaattccctcttctatagagtgagcaaggcgaacttttacttcgaggaaatcgccaaactgctcgggggacgcaacaattactgttatttcaaggacgaggtgcaaaaagattttaagttcaactaccggatgtctcagtccgtcagcggctgccccacaaccgctcagctgagaaatatttttggcgaagactggaaaacagggatcgccgagacctatcaacactccgctaagaaggatggatctctgaaaaccgttgacgaaatggccgatgacatttggaacgtgctttacagcttctccagcaaggattgtctgtataattttgcggtgaacaaactccagctggaggaggacaaggccaaaaagttctctaagatcaaactttcccacggctttgctagcatctctctgaatgccattcataagatcctccctttcctgcggatggggatgatttacagccacgctgtcctgtttgccaacatccccacaattgtgggaatggacgtttggaatgatgaatccaaacgccagcatatcatgacggagctctctgacctggtgttcaactatgatcctaagaatagagaagtcgagggcaccatcgagatgtgcattaaagactttcttctgaacaattacgatctccccgccggggctgtgtgtcggctgtaccacccgagcatgatcgacacatatcctgatgcgaaggccaacaagtacggagttctgcagcttggctcccccgctaccaatgccattagaaaccctatggccatgcgcagcctccatgaactgcggcacgtggtcaacctgctcctgagaaaaggcaagatcgaccaaaatacagaggtgcacgtcgaatatgctcgcgagcttaacgatgccaataaaagaaaggcgattgctgaccggcagcgcgaactggataaactccataagaaataccacgacgatatcattaccctgtataaggaggagacggggaaggacatcaaccccacacaggccgacatcctgaaattccagctttgggaggagcaagaacatgtgtgcctctacaccggaagacagattggcatctctaagtttctggggcccgatcctgagttcgacattgaacacaccgttccgcggtccgtgggaggcgatagcacacagatgaatatgaccctgtgcgaccgcagattcaaccgggatgtcaaaaaggccatgctcccctctcagctgcctaattatcaagagatccttccccgcattgagaaatggaagaagaaatacgaaaagctgacaaaagacatcgatcactgtatcacgcattccgggatgaccaaggaggctaaagacagcattatccagaagagacaccggctcacactggaacatgattactggcgcaacaagtattccagatttaccatgacagaggtgcctgaaggcttctctcggagacagggagccggcattgggctggttagcaaatacgctggactttttctcaagtccctgttccacgaccccaccgatcgccggagatctcatgtgtatgtcgtgaaaggcacgaccacagccgagtttcgcaagatgtgggggctgcagagcgagtacgagaaaaagtcccgggacaatcacgtgcaccattgcgttgatgcgatcaccattgcctgtatcggaaagaacgagtataataaaatggctagcttctaccacgacgaagaggcctttgagagaggcgaatgcgagaagccgcatttcgacaaaccttggcccacatttacccaagatgtcctcgggctggaaaagcgccttatcgtggtgcactctacgcaggacaacatgcctaaacatgctaagaaatatgtccggacacccagaggcaagttcattgccaagggagattgtgcgcgcggctccctgcacctcgacacctactacggggccatcaaacacaaggatgacacagagcctcggtatgtgctgagacgggaactgagctcttttgattccgttaatgaccttgatattatcgtggacgatgctgtccgcgagaaaattaaggaggccgtgaaaggaaagagcggcaaggctttcaaagaagccctcgccaacgtttacatgaataaggagaaagacatcagaatcaagaaagtgcggtgctatgtcccctctgtgaagcgcccgattgacatcagacatcagcgggatatgagcagatttgactacaagcgccaattccacgttgctaacgatgggaactatatgatggcgatttacgaaggagtggtcaaaggcaagctgaaacgggacttcgagctggtgaagaatatcgaagccgcttcctattttaaagtgagccaggataacgagtctttctccagcattgtccctgagaagtcctctaatgggtttcccctcaaggccgttctgaaaatcggcacccatgtgcttctgtacgaaaacaccgccagcgagattgacttctccgatcccgtggacctcacaagacgcctgtacaaggtcgtgggactgtctagcgctatcatcaataactgttcctatggctttattacgcttcggttccaccaggaagccagacaggcgaaaaatctgaagctcaccaaaggggtttttaagaacgtggataattaccgcggagctatcattctgtatcacacacaactcaaggccctggtcgagggctacgacttcgatatcaacattcttggggaaatcacctctaaacagtga

SEQ ID NO: 4058 - RNA, 3705 nt, synthetic construct
  misc_feature 1..3705: note = Cas9 variant
  source 1..3705: mol_type = other RNA
atgcccaacttctggagcatctttaccgagaatctgcagacatacctcatgaagacgcgcattctgggccttgacaccgggacaaactccctgggatgggccgtggtcgatcgggacgaaaataaccaatatacccctatctgccgcggcgatctcattttcacagagggggttaaacaggaaaagggaatcgagttttctctggctgccgaaagaaccagctaccgggcgtcccgcagacactatttccggcgcagacttcggaaagtggaggtgctgaaggtcctcgtgaaacataagctgtgtccgcccctgtctgacgaggctctcaatcgctggcacacaaagaaagaataccctctggatgaggactttattctttggcagagaaccaacgaagccgataataagaacccctatcatgaccggcacatctgcctgcatcgcaaactcaatctgaaggatagccagacggacagatacacccttggccgggccctgtatcacctcacacaacgcagagggttcctgtccaaccggctggatcagaatgaggaggctgaagagaccggaaaagttaagtctgccatcagcgaactctccaaggagatgaaagaagctggctgtgagtttctgggcgactacttctaccttctgtatagaacagaggggaaccgcgtgcggattagaagccgctacaccgatcgggaaaagcactatctccaggagtttaaagaaatctgcagagtccaggagctggacgaagaccttgccaaggcgctggagaaaacgattttctttcaacgccctctcaagtctcagcggcagggagtgggcaaatgtacaatggagaaggggcattccagatgcgccgttagccaccccctgtacgaagagtatcgcctgctctgttacctgaataacatccggattaagaccccttctgatgacagacttcgcccgctgaatgctgaagaacgggagaaaatcacacccctcttctataaggagaaaaactttgatttcgagaagattgccaaaaagctggctggaaagacccctttcggctggatcagagacgccgaagattggccctaccagtttaactaccggatgacccaagaggcgcctgcctgccccacaacggctcagcttatcaaagtgttcggggaagactggaaggccgctctggccgagacctatacaatgtccgccaaacaggatggaaccctcaagacagaggacgaaatttgtaccgatatctggaatgtcctgtacagcttttcttccaaagagaagctgaaggaatttggcctcaaaaagctgcaacttgacgaggtgcaggctaaagcgtttagcgaaattcgcctgacgagagatttcgcctccctctctctgaaggctatccggaaaattctgtttttccttagaacaggcgaggactatagcaaggccatctttctcgccaacatcccgaccattgtgggggaggaaatctggaatgacattgagcgccggtccagactgctgtacaaggtcgatctcgctctgcgccctcaggaagagagagacgccgaggaacatcggaccatcgcggagcgcattaaagctgccgttgccgctgaagtgcccgatgcccctatcgaccttctgtatcaccccagcatgatcgaggcttaccccgatgccaagagaaacgaacggttcgactgctatcagctcggatctcctaaaacaaatgcggtgcgcaacccgatggccatgagatccctgcacatggtccggaaggtgattaatcatctgcttcgcaaacacatcattgatgagaagaccgaaatccatattgagtacgctagagagctcaacgacgccaataaacggcaagctatcgccgattggcagcgcgaactgagcaagagacacacagcgtacgcccagaacattcggcagctgtataaggctgagacgggcctcgttatcgaacccaccaaagccgacatcctgaagtaccaactttgggaggagcagcagcatgtgtgtctgtatacagggaaaaagattggaatcgctgattttctcggcgccaatcctaaattcgacattgaacacaccatccccagatctcgcgggggagatagcacacaggagaacctgaccctgtgcgaatccaagtttaatcgggacattaagagagacaaacttcctacggagctcgccaactacgaagagatcctggctcgcatcgagcactggaagaaacaatgctatgcgctgaagctcaaacgggatggcattagaacccattctggcctggaaaagagcatcaaggactcccgcattcggagacgccaccttgtcgggctggagtacggatatctcaaaggcaagtacgatcggttcacaatgaaagaagtgcccgaggggttcagcagacggcagggagccggcatcgggctgatttctaagtacgctggcctgtttcttaaatccctcttcaaggacccgaagaatcctaaccgcagcaacgtttatgtggtcaaaggagccatcaccgccgaatttagaaagctgtggggcctgcagcaggctgatgaggccaaatctcgggagaatcatacacaccactgtatcgacgcgtacaccattgcttgcatcgggccctgtgaatatgccgccctcgctgcctactatcgctccgatgaggagttcaagtacggaagacggagagaaaaacctcaatttgaaaagccctggcctacgttcacagaggacctgcttaaactgcaggaggaactcctgattgtgcatcagaccacagataagctgggcaagcgcgaccggagaaaagtcaagacccccagagggaaatttcttaccggaggcgatagcgcgcgggggagactgcaccaagagacatattacggcgctatcaactacgacggaaatattaagtatgtggttcgcaaaccgctcgattccctgacggaaaaggacctcgacaagatcgtggatgagaccgtcatgggcatcgtgaaaggggccgttgaggccaagggatctctgaaagaagctcttgccgacggcatttacatgaacaaggagaaagggatcctgattaagcgggtgagaatcttcagcgatgtctccgaacctattaatctcaagcagctgcgcgacgtgtctacaaaagagtataagagacatatccatctgcggaaagatgaaaactacctttttgctatttatgagggaatcgacaagaaaaagaataagaaacagaccgagacagccaccgtggattacctggacgcggccaagttctataaagatagcaagcgcagagacaaagctaactccctcgttggcgattacagcaagaagaataaactgcccctcaagtgcatcctgaaaaagcggcagatggtccttttctacgaacactctcccgaggaaattcgcttcaaagacaagaaagacctgtccagacggctctatatcgtgacgagcattgccaaggatgggagagtgaagtttctgcaccaccaagctgccacagccaccggcatccagtcttcccctagcccgttcaccaacgacggagagcatcagccctactatcgcctgtctgctagcaatattaaagtccttgtggcgggcatcgatttcgacatcaacattctgggggaaatcacacctaagctctga

SEQ ID NO: 4059 - RNA, 3711 nt, synthetic construct
  misc_feature 1..3711: note = Cas9 variant
  source 1..3711: mol_type = other RNA
atgtacttctataagaacaaagagaataagctgaacaaaaaggtggtcctcggcctggaccttgggatcgccagcgttggatggtgcctgaccgatatttcccagaaagaagacaataagtttcccatcattctccacggcgtgagactgttcgagacagtggatgactctgatgacaagctcctgaacgaaacgcggcgcaaaaagagagggcaacggcgcagaaatcggcgcctctttaccagaaaacgggatttcatcaagtacctgattgacaacaatatcatcgagctggaatttgataaaaaccctaagattctcgtccgcaatttcatcgagaagtatattaacccgtttagcaaaaatctggagcttaagtacaaatccgtgacaaacctgcccatcggattccataatctcagaaaggctgccattaacgaaaaatataagctggacaaatctgagcttatcgttctgctctacttttatctgagcctgcggggcgcgttctttgataatcctgaagacaccaagtccaaggagatgaacaaaaacgagattgaaatcttcgataagaatgagtctatcaaaaacgctgaatttcccattgacaagatcattgagttctacaaaatcagcgggaagattcgctccacaatcaatctcaagttcggacaccaggactacctgaaagaaatcaaacaggtgtttgagaaacagaacattgatttcatgaattatgagaagtttgccatggaagagaaatctttctttagcagaatccggaactactccgaaggccctggcaatgaaaagagcttctctaagtatgggctttacgccaacgaaaatggaaaccccgagctgattatcaatgagaaaggccaaaagatttataccaaaatctttaagacactctgggaatccaaaatcgggaagtgtagctacgacaagaaactgtatcgcgctcctaagaactctttctccgccaaagtctttgatattaccaataaacttacggactggaagcataagaacgagtacatcagcgaaagactgaaacggaagattctcctgtccagattcctgaataaggattctaaaagcgctgtggagaagatcctcaaagaagagaacattaagtttgagaacctgtccgaaatcgcctacaataaagacgataacaagattaatcttccgatcatcaacgcgtatcacagcctgaccacaattttcaagaaacatctcatcaattttgagaactacctgatttctaatgaaaacgacctttccaagctgatgagcttctataaacagcagtctgagaaactcttcgttcccaatgagaagggaagctacgaaatcaaccagaataacaatgtgctgcacatttttgatgccatctccaacatcctgaataagttctctaccattcaagaccgcatccggattctcgagggctattttgagttcagcaacctgaagaaagatgtcaagtccagcgagatctactctgaaattgctaaacttagagagttttccgggacaagctctctgtccttcggagcctattacaagtttatccctaacctcatcagcgagggctccaaaaattactctaccattagctatgaagagaaggctctgcagaaccagaagaataacttctcccactctaatctgtttgaaaagacgtgggtggaggaccttatcgccagccccacagtgaagcgctccctccggcagaccatgaacctgctgaaagaaattttcaagtacagcgagaaaaataacctcgagatcgaaaagattgtcgttgaggtgacaagatcttccaataacaaacatgaacgcaagaagatcgagggcatcaataaatatcggaaggaaaaatacgaggagctgaagaaagtgtatgaccttcctaacgaaaataccaccctgctcaagaagctgtggctgcttagacaacagcaggggtacgatgcgtatagcctccgcaaaattgaggccaacgacgtcatcaataagccctggaactacgatattgaccacatcgtgccgcggtctatttcctttgatgacagcttctctaacctggttatcgtgaataaactggataacgctaagaaaagcaatgacctctccgccaagcaatttattgaaaagatctacggaatcgagaaactgaaggaggctaaagaaaactggggcaattggtatcttagaaacgccaatgggaaggccttcaacgataaaggaaagttcattaagctgtacacaatcgacaatctcgatgagtttgacaacagcgatttcattaatcgcaacctgtctgacacgtcctatatcaccaatgctctggtcaaccatcttacatttagcaattccaaatacaagtattctgtggttagcgtgaacggcaaacagacctccaatctccggaaccagattgcgttcgtcgggatcaagaacaataaagaaacagagagagaatggaagcggcctgagggatttaagtctatcaacagcaatgacttcctgattcgcgaggaaggcaaaaacgatgtgaaggacgatgtcctgatcaaagacagatcctttaatggccaccacgccgaggatgcttacttcattaccatcatttctcagtattttcggagcttcaagagaatcgaacgcctcaacgtgaattaccggaaagagacgagagaactggacgatcttgagaagaacaatatcaaatttaaggagaaggcctccttcgacaacttcctgctcattaatgccctggatgaactgaacgagaaacttaatcaaatgcgctttagcagaatggttatcacaaagaaaaacacccagcttttcaatgaaaccctgtactctgggaagtatgacaaaggaaagaacacaattaagaaagtggagaagctgaacctcctggataatcggaccgacaaaatcaagaaaattgaagagtttttcgatgaggacaaacttaaggaaaacgagctgacaaagctccatatctttaatcacgacaagaacctgtacgaaacgctgaaaattatctggaatgaggtcaagatcgagattaaaaacaagaatcttaacgaaaagaattatttcaaatactttgtgaacaagaaactgcaggagggcaagatctccttcaatgaatgggttcccattctcgataacgactttaaaatcattcgcaagatcagatatatcaaattcagctctgaggaaaaggagaccgatgagattatcttttcccagagcaatttcctgaagattgaccaacggcagaacttttctttccataatacactctactgggtgcagatctgggtctataaaaaccagaaggatcaatactgcttcatttccatcgacgctcgcaacagcaaatttgaaaaggatgagatcaaaattaattacgaaaagctgaagacccagaaagagaaacttcagatcattaacgaggaacctatcctgaagattaataagggggacctcttcgagaacgaagagaaagaactgttttatatcgtgggaagagatgagaagccccagaagctggaaattaaatacatccttggcaagaaaatcaaggaccaaaaacagattcagaagcccgtgaagaaatatttccctaattggaagaaagttaacctgacatacatgggggagatctttaagaaatga

SEQ ID NO: 4060 - RNA, 3717 nt, synthetic construct
  misc_feature 1..3717: note = Cas9 variant
  source 1..3717: mol_type = other RNA
atgaccaaggtgctgggcctcgacctgggggccgctagcgtcggatgggccatgatcgaggaagaggaaaaatcccacaagattcttggcctggggtctagaatcattccctacgagggaacagaaggcaacgatttcgcgaaagggacgggagagagccggaatgctctccgcaccaaggccagaacagcccggaaaggctatgaccgctaccagctgagacggaagtatcttgttgataccctggtgaagaacgagatgatgcctgacgaatacctccgcaaactgccgaagatgcaactgtgggagctcagatccaaagctgtgacaaccgaaatcacaaagcaggagctgggccggctttttctgtggctcaatcagaaacgcgggtataagtctagcagatccgatgccaacctggacaagaaagataccgagtacgtcgtggaagttaagtctcggcatgagaaaattaaggaaagcggattcacgatcggccagtatttttactccgagcttaaaagcaatgaatacttccgcgtgaaggagaacatctttcccagagaggcttatattgaagagttcgacgccatctgcaaacaacagaagcggcacctgaccgataagctcatttctcgcatcagaaatgaaattatctactatcagcggcctctgaaatcccagaaggggctggtcagcgtgtgtagatttgagggattctttaaaaagggcattaacgggaaagaatacttcgttggacccaaggtggcgcctaagtctagccccctctttcaaacagtcaaaatctgggagaatatcaactccattcgcctgtctgaccggaatggcaaggagatcatgctttccctggaacagaaaaagtgcattttcaaccatctcgataataacgagaaactgacccctaaggacctttttatcattatcggcgtgaagaaagaaaattgtttcgtgaacaagcagctggagaaagggatccagggaaacgtcacaaagagcaccattctcaaatgcttcggcgaaaataacgattatgacaagtggctgaagctggacctcaatatcattgttaaaaaggatacgtttgggtacctgtatgacaaaaagacaggagagatcattggcgagaaacttatcaagcacgtggattccgccgtggaaagagagccgctgtaccaactctggcataccatctactctattaacaatacagacgaatgtagcgctgccctgcagaacaaattcgggtttgattccgagaccgctgacaaacttagcaatatcgatttcggaaaggccggctttggcaacaagtctgcgaaggtcattcgcaaaatcctgccctatctcatggagggggacgattactcccagagcatgtcttatgccggattcaatcacagcgactccctgaccaaggatgaaaacctgaaacggaagctcctggacaagctgagacctattgagaaaaattctcttcgccaacccatcgtggaaaagattctcaaccagatggttaatgtggtcaacgctatcatcgacaaatacggcaagcctgatgagattcggatcgaactggccagagagctgaaacagaataaggaggaacgcaacaagacagacaaagatatgagcaagcggcagagagagaacggggaaatttccaaacgccttgctgagtatggactccgggccacgagaaataacatcattaagtggcggctgtacgaagagatcgacaatcaagataaaaagctgaacgccatctgcgtgtattgtggccagcccattagcctcaccgaggctatcaaggggaatgaagttgacgtggagcacattatcccgaaatctaagctgtttgatgactcccagagcaacaaaacacttgcgcatcgcagatgcaattctaccaagggcgatatgacagcctacgacttcatggaaaacaaacctgctcaggtctttaatgcctacattgagcgggtgaacatgctgtatgataataagatcatcagaaaagtcaagcgcgacaagctcctgatgcccgaatccaaaattcctgataacttcatcgaccggcaactgagagagagccagtacattgcctccaaggctcgcgagatccttcagaccatttgttataatgtgtggtctacgagcggaacagttaccgccagactccggcacctgtggggctgggacgatgcgaccatgtccctgcagctccccaaataccgcgaactggggcttacagagatggtggaatgggagtctgagcatggaaagcaaaaacacagcaaggaagtcatctccgactggagcaagagagatgaccaccggcatcacgctgtggatgccctgaccatcgcctgcacaaaacagggctttattcagcgcttcaacacgctcaattcttccaagaccaaagaggacatggaatttgagatcgctaagtgtagcattgaatatagagagaacctgtctaaactggagaagtacatcattgcccttcggcccatccctgtttccgaagtggaggatgctgtcgccaacattctcatcagcttcaagtctgggaaaaaggtggcggtgaaaggaaagcgcaaaatcggcaagagagggaataagaaaattatccagacagacattatcattccgcatggcagcctgtccgaagagagcgtttatggaaagatcaaaaccatcgaacgggagaagcccctgaaatacctcttccaaaactctcagctgatttttaataacaagatcaagattcttgtcgaggaacgcctggccacattcgagaatgataccaaaaaggctctcgcctccctgaaaaaggtgcctgtgtacctggacgaagagaaaacgatcgtccttgaatatgctacctgctttaaggaggagtacgtgaaaaagtatgatgttgacacaaacttcagcaagaccgataaagtgattgacgacaagatcaaagaaatcctccagcacagactgggcaagtttgggggaaaagccaaggagaaggaagcgttcaaagatgtccaacagggcgacaagacaattaaatggtacgaggatgaggggctggaacggcccatccattccgtgagatgctttaccggactctctgccattgttcctgtgaagaaagacgagaatggcatcgatattgggttcgtcaagcccggcaacaatcaccacatcgctatttatagcgacaaggatggaaaccgctacgaacatatctgtacgttttggcacgccgtggagcggaaaaagtatgacatcccggttgtgattaaagattccaatgaaatctggaacaagatttggtctaaacctgagggcagctacccccagtccttcctggacaaacttcctcaggagaatctgacactcgatctgtctatgcaacagaacgaaatgctgatccttgggatgagctacgaggacattaagaccgctatcgacaattccgattataagcagctgagctctaacctctacagactgcagaagctcgccaacgccaattatatgtttcgccatcacctggaaacacaaatcattgacgataacaattccaaagctagccggagattcatcaacattcactctcttaaggcgctgtttgcctggaatccctacaaagtcaacatcaattgcctcggagacattcagaccaactcccgctga

SEQ ID NO: 4061 - RNA, 3720 nt, synthetic construct
  misc_feature 1..3720: note = Cas9 variant
  source 1..3720: mol_type = other RNA
atgaccgagaagagaaaattcgacatccgggaagtgtacctggccattcaccatatcgtcaagtatcgcggcaactttctcaatagcgctacagttgattccttcaaaacgtctaacattgactttaccagccagttcgatagactgaatgagctttaccggcaagtgatcctggaggaaccctttcagattaacatgaatcaggtggacaagatgacaaacaaactcctggataatgacgcccttaagctggatacccagaagcaagtcgcgaaactcctgcctgtgatctataacgacaagccggttgataaacagtacacacgcctggctaccgagttctccaaggccatcctcgggtataaaacaaagctggacgtgattcttaatctggatacccagaacgccaaggactgggctatcagactcgatgacgaagacattgatgacaaactgcccgcccttgtcgagaatctggatgaatctcggcaggagatcgtgacgattatccgcgacctctacgctcaaattaccctgaacgccatcgttcctaagggaaaaagcctgtccgaatctatggtggataagtataatgaccacaaagatcatctcgacctgcttatgggcctgatccacgagctcggggatgacagcgcgaagggaattaaactgagagaggcctacacacagtacgtcggcaagtccggggataagacccttaaccaggacgacttttatgctgccatcaaaaagaatctggatgaagacagcaaacggtctcccaagattcagcgcctcatcgagcaggcttccttcatgcctaaacaaagaacaagcgccaacggagtgattccccatcagctgcaccaactggaactcgatcggatcatcgagaaccagggccgctactatccttttctgaaggaacccaattctaacacccacaagcccaatggcgggaaatacaaacttgacgagctggtggcgttccggattccttattacgtcggacccctcatcacgaaacaggatcaggagaagacatccggcgccgactttgcttggatgattagaaaacctgggcaaggaggcgaaatcaccccctggaacttcgatcaggaggttgaccgcatggccagcgctaatacatttattagacggatgaccaccaaggattcttatctggtggccgaagacgtgcttccggattccagcctgatctacgagaagttcaaagtcctcaacgaactgaatatgctgaaggtgaacgacagacgcctctccatctctcagaaacaggatctgttcaataacctttttaagaaacaaaagacaattcggacgaagaaactgcagacctacatcagaacaaagtgggagctccctagcgttatgatttccgggctgagcgaccccgacaaattcaattcttccctggccacctatatcgattttcgcgacgtgttcggagagaaggtcgatgaccctaaccggcaggctgattacgaaaagattatcgagtggagcacagtgtttgaagacagaaagatttatcaggcgaaacttaatcaactcgattggctgaccgagtctcagagcaaggccctgctcacgaagcattacacaggctggggccgcctgtccaaaaagctgcttaccgggctcaaagaccagaacggagattctatcctggaccagctgtggaagaccaatgataacttcatgcaaatccagagccgggacgaatttgctaaacagattcacgatgagaacgccaagcaattccatgaggccaataacgttgacgacatccttgatgacgcttttacatccccgcagaataagaaagccattagacaggtggataaggtcgtgcaggacgtcgtgaaagcggttggctatgctcccgataagatcgccattgagttcacccgcagccctcaagaccggccgcagagaacattttctcgccagcggcagctccaatccacgtacctgaacgtggccaaagctctgatgaaaagcaatctcaaccaggaactgaagtctgtcatcgattcccagcagacccttacagacaagctgtatctctacttcacccaactggggcaggatatgtacacaggaaaggaaatcaattttgacgagctggtgaactatcagattgatcacatccttccccaagccttcattaaagacgacagcctcgataatagagttctggtgtccgctcctatcaacaatgccaagtctgacaacgtccccgtgaaaaagttcggcgcgaagatggggtacttttggaaacagctggccgagaatcacctcattagcaagcggaaactgaacaatcttaccacggatcctgacaagatcggaaaattcaccgctcagggctttatccatcgccagctggtggaaacatcccaagttattagactcgtcgccaacatcctgggcaacgagtatgggcacgatggaaccacaattatcgaagtgaccgctaagatgaatcatcagatgcggaaagacttcgatctgattaagatcagagacgtgaacgattaccaccatgccatggacgcgtatcttacggcctacgtcggcgattatctctacctgcgctaccccaagctgcggtcttattttgtgtacggggacttcaaaaagctcaaagatcagagcctgaagatcagaaattttaacttccttcacgacctgacaaatgacgaggctggagataaaattgttgaccaggaaaccggcgagatcatttgggataagcacgagtccgtgaagcaactcaaaaaggtctatcattacaaatttatgctggtgagccaggaagtttatacacgccaggacgccctgttcaaccagaccatctacccggcttctgatgccgacaagagaaaacttattcctatcaagaataacaagcccgtggatgtctatgggggctactccggaaatgtggacgcctacatggctattgttcggatccacggcaaaaaggaggataaatataaggtggtcggggtgcctatgcgcgcggtggccgacctgaaaaaggctgaaagcaagggaagagataactacctcaatgccgtccatgaggttctgaaaccccaatttaccaagaaaaagaaagaccggaagacaggcgaaatcacggagatgatggatgacttcgacgtgctcctggggaaggtgtattaccgccagcttattgtcgatggaaacaaaaagtttatgctggggtcttccacctatcagtacaatgccaaacagctcgtgctgagcgacaaggctatgcaagttctgtctaaagatgacaaacttaagaaccaggatgagaatcagaacctgatcgacgtgtatgatgaaattctcgagaaggtcgaccaatacttcgaactgtacgatatcaacaagttcagacagaaactccacgacgggcggaagaaatttattgagctgcctgtggataatgacttcaacggcaagaaacttatcagctatggaaagcgcgccacaatcatttccatcctgaatggcctccacgcgaacgctaccatgagcaatctgaagtacctggggatttcttccccctttggaatgcttcaggttccgaacggcatcattctgagccctgcctccagaatctgctatcagtctcccacaggcctcttcgaacggaaagtgaagctgagcgacctctga

SEQ ID NO: 4062 - RNA, 3738 nt, synthetic construct
  misc_feature 1..3738: note = Cas9 variant
  source 1..3738: mol_type = other RNA
atgatcatttacttcatctttgagaagattgtgaacaccatcctggtcatgaaaaagattgttggcctcgacctggggacaaatagcatcggatgggcccttatcaacgcttatattgatgaatacaataaagagcacctgtatggcatcgaagcctgcgggtccagaattatccccatggacgcggctattctcggaaacttcgataagggcaattctatcagccagacggccgaccggacctcctaccgcgggattagacggctgcgcgagagacatcttctgcggcgcgaaagactccaccggatcctggatctgctcggatttctgcctaaacattattctgacagccttaaccgctacggcaagttcctgaatgatatcgagtgtaagctcccgtgggtgaaagacgagacaggctcctataagtttattttccaagaatcttttaaagagatgctggccgatttcaccgaacaccatcccaaacttatcgctaacaataagaaggtgccttacgactggacaatttactatctgagaaagaaagccctcacccagaagatcagcaaagaggagctggcttggattctgctcaactttaatcagaagcgggggtactatcagctgcgcggagaagaggaagagacacccaacaaacttgtcgaatactattccctgaaggtggagaaagttgaggatagcggcgaaagaaaggggaaggacacctggtacaatgtgcacctcgagaacggaatgatctatcggcgcacgtctaatatccctctggattgggaaggcaaaaccaaggagttcattgtcacaaccgaccttgaagccgacgggtcccccaaaaaggataaagagggaaacatcaagcggagctttcgggcgcctaaggacgatgactggacactgattaaaaagaaaaccgaggccgatatcgacaagattaaaatgacggtgggcgcttacatctacgatacactcctgcaaaagccggaccagaagatcagaggcaaactggttcgcaccattgaacggaagtattacaaaaacgagctctatcagatcctgaagacacagtctgagttccacgaagaacttagagataaacaactgtacattgcctgcctcaatgagctgtatcccaacaatgagcctcgccggaactccatcagcaccagagacttttgtcatcttttcattgaagatatcattttctaccagcgccccctgaagtctaagaaatccctcatcgacaattgcccttatgaggaaaaccggtacatcgacaaggagagcggggagattaaacacgcttccatcaagtgtattgccaaatctcatcccctgtaccaggaatttagactgtggcagttcatcgtgaatctccgcatttatcggaaggagaccgatgtcgacgtgacacaagaactgcttccgacggaggcggattacgtgaccctgtttgaatggctcaacgagaaaaaggagatcgaccagaaggccttctttaaatatcctcccttcggatttaagaaaacaaccagcaattacagatggaactatgtcgaagataagccttacccctgcaatgagacacacgctcagatcattacccgcctgggcaaagcccacatccccaaggctttcctgtccaaggaaaaagaggaaacgctttggcatattctctatagcatcgaggacaagcaagagattgaaaaagccctgcactcttttgccaacaagaataacctgtccgaggagttcatcgaacagtttaaaaatttccctccgtttaagaaggaatacgggagctactctgctaaagcgatcaagaaactcctgccccttatgcggatgggaaagtattggagcattgagaacatcgataacggcacaagaattagaatcaataaaattatcgacggggagtacgatgaaaacatccgcgagagagttcggcagaaggccattaatctgaccgacatcacccatttcagagctctccctctgtggctggcctgttatcttgtgtacgatcgccactccgaagtgaaggacattgtcaaatggaagacacccaaagatatcgacctctatctgaagtctttcaaacagcatagcctgcggaaccctattgtggagcaagttatcaccgagacactcagaacggtgcgcgacatttggcagcaggtcggacacatcgatgaaatccacattgagctgggcagagaaatgaagaatcccgccgacaaacgggctcgcatgtcccagcaaatgatcaagaacgagaataccaaccttagaattaaggccctgctcacagaatttctgaatccggagttcggcatcgagaacgtgcggccttacagcccctctcagcaggatctgcttcgcatttatgaagagggggttctcaattccatcctggaactgcctgaggacatcggaattatcctcggcaaatttaaccagaccgatacactgaagagacccacccggagcgaaattcttcgctacaaactgtggctcgagcaaaagtacagatctccttatacgggggagatgatccccctgtccaaactgttcaccccggcgtacgaaattgagcatatcatccctcagagccggtattttgacgattccctttctaataaggtgatttgcgaaagcgagatcaacaagctcaaagaccgctccctgggatacgagttcattaagaatcaccatggcgaaaaagtcgagctggcttttgataagcccgtggaagtcctctctgtggaggcctatgaaaaactggttcacgagagctactcccacaacagaagcaagatgaagaaacttctgatggaggacatccccgatcagttcattgaacggcagctcaacgactctagatatatctccaaggtggtcaaaagcctgctgtctaatattgtgcgcgaggaaaacgagcaagaagccatctccaagaatgttatcccttgtacagggggcattaccgatcggcttaaaaaggactggggaatcaacgacgtgtggaataagattgtcctgccgagatttatccgcctcaacgagctgacagagagcacccggttcacgtctattaatacaaacaataccatgatccccagcatgcctctcgaactgcagaaaggctttaacaagaaaagaatcgatcatcgccaccatgctatggacgccattatcattgcttgcgccaatcggaacatcgtgaattaccttaacaatgtgtccgcgagcaagaacacaaaaattaccagacgcgatctgcagaccctcctgtgtcacaaggacaagacagataacaatgggaactacaaatgggttatcgacaagccctgggagacgttcacccaagatacactgaccgcccttcagaaaatcacagtctcttttaagcagaatctgcgggtgattaacaaaaccacgaatcattatcagcactacgaaaacggaaagaaaatcgtgtccaatcaaagcaagggcgactcctgggctattagaaagtctatgcacaaagagacagtccatggggaagtgaacctccggatgatcaagaccgttagcctgaatgaggccctcaaaaagcctcaggctattgtggagatggatctgaaaaagaagatccttgccatgctggaactcggatatgacaccaaacgcattaagaactacttcgaggaaaataaagatacatggcagtga

SEQ ID NO: 4063 - RNA, 3741 nt, synthetic construct
  misc_feature 1..3741: note = Cas9 variant
  source 1..3741: mol_type = other RNA
atgagactggtgtacctcgccctggctcacatgatcaagttccggggccattttctttatgagggggacctgaaagccgaaaacaccgatgtccaggctctcttcaaggactttgttgaggaatacgataaaacaattgaggaaagccacctgtccgagatcacggtggacgctctttctattctgaccgagaaggtgagcaaatcctctcgcctcgaaaatctgatcgcccattatcccacagagaagaagaacaccctgttcggaaatctcattgccctgagccttggcctgcaagctaactttaaaacaaatttccagctctccgaagatgccaagctgcagttttctaaagacacctacgaggaggatcttgaagggctgctcggagaggtcggcgacgaatatgctgatctgttcgtgagcgccaagaacctgtacgacgcgatcctcctgtccgggatccttacagttgatgacaatagcaccaaagcccctctgtctgcttccatggtgaagagatataaggagcacaaagaggagctcgccgcttttaagcggttcattaaagagaagctgccgaaaaagtacgaagagatctttaaagatgacacgaagaacggatacgccggctatgtcggcgcggacaagaaacttcgcaagagaagcgggaaactggccaccgaagaggaattttacaagtatgtgaaaggcattctcaataaggttgagggagctgattactttctggacaagatcgatcgggaggacttcctgcgcaaacagagaacattcgataacgggtctattccccatcaaatccacctccaggaaatgcacgccattctgcggcgccagggagagcattatccttttcttaaggaaaatcaggacaaaatcgagaagatcctgaccttccggattccctactatgtgggccctctcgctagaaaagggtcccgctttgcctgggccgaatacaaggctgatgagaagatcacaccctggaacttcgacgatattctggacaaagaaaagagcgcggaaaaatttatcaccagaatgacgcttaatgatctgtacctccctgaggaaaaggtcctgccgaaacactctcccctgtatgagacattcaccgtgtacaacgagctcacaaaggtgaagtatgtcaatgaacaaggagaggccaaatttttcgacaccaacatgaagcaggaaatttttgaccatgttttcaaagagaaccggaaggtgaccaaagataagctgcttaattacctgaacaaagaatttgaggagttccgcatcgtgaatctcacaggcctggacaaggaaaacaaggcttttaatgcctccctgggcacgtatcacgatcttagaaaaatcctcgacaagagcttcctggatgacaaagtcaacgagaagattatcgaagatattatccagaccctgacactcttcgaggaccgggaaatgattagacagcgcctgcaaaaatactccgatatctttaccacacagcagcttaaggagctggagcggagacactataccgggtggggacgcctctcttacaagctgatcaatggcattcggaacaaagaaaataagaaaacgatcctggactaccttattgatgacgggtatgccaacagaaatttcatgcaactcatcaacgatgacgctctgagctttaaggaggaaattgcccgcgcgcagatcattggagacgtggatgacatcgctaatgttgtgcatgatctgcctggctcccccgccatcaaaaaggggattctccagagcgtcaagatcgtggacgagctggttaaagtgatgggacacaaccctacaaatattatcattgaaatggcccgggagaaccagaccaccgataagggcagacgcaactctcaacagcggcttaaactgctccaggactccctgaagaatctggataaccccgtcaatatcaaaaacgtggagaatcagcaacttcagaacgacagactcttcctgtactatatccagaatggcaaggatatgtacacaggggaaaccctggacattaacaatctcagccagtatgatatcgaccatattatcccgcaagcgtttattaaggataactctctggacaatcgcgtccttacacggagcgacaaaaacagaggaaagtccgatgacgtgccttctatcgaggttgtgcacgaaatgaaatccttctggagcaagctgctcagcgtcaaactgatcacgcagcggaagtttgataatctgaccaaagccgagcgcggcgggcttacagagaacgacaaggctggattcattaagagacagctcgtggaaacccggcagatcacaaaacatgttgcccaagtgctggatgcgagatttaatgccaagcacgacgagaacaaaaaggtcattcgcgatgtgaaaatcattaccctgaagtctaacctcgtgtcccagttccggaaggactttaaattctacaaggttagagaaatcaatgattatcaccatgctcacgacgcctacctgaacgctgtcatcggcacggcccttctgaaaaagtaccccaaactcgcgagcgagtttgtgtatggggagttcaagaagtacgatgtgcgcaaattcattgccaagtctgacaaagaaatcggcaaggctaccgccaaatatttcttctactccaatctgatgaactttttcaagaaggaggtcaaatttgctgacggaacagtggttgaaagacctgatattgagaccagcgaagacggcgagatcgcctggaataagcagacagatttcaaaattgtgcggaaggtcctgtcctatccccaagtgaacatcgttaaaaagaccgaagtgcagacgcatgggcttgaccgcggaaagcccagaggcctgtttaatgccaacccttctccgaaacccaagcctgatagctccgagaatctcgtcgggattaaacggaacctggaccccaagaaatacggaggctatgctgggatctctaatagctacgcggtgctcgttaaggccatcattgagaaaggcgtgaagaagaaagaaacaatggtcctggagttccagggaatctccattcttgatcgcatcacctttgaaaaggacaaaagagctttcctgctcggcaaggggtacaaagatattaagaagatcatcgagctgcctaaatatagcctgtttgaacttaaggacggatctcggcgcatgctggcctccattctcagcacaaacaataaaagaggcgagatccacaaggggaacgagctgttcgtgccccagaaattcaccaccctcctgtaccacgccaagcggattaataacccgatcaacaaggatcatattgaatatgtgaaaaagcaccgcgacgattttaaagagcttctgaattacgtcctcgagttcaacgaaaagtatgttggagctacaaagaatggcgagagactgaaagaagccgtggcggactttgactctaagtccaacgaggaaatctgcacgagcttcctgggggctgtcaattctaaaaacgccggcctttttgagctgaccagcctcggatccgccagcgatttcgaatttctgggcgtgaagatccctcggtacagagactatacaccctcttccctcctgaaagatagcattcttatccatcaatccattaccgggctgtacgagacacgcatcgacctgtctaagctcggagaggattga

SEQ ID NO: 4064 - RNA, 3747 nt, synthetic construct
  misc_feature 1..3747: note = Cas9 variant
  source 1..3747: mol_type = other RNA
atgaagaaaatcctgggcctcgacctggggagcgcctccattggatgggctgtgatcaccgagaacgtcgaaaatggcattacaaagtgcgatatccttgggatgggatctagaattatcccctacgagggcacggaagggaaagacttcaccaagggaacaggcgagagccggaactccctgcgcaccaaagccaagacagcgagaaagggctatgatcggtaccagctccgcagaaaatatctggttgacacccttatcaagaatcaaatgtaccctgatgaagctacacggaacctgccgaaaatgaagctctgggagctgcgcgacaaagccgtgcactctcccgtgagcctgatggagctcgggagactgcttctgtggctcaatcagaagcggggatataagtcctctcgcagcgatgccaacctgggcaaaaaggacaccgaatacgtcgctacggtgaaatccagacatgagaagatgaaagaacttgatgttaccattgggcagtatttttaccgggagctgagcgccaatgagttctttaaggtgaaagaaaacatcttccctcgcgaggcttacattgaagagtttgacgccatctgtaagacacagcaaattgcgcaccccatgatcctcagatctgaactgattgataagatccggaatgaggtcatctattaccagcgccctctgaaatcccagaagggactcgtgagcgtttgcgagttcgaaggcttttggagaattgggaaagacggaaaggagtatttcgtgggccccaaagtcgcccctaagtcttccccgctgtttcagcttgctaagatgtgggaaaacatcaataacattaaaatcggcagccggaccggggaggatctgaagctcacaaccgaacaaaaatgggccattttccagcatctggacaataacgagaaacttacgcccacagacctgctcaaaatcctgaatctgaagaaggagaactgttacgtgaacaaacagatgggaaagggcctcaatgggaacatcaccaaacacgctattctgcagtgccttggaggctctgataagtatgaaaatctgctcaaactggagcttaagatggtggacggggataaggaaggatacctgtatgacagaaaaacaggcgaggtcctcaactccaagatgatcaaatttattgatcctatggttgaacaagagcccttctaccagctgtggcatatcatttacagcatccacgaccaggaggaatgttcccgcgtgctgcaagccaagtttgatatcgagcagcctattgcggacaaactcgccgctatcgatttctctaagcacgccttcggcagcaaatccgctaaggtgattcggaagatcctgccctatcttatggacggggatggatacagcgaagccatgtcttatgccggctacgaccattccaatagccagaccaaagaggagaacctgcagagaaagctcctggacctgcttaaaccgattcctaaaaattctctccgccaacccatcgtcgaaaagattctgaaccagatggtgaatgttgtgaacgctatcatcgagaagtatgggaatcctgatgaaattcgggtcgagctggcgagagaactcaagcagagcaaggaggagcgcaacgacgccgataaggctatgtccaaacggcagagagaaaatgacgccatcaccaagcgcctggaggaatttggacttcgggccacaagaaacaatattatcaaatggcgcctgtacgaggaaattgataaccaagagaagaagctcaacgctatgtgcgtgtattgtggccagcccatctctctgacggaggccctgcgggggaatgacgttgatatcgaacacattatccccaaaagcaaacttttcgacgattcccagagcaacaagaccctcgcgcatagacactgcaataagaacaaaaatgacctgacagcttacgattttatgaagggcaagcctgaggccgtgttcaacgaatacgtcgagcgggtgaatctgctctatgacaaccacattatccgcaaagccaagagagataaactgcttatgaccgaatctaagattccggacaattttatcgaccggcagctgagagagtcccaatacatcgctaaaaaggcccgcgagattctccagacaatctgtcatgatgtctggagcacctctggaacggtgacagctgaactgcggcacctgtggggctgggacgatgttaccatgaaccttcagatggccaaatatagagagctcgggctgacccatcaggtggaatgggagtccgagcacggaaagaataagcatgaaaaagaggtcattacagactggaccaagcgcgatgaccacagacaccatgcggtggatgccctgacaatcgcttgcacgaaacaaggcttcattcagcggtttaacaccctcagcgccgctaagacacgcgaagacatgatgttcgatatcgagcagagatcccacgaatttaaagagaagcggtctctgcttgagaagtacatcattagcgaacaacccctgaaagttgacgaggtggaaaaggccgtctccaatatcctcatttctttcaaaagcgggaagaaagtggcggtgtggggaacccgcaagatcggcaagagagggtccaaaaaggttattcagaaaaagatcattgtccctcggggcagcctgtctgaggaatccgtgtatggaaaaatcaagaagcaggaggagaaagattacaagtatctgtttgaaaacccccagcttatcttcaatcctacaattaaagccaaggtggaggaacgcctcctgatgtttgacggcgatgtcaaaaaggctatcaccagcctgaagaaaattcccatctacctcgacaacaacaagacggtggttctggagaaagccatttgtcttaaggacgagttcgtgatcaaatactctgtcgatatcaatttcaacaaggtggacaaagttgtggatccgaagattaaggaaatcctgcaaaatagactcaaaaagtttgggggaaaagagaaggaggctttcaaagacgtccagctggaagataagatgattatcaagtggtatgaagacgagggcctggagcggcctattaaatccgtgcgctgctttaccgggcttagcgccgttgtgcccgtcaagaaagatgaaaacggaaatgacatcggcttcgtgaagcctgggaacaatcatcacatcgccatttacacagataccgaggaaaacaaacagcagcacgtgtgcacattttggcatgctgtcgagagaaagaagtatgacatccccgttattatcaaaaataccaacgaagtgtgggataagattcaatctcagcctgacggcacgtaccccgacagcttcctggagatgctcccgcctcccaatctgaacctcctggtgaatatgcagcagaacgagatgtttatccttggaacaaccacagaagatattaaactggcgatcgacaagcgggattataaaatcattggcgacaagctctacagactgcaaaagatgtccatcaaacccagctctgggcagattgatatcgtcttccgccaccatctggagacccagcttattgacgatgaaaattccaagaaaagcaagcggttttataacgtgcaatccctgggagccctcttcgctctgaacccttttaaagttagaatcgacaatctcggcaacctggtgaaggagaaatga

SEQ ID NO: 4065 - RNA, 3762 nt, synthetic construct
  misc_feature 1..3762: note = Cas9 variant
  source 1..3762: mol_type = other RNA
atgaaggccagaggcaacttcctgcaccaggacacccccgggctcacagctgccaatgcgaacatgggagatgctgtggagaaactgtgcgtcgcccttgaagactggtgtacgctgcggaatctcgagtgcaacatccgcaagaatcagaaaaacattcaaaatctgcttgaaggcaagaccgttgaggtgagcgccgaaaacgctctgaaagagtcctttgattctagcagagcctcccggaaggacaaggctacaatcctctctacctggattgccatccagcctggggagtacctggatgcgaaacaggccaaggacgctagcaaagaaattgccaatgtgctgttcggactccaaggcaacatgaagaaaatctttatcgagttcgaagaggatcagaagattcgcctggacaatgatgagcaggtcgaggctttttattccctttgtccggacgatggggtggccctgttcgaatcttttcagagcatctactccgcgtatattctcatgggaatcctgaagaacgccaatggcggcagcatttcttcctgcaaagttgctgcctacgaccaatataaggaagatcttaaactgctcaaggacctggtgagagagttcgctagcgaaaaatacgacgagtttttccggggagatatctttgactcttccaagggattccgcgccagaaactataatcccgccacagctaaaggctacaccaagtacaacagcgtcagaggggcgtcttatgatgactttaagaaagaggtggaaaagattttcaaaggaacagttgccgaggaagatatccgctacgtggacatgatgcagagattcgctgagggcacctttctgcggcgcctcaagacgtccgataacgggagcatcccttatcagctgcatcttgaagagatggacgccattgtcgagaatcagaaacaattctacccctttctggaatccgagaaggaaaagctcgagtctctggtgaccttcagaatcagctattacgtgggacctcttacacagaaaaacgcccggctggataatcacaacaatgctcgctttgcctggtcccagagaaaggaaggcaaagagcatgcgcgggtctatccctggaactgggaggaagttattgacagaaagcaaagcgctgccaaattcatggagcgcctcaccggcacatgtacctacatcctggatgaacctgtgctgccgcggtgctctctcctgtacgaggagtattgtcttctgaatgaactcaacgggtccaagtggagagacatgggaggcgactggcaccgctttgattacgagacgcggatggaaattatcgagaatctgttcaagaaaaagaaagggagcgtgaagtatgccgctgtcgaagactggcttaaatgcgagaagcataagtcttgtgccgaggtgaaaggaggccagggggaaacaggatttgagagcaagctgtcctcttacgttttctttaaagaagtgctccacgtcgatgagatcgacgaagctgatattcccatgatcgaggagctgatttggtggaacaccctgttcgaagacagaagcatcctcaaggagtccattgaagataaatatggcgaccgcctgacagatgaccagatcaaggccatctgcaaaaagcggtttaccggctgggggagacttagcaaggagctgctctgtggaattaaaacccacacagataatggcccttactctatcatggacgtgctgcgcgaagggaaccccaataacaatgcgcggtccgagacgatggttttcatggagattctgagagatgacaagttcggatttgacaaacttatcgaagaggaaaacatgcgccgggtgagcgaggtcgataacttcgacgtgaatgatctccctggctctcccgccgtcagacggaccgtgaaccaggctaagcgcattgttgacgagatcgtggggattgccggctgcgaaccgcaaaatatctttatcgaggtcacaagagatgaagacggacggaacaaaggcagacgcaccaagcggagatatgataatattaagaacgctatcgccgcgctgaaaaaggagcagaaagaatacttcaataaggacgtgtccgatagcctgaacaaaacaaatccttccgacctcgataacgagcgcctggccctttactttatgcagaatgggaagtgcatgtattgtggaaaggacctggatattaaacagctcgacaagtaccaagttgaccatatcctgccccagtcttatgtgaaagatgacagcttcgagaacaaggctctggtccacatggaagataatcagagaaaatccgcctctatgcttctcgacgatagcattatccggaagatgaagccttactgggaggctctgcgcgccgccggcctgatcggggagaaaaagtttaaaaacctcaccagagtgcgggtgtccgacaaggaactgggaggcttcattgctcgccagatggttgaaacgagccaatctatgaaacttacatccctggtcctcgagaagacctatcccaataccaacgtgagacccgtgaaagcggggtttagctctgatctgcggaagcgcctggaccttatcaagtgcagagagattaacgattaccatcacgcccacgacgcttatctcgcctgtgaaatcggccagttcattacaatgcggcataataaactgtacgagaaccctatctcctacagccacgccgtcaaggattttatcgctaaacgcgccaagtatgcgaatgaccatggaaccccgatgtctacatacggcatgcccgggagctccagcttcgtgatttcttcctttctgacgagcggattcgacgaagagaccggcgaaatcttcaaagatgcttggtccgccgaggttgccgctgtgcggattcgggagtctctcaacagaaaggactgctatatcagccgcatgcctgaagagacatccggggccttttggaaggaaaccctgatttctccccgggatcctagccttgggaaaaatctgtccctccccatcaagaaaggcctggacccgagaaagtacgggggctataacgagcagaaattcgcgtactttttcgtctatgaggctgtgaagatcaagaaaaagggagaagttaaagagtacgtgtttgccgccgtccctgtgcaggttgctgccattgtggctcgcgatcccaatgccctgacaggcttcgcgaagaaagacgccgaagctcggaagatcaagtttcttagaattatccgcgagaaagtctacaagtatcaactcattgaagtgaacggggagcggctgtacatcaccggactgaaatctgtgagaaatgcccgccagattgctctcagccaggatatgacgaccgtcttcctgaaggccatcaacgacaaagatgttgccgaggacgaacttaagtccctgtttgaggaaatcgtgcaacggtatagactctgtgctaatcggctgggcaaccagctgaagattttcagcctttctgattcctttaatagcgcgaactctgagtccaaaaagcgcgccctggtgagcctcgtcgctatcattgacgccaaaacaaataagatcgatctgtctgggattggatccggcaaagccgtggggaacatgagactcagcttctccaaggaaatgagcaactctaaaaatcacttcgcttttatcgaccagagcgttaccggcatgttcgagcggaagacatacctgtga

SEQ ID NO: 4066 - RNA, 3777 nt, synthetic construct
  misc_feature 1..3777: note = Cas9 variant
  source 1..3777: mol_type = other RNA
atgaccgaggaaaaccccgacatcagaaaggtgttcctggccattcaccatatcctcaaaaatcggggccactttctgcttcaggggcaatccttcaaggagggaaacctgaataacctcattaaagaactgcttaatctggatatcctccatatttccatcgagatcacagaagagaacattaataagatcacggagattgctctggagaaaaagaccctgacagacaaggtcaacgatctcaaaaagatctaccctaaagagaagcagctgcttgaagcctttcgcctgattttcggcgggaaaacctctctcgacaagctgtttgcgatcgatgagtataaggagcttgacgctagcgttaaatccgtgtctttcaaggagaaaatttacgaagaagtgagacacgattatgagcaggtcctgagcaattacatcgaactcctggacctggccaagctcgtgtatgattccatcattctgtctgacatcaaaaaggagggaaaaacacttagcgagtccaaggttgaactgtaccataagcaccgggaggatctcaccaaactgaagacacttgtgaaaaacgacagcaagctgtctgaagataaaaaggtcgagctctattccgccatttttaaggaagacaaagacaagggcaccaattacgtgaactacatccgcaaaagcgaggaggggaagggatgcaattatgaagatttcaaaaagtttctggttaaggagctggctaaactcgaagagtcttccgccaaggaagagattctgagagaccttgagctggaactcttcctgccgcttcagcggacgaaagataacagcgtggtcccctaccaaatccacaaggaggaactggtgaaaatcctcgacaatgctgccaagtatcataagtttctgaacgagaaagatgactctggctactccattatcgagaaggtgattcagctgctcgagttccgcatcccttattacgtcggccccctgaacagctccaaaaaggcgaaagttgatgggtttgcctggtctgtgagaaataagggatatgaaaacacccctgtgacaccctggaattacgaaaaagtcattgacgagagcgcttccgccgaaaagttcatcaccaaccttacaaataagtgtacctacctgaaaggcgaggatgtgctccctaagagctctctgctgtattccgagttcgcccttctcaacgaactgaatgctctgaaatacgacgggaaccggatcagcctcgaggcgcgcaatgttattatcgaaaagctgtttaaagagcagggaaagaaggtgacgaaaacatctattaagaaccttctgaaagccgaaggctatatcgatgggaagggagagattaccggcatcgacattacagtcaaaaatgacctcaagagctacagagatttcaagaaaatcctgggcgacaagtttaacaccgagcacgtggaaaatatcattctgtggatcaccctttatggggagtcccggaaactcattaaggctaaaatcgaagccgtttacggagatatttattctaaggaggaaatcgctaagatgagccgcctggtgtacaaagactggggcagattctcccggaagctgctcacagagctggtcagcaaaaagctgtacaacgaggaaacgggggagtgccttaatatcattggagccatgcgccagaacaacatcctctttatggaactgctggccgatagattcgactattctcaacagattatcgattacaataaagagcttcagaaggaggtgaccgaaattacaccggagatcctcgacgatctgtatgtctcccccagcgtgaaacggtctatctggcagaccgttagaattgtggaagaactgaagaagatcattggctgtgctcctgcgaaaatctttgtcgaaacaacccgctccaaccaagacaagaaaaagcccacggatagccggaaaaagcagctcgagctgttctacaaggccgtgaaaaaggacgttaaagatcttgagaaggaaattgggtccctgaattttgacaaactcaacgagagactgtctagcgtggaaccttccaagctgaaggctaaaaagctctatctttactatacacagctgggacgctgcatgtactctggcgagaccatcgacatcacccaactgaatacaaccgcctacgatattgaccatatctatccccagagcaaagtcaaggatgactccttcacaaacacggtgctcgtgaaacgggaatacaatgccgctaagaccgatagatatccgctgggcagcgacattcagacaccttctaaccgccggttttggaagttccttaaagagaaggggctgatcaccgatgagaaatacaatagactcgttcgcacagaagagttttccgacgaggaactgaccggattcattgcccggcagctggtcgaaacgagccaatctgtgaaggcggtggctggcatccttggggagctgaaccccaaaacctccatttgttatagcaaggccgagaatgtctctagcttcagacagaactttggaaagatcaaagaaggcaatcgcaagtccgataacacagagcagctcatcaaagtgcgggaaattaatgactaccaccacgccaaggatgcttatctgaacgttgtggtcgggaacgtgtacgacaccaaattcacaagaaatgtttttaacttcatcaaggataaaaaggacggccggaagtacagcctcaataacgtgttttatgagaatgtctctaactccaataacgtggcctgggagctgaataaaaccgttcatcaggtggaaaaggtcatgaacaataacaatattcttgtgacgcgcagaacaagcgagcaaaaaggaggcctgttcgacgctaccgtgtacaaggccaaagtcgcggccaaggctaaggaaggggtttattaccctctcaaaacatccgatcccgtggtgaacgacgtcaccaagtatggaggctttaccaaagtgaagatcgcctactattctattttcgagtacacactggttaataaaaagggggaagagaagatcacgcggatcattcccatccctatttacgtgagccagaacatcaaagatgactccaccctgcttgagtttggaaagacacagattaacatcaaatctggcgaagaggtcaaggatttcaaactgaagtatagaaagctctgcatcggggacctggtgaaaattaataactttttcaattttatcggcggaaagaccaacgatagcttcgtttacgacggcgctgtgcaggtcacactcgataccgaatccgagcgctatattaaaacgctgtctaagtaccaaaattggaaaaaggaaaacaaagacggggagctttgggagagcatcacaaaggaaaagaataccgagctgtataacctcctggtggagaaaatgaatagcggaattttcatcaagaaaaagccgaacaaatttaatgaactgaacagcgaagagattcggaataacttctcttccatcagccttgaggaacaggccaaggttctgctcgaggtgctgaatctcctgaccaacaagaaatctatctttgatcttaagtccattaatatcacagcggccagaggcaaaattagcttcaacctgtctaacctgtcccagtttagcatcattgaacagtccgtcgctgggttctacgagaaggagatcaccatcattggagacaaagaaaatgacatggagaacaataactgttga

SEQ ID NO: 4067 - RNA, 3780 nt, synthetic construct
  misc_feature 1..3780: note = Cas9 variant
  source 1..3780: mol_type = other RNA
atgaagtacatcctgggcctcgacctgggggtggccagcattggatgggctgtcaccgagatcaacgaaaaaggcgagcccgttgggcttattgatgccaattccgtgatcttcaagcctctggacaacgataaaggaaagctctataatgtggaaagacgggacaaacgcggctctagacggattctgcgcagaaagaagcaccgggtcgagcgcacaaaaatgcttctggtgaacagctcctttctcacgaatgaagagatcgataacctgtacgttgggaagctggacaatatctatgaggtgagactcaaaggactgaaggaacagctttctaaaaacgagattgcgcggctgatgatctactattgcaagaatcgcggcttcaagagcaacagaaaaaccgaagatctcgagattctgaagtcccttggcgagaaaatctctgaaaaggacagcgatgagaaaaagctgaaaccgattatcgctaagaatacagaactcattgagtccaaggggctgacccccatcgaagtcatctacatgattcgggagaacgacaatagcatcctgggatttaaaaacaaggagggcaattataaattcgggtttaagcgcaaccaagtgattgatgaagttagaaaaatcctcggaacacagcagattctgtctaaggagatcgtggacgaatacatcgatattctttccagccagcgggacttctctgacggccctgggggagattccaagtacaaaatcgactataccaagctggccggcaaatgtaagtacacaggcgaggtccgcgccgtgaaaagcgctccctcttatgaaatttttaccatgctccaaaagctgaacgatatcagatacgtgaagttcacgtccgaggacaaaattgagaagaaaaagctgagcaaagaagtcatccataagctgtatgatctcgttgtggagaagaataaaaccctgacatacgacctgatcgaaaagtccattgatgaggaaaacatcaaactcctgaatattcctaaactttctaagagcaagtatgtggagctgcggaaatcctactttaaggagagaaacgacaatgaaaacctcaccgaggaagagatcaatgccttcaacgagaagctgaataacgaacgcatgaaacaggagcttattcggaataacctgaaggcttacaaagaactcaagagcaaatttaagaagaataacatcgatgagaatagaattaaagaacttgggggaatctatttcctggacctcgtcgccgagctgcttacatactctaagaccgatgagaaactggaatattttgtggagaacgttgaacgctactccctcttcaaggagcagcgggacatcgtggaaattatcaaaacgttccccaactatacaaagaatggcaacctgagcctgtctcttgtcagagagctcaataagctgctgatggaggggcacgactacgaaagctccctctctagcctgaactattacattgataccgacgtggattgggagaaatttcctacaatctccgaaattgaggacagcctttctaccaagatcaccaatccgaacgttaaacatatcctggtgattctccgcaagctgtacaatacactgcttttcaaatatggacggcccgaaaaggtccacctcgagctgtccagagattttagcaacgacttctctacgcgcaataagatccagaaagagcaactggaaaacaaggtgcggagagaggtcgcggcctttgaaatgtacggcgctaataaagatattgtggccgggaaggaccgcctctccaacgatgacttcgttcggatcaaactgtgggaggagcagaataaggtgtgcatgtatagcggaagaaccattgaaaaataccagcttacatccgctgaggtccagatcgatcatatcctgccttattctaagagctttgacaactcctactctaataaggtgctcgttttcagcaacgaaaaccaagataaaaaggagcggaccccctatcagtggctgaaaggcacagaaaagtggaatgagtttaaacagcgcgtgagactgaaccttaatatttccaacaagaagaaagagaatctcctgttcgaagacgaggtcgtgaacaatgaatttctggagcgggaactccacgccaccagctactcttccagactggcgcttaacatcttccaacgcctgattcctgtgagcgacgaggataagtacgacgagcacggcaatgaaaaagttaagtatctctacaaccggaatgtcatcgcctttcaggggaaaatgacgtctatgctgagaaacctgtattcccttaataagtacacacatagcttcgagtctgataccctcgacattgataacaaggctttcatcctgaaagaatttgagatcaataaggacaacctgaaaatgaccgcctataacgtgaatacaggactcgaaattaccagcgagacaaaggtggagaaaaacaagtccggcgagttcaagacgatcaaagatgaactgcttaagaaagaactggacaagaaagagaatctcattgagatcagcgattactttaaggacaaggtcctgttcgatctgaaaattgtggactttgaagagatcgataccgttgaacccgagattatctctatcctttataagatgattacagctctgaaagaagaggtgtactccaagaaccgcgagaatcacctccatcacagcctggacgccttcctcctgaccatcatgaacagatccatgcagatgaaacttattaagtacaatcagctgatctctgtcctcaaaaacaaggaaattgagatctttaatgaagagaagggggaatatatcgacagcaaagagttcgccgaggaactgcaaaagcagaaaattatcgatattgacggaaacgagcggggcatcaagtttaatgtgaacgggaaaacacaccgcctgaatcttgttaagccgtacgaaaacttcctggatgacattaagaataaaatctttgataagagagagaacaataaactcccttatcatgtggtcaagtccaaagtgtctggcgctctgcacgcggaaaccatcctcggagagagcaagggcgagattacgaagcggatctccgttttcgacattaactacaaaaacctggggaagatctttgataaagacggatctcagaaggaaatttatgagacccttgtgaaatggctggaagccaagagcaaggattaccccaaactcaagaatggcaacatcattaaaaaggtcaaaatcgtggacgggaataaggataaactgatcaagctgggaaacaagcgctatgtggagatgggcagaacaaccgtcaaaattcttgttctgaagaaagaggctgaagaggggctcaagttcgcctccatcggccggtacaaatacaatctgctcaagagcgaaaaggacgtgaacatttctatctggaaagacgccattcatttctgtaaggtgcgctataataaactgaaggagaacggatacagacttatccacgaactgatccctggcgagacaattgagctggaactcaataaagggaacatctccaagtgcctggtcgtgggatttagcggcgggaagattgagatctcttccgttattggagatgctcttgacctgatcaatgataaaatcagcacccggattaaggaacgctattacatcacggtgtctacaattaaatccatcaagaaaattaacaagaatatcctcggcgactga

SEQ ID NO: 4068 - RNA, 3792 nt, synthetic construct
  misc_feature 1..3792: note = Cas9 variant
  source 1..3792: mol_type = other RNA
atgcacaagaacaatcccgacatcagagagctgttcctcgccattcatcacatcctgaaataccggggccattttcttttcgctgggcagcaatttaagggaagcgaaattaaagataacatccgcgagctgctccagtataattccctgaacattaagatcgacatcaccgatgaacttattaataacatcgccgagattctgctcaaaaagaaaaattctacagacaaaatcattgaatttaagaaactgtttgcggatgagaagcagctgatcgaggctctcagactggcccttggcaacaaaacgcagctggccaaactcttcgacattgaggcttacaaggaactggatatcagcatcaagaccatttcctttaaggaaaagatctatgaggacgtgcggtctaattacgaggaaattcttggggagtatatcattgtcctggatacagccaagctcatctacgacgctatcattctgagcgaaatcaaaattaagaacatgaccatctccgagtctaaagttattagctatgaaaagcacggaaaggatctgaaacaactcaagcagctgatcaaagaggactccaagctgagcaaaaaggagaagcgccagctgttcgaaaatatctttgtgaaagaggatgaaaaggaggccaactacgtgaattacattggcaaaaacaatgtcgggtcttccaagagctcttgctcctatgaagacttcaaaaagagcctcatcaaggagctgaaatactgtgaggaatctaaacttaagcaggacattctggcggagctcgaactggagacatttctgcctagacaacggaccaaggataactccgtgatcccgtatcagattcataaagaggaactcgagaagatcctgaacaatgccgttcagtaccaccccttccttaacaatacagacgaatatggaattagcatcaaggagaaaatcattcagctgctcgaatttcgcatcccttactatgtgggctccctgaacacctctcacaaggtcggcaatgggggattcagctggtccgtgagaaacaaaggctacgagcggacggctgttaccccctggaatttcaacaaggtgattaataaagaggaaagcgccaagaactttatcgagaatcttacaaaccaatgcacctacctgctctatgaagatgtcctgcctaaacattctctgctctactccgagttcacactgcttaatgaactgaacagcattaattatgggggaaagcgcctcaccgtggagcacagaaacctgatcatcgagcggtttttcaagcagtctgctcccaaagccacgggcaaggaactgaaaaagtttcttatgagcgagggggtgattgacggaaaagatgaactctccggcttcgacatctctattaagaacgatcttaagagctaccgcgactttaaaaagatcctgggcgagaaattcgattccgaaaaggtcgagaaaatgattagatggatcacactctttggggagagcaagcagctgcttgttgacaagatcaccaaagaatatggagatatttactcttccgaggaaatcaagaaaattagcggcctgacatataaggactgggggcggctctctgagaaactgctgaccgaaatcgtgtccagccaactttacgacgagtccaccggagagtgtttcaatattatcaacgcgatgcgcaataacacactcctgtttatcgaactgctcggcacgaattacgattatttcgagaagattaacacctacaatgggaagctgagaaaagaaatcacagagattacccctcatatccttgacgatctgtatgtgtctccggccgtcaagcggagcatttggcaagtggttagaatcgtggaggaactcaaaaaggtcattggatccgagcccaaacgcatctttgtggaaacaacccggtctaacaaggagaaaaagggcgacgatggcagaaaggacagccgcaaaaaggctctgctggaactttacaaaaagatcaaaacgtccgatattgccgagctcgagaaggctctggggcacacagttgacttcgataagaaaaagcaggacctgaccgatatcgacaataacaaactcaaggcccggaaactgtatctttactatacccagctgggaagatgcctctacacaggcaaggccattgatctgaataacctgttcgggagcaattctgaatacgacatcgaccacatttatcctcagtccaagaccaaagatggaagctggaacaatcttgtgctcgtcaacaagacagagaactctaaaaagtccaatggcctgatcagcgaatctatccagcgcaaaaacaagcatttttggcggttcctgaaggctaaaaatctcattagcgaggaaaagtacaaaagactgacgcgcaccgaggactttacagatggggagctttccggcttcatcgcgcggcagctgattgaaaccagccagtctgtgaaggtcgtgtccaaaatcctccaaaacctgaatcccacaaccgagctgtgttttagcaaggccgaaaacgtttccgacttcagacaggagtttggaaagattaaagtgggcaagcgcaaaaatcttacggaagaggagcagaagaaagctaaggaagggcagctgatcaaagtccgggatctcaacgacctgcaccatgccaaggatgcctatctcaatatcgtggttggaaacgtgtaccacattaagttcaccagaaatcctaaaaactttatccggaagaatttcaaaaaccgcgagtatacactgaatacccttttctactctgacaaggtcgaaagaaacggcgaggtggcttgggagaaagggaagacagaagagattgtgagctccgttatgtgcaacaatctgatcaacgtcacccggagaacgtctgaacaaaagggagccctctatgaggcgacaatttacaaagctaatgccgccaaggaaggcagctactatcccgtgaaaaccaacaataagaacctgaaaaatgtgacacgctacgggggcttcacctccatcaagattgcttattactctatctttaagtatgatatccggaacaaagacaaggtcaaagagaatattaagatcattccgatccctatttacatcagccagaacatcaaaaccgatctggaccttattaatttcgccgagaagcagatcaagctgaaaaagggagaaaacattgagaatctccagctgatctataaaaagctcaacattggcgctctggtgaaaatcgatcattacccctactatatcgggggaaagacagacgacaatttctacgttgatggcgccgtgcaagtccttctgtccagcgacattgaaagatatctcaaagaggtggttaagtttgtgaacttccagcgcgaaaataaggaggcgaaagtctctaaggagcacatctccctggaagagaacattaaactgtacaacacgcttgtgtgtaagatggccaccaaaatctttacacacaagaagaataacaaatataatgatctgacccaggacaaggctaaaaacacattcaataagctcagcctggaggaacaatgcaaagttctcctggaaattcttaacctgctgaccaataagaagacgacatttgatctctctctgatcaacgagaaaacctccagagtgaagtgtgggttcaatcttctgaaccagaaacagtttagcattatcgagcagtctgtcaccggactctacgaaaaggagatcaaaattatcgaagactga

SEQ ID NO: 4069 - RNA, 3795 nt, synthetic construct
  misc_feature 1..3795: note = Cas9 variant
  source 1..3795: mol_type = other RNA
atgaagaacgtgctgggcctcgacctggggaccaatagcatcggatgggcccttattgaggtcgatgaaaacaatctgcccatcagaattatcgctatgggctcccggattatccctctctctacaagcgacaaagaggagttccagcgcgggctgtccatcacgaagaaccaatctagaaccgttagccggacacagcgcaaaggatacgatagaaagcagcttaaaaagtccgacctgaagaaaattctcaataagtataacatctttccgtctgaggaactgctgcggctccccatgctggatctttggaaactgcgcagcgactccgccaatcctgatgagaacattagcgcggagcagctcggcagaatcctgtacatgcttaatcaaaagcgggggtataaatctgctcgctccgaagccaacgccgacaagaaggatagcgactacgtgcaggctgtgaaaggaagatatgatcagctgaaggaccggaaacagaccattggccaatacttctatgatgagctctacaatgccaacgctaataactcttactttcgcatcaaggaagaggtctatcccagagaggcctacattgaagagttcgacacaatcatctccgcgcagcgggaaaaacacgactttctgaccgatgaggtggttcatcagctgcgcaatgaaattatctatttccagagaaagctcaaaagccaaaagggcctggtgtctatttgcgagtttgaggggttcgaaaagacagtctttgacaaagagaagaacaaaaacaaggtggttttcgtgggacctaaagtcgcccccaagacctcccctctttttcagctgtgtcggatctgggaagtggtgaatacgattaccctcaagatcaaaaacccggagggcagcaagtacaaatggggagaaaagatccccgatattaaagagaaggagatcctggctgactatcttttcaagaatgaatccctgtcttttagcaaactcctggagattctggaactcaagaaagagaacgtctacgttaataagcagatcctgaaagggattaagggcaacgaaacatattccgcccttcacagcatcctgggggataatgagctcctgaacttcgacgtgtctatcatgacctccaatcaaacagcccttctggtggatagaaagaccggagagattctcgaggagcgcgctggcctggaactggacgcgagcctcgagaaagagcctctgtaccagctttggcatacgatctactctctgaaggatctcgacgaatgcaaaaacgccctgattaagcggttcgattttgacgacgagacagctgaaaaactgagcagaatcgatttcaataagcaggcctttggcaacaaatccaataagtctatgcgcaagattcttcccttcctcatggaggggtatgactacagccagtccagctctctggctggatataaccactccaatagcctgaccaaaaacgaacgggagcaacagatcacactcgatagactggagcttctgcctaagaactctctccgccagcccattgtcgagaaaatcctgaatcagatgatcaacgtggttaatgccattctggacgaatacggcaagccgtccgaaatccgggtggagcttgccagagaactcaaacaaagcaaggatgagcgcaacgagaccgacctgcaaaattccaagaacaaaaagctgaatgatgaaattgggaaacggctcgaggaactgggacttcctgtcaccaagagatatatccagaaatacaagtttattttcccctctctgagcaagaacctcaaagaggctaaggtgaataaccagtgtatctattgcggcgaaacatttaatctgacggaggcgctgtccggggacgcctacgatgttgaccatatcgtgcctaaagcccttctcttcgatgactctcagaccaacaaggtcctggtgcaccgcaaatgtaatagcacaaagaccaaccagacagcttacgattatattgccaccaagggagacgagcacctgaaactctactccgaacggctggacgattggtttgagagaggcatcattagctattctaagatgcagcggcttaaagtctcccataaggaatacctggagcgcaaaaagctcggcaaagagacggaaacagacaagaagctgtgggagaatttcatcgatagacagctgcgggacacccaatatattagcagaaaatctcgcgaaatccttcagaagatctgcaacgatgtgaaaaccacagaagggggagttaccgctaagctccggaacctgtggggctgggacgatgtgctgatgaatctccagatgcccaaatacaaggaactggggcaaacaattacgaaggagtggacctccgagcacggaaaaagaaagcatcagaaagaagagatcgacaactggacaaagcgcgatgaccacagacaccatgccattgatgcgcttgtcatcgcttgtaccaaacagggctttattcagcggatcaatacactgaacagctctgacaccaaggatctcatgatcaaggaagtggaggaagccaaaattgagttcaatgagaagacgaccctgctggaaaaatatcttaagacacaaaaaccctttagcacccaggaggttatgaaggaagccgacaagatcctggtgtccttcaaagctgggaagaaagtcgccacaattaccaagttcaaagctacgggcaagaacaaggagacaggagtgatcgtgcctcgcggcgccctccacgaacagagcgtttacgggaaaattaaggtcatcgagaaagacaagccgctgaaatacctcctggaaaattctgataagattgtgaaccccagaatcaaaaatcttatcgaaattaagctgtccgagaacaagaatgaccctaaaaaggcgctcctggccctgaaaaagatccccatttttcttgatgaggaacagagcatcaccctggagaaagctagctgctataacgacgccacagtgctcaagtacaagctgcaaaatctcaaagctgcccaggtcgatgacattgtggatgaaaaggttaaaaagatcgtgcgggagcgcctgtctcagttcggaaacaaagaaaaggaggcgtttaaggacaccctttggttcaatgaagagaaaaagatccctattatcaccgtcagactgtttgcccggcccgatgctaacaacctccagacaattaaaaaggacgagaatggcaacgggatcggattcgtggttacgggcaataaccatcacattgccatctatgaagataaagacaataagccggtgcaacatagctgtaccttttggcacgctgtcgagcgcaagaaatacaacatccctgccgtgattagagactcctctgaagtttggaatgatctgctgcggaaggagcttcccgaatccttcctgaacaaactccctgccgacaatctgaacctcaagttttccatgcagcagaatgagatgttcatcctggggctttctcaagatgagtttgtgaaagctattgcgaacaatgacaagagcctgctgtccaaacacctctatctggtctggagcatctctgaaaacaattactggttccgccatcaccttgagacaaagaactccgatctgaagaaaaccgacggcgtgaaggaaagcaaaagactctataatattcggtctctgggatccctctttagcctgaaccccatcaaggtgagacttaactacctgggcgagattacaaaaatcggggaatga

SEQ ID NO: 4070 - RNA, 3801 nt, synthetic construct
  misc_feature 1..3801: note = Cas9 variant
  source 1..3801: mol_type = other RNA
atggccaagtacatcctgggcctcgacctggggaccaacagcattggatgggctcttatcgaggtggatgaaaataacattcccatcagaattatcgtcatgggctcccggatcattcctctgtctagcaatgaccgcgaggagttccagagagggctctccatcacaaagaaccaaaatcggacgatttctcgcacccagagaaagggatatgatcggaaacagctgaagcgcaacgaccttaataaagttctgaacaagtacaatatctttccgagcaagatgctcctgaacctgcccatgctcgatctgtggaaacttagatccgactctgccaatagcaacaaggatatttccgcggaacagctgggccggatcctctatatgctgaatcaaaaacgcgggtacaagagcgtgagatctgaagctaactccgacaaaaaggatacagactatgtgcaggccgtcaagggacggtacgcccagcttaaagatcgcaatcagaccattggccaatatttctacgaggagctgtacaacgctaacgtgaataacagctattttaagatcaaagaagaggtttaccctagagaagcctatatcgaggagttcgacacaattatcaattctcagaagaccaaacacgaatttctcacagatcagttcgtgcatcagctgcggaacgagattatctactttcaacgcaagctgaaatcccagaagggcctcattagcatctgcgagttcgaagggtttgaaaagaccgtcttcgacaaagagaagaataaacacaagatcgtgtttgttggacccaaagtggctcctagatctgcgcccctgttccagctttgtcgggtctgggaggtgattaacacgatctccattaaggtgaagaatcctgaaggcagcaaatataagtggggagagagaatcccgtccattaaagaaaaggagatcctggccgactacctctttaaaaacgaagtcctgtctttcaccaaacttctggagatcctcgggctgaataagaacgatgtttatgtgaataaacaaattctgaagggcatcaaagggaacgagacatacgccaccctctacaatattctgggagaaaacgagttccttaattttgacgtgagcatcattccctccaaccatacaagcatgctggtcgataagaaaaccggcgaaatcctcgaggaacgcgctggcctggagcttgacgtgtctctggagaagcagcctttctatcagctctggcacacgatttactccctgaaggatctggacgaatgcaaaaacgccctcatcaagcggtttgatttcgacgatgagacagctgaaaatctgagcagaatcgactttaacaaacaggccttcgggaataagtctaacaaaagcatgcgcaagattcttccctttctgatggagggatatgattactcccaatcttgtagcctcgcgggctataatcattccaacagcctgaccaaagacgagcgggaacagcaggttacactggacagacttgagctcctgcctaaaaattctctgcgccagcccatcgtggaaaagattctcaaccaaatgatcaatctggtcaacgccattcttgatcagtacggggagctgtccgaaatccgggtggagctcgctagagagctgaaacagagcaaggacgaacgcaatgatgccgacctgcagaacaccaaaaataagaaacttaacgatgagatcggaaagcggctcgctgaactgggcctgccgattaccaagagatatatccaaaaatacaagttcatttttccttctctctccaaaaatctgaaggacgcccacgttaacaaccagtgcatctactgtggggagacattcaatcttagcgaagccctgtccggagatgcttatgacgtggatcacattgtccccaaagcgctcctgtttgacgattctcagacgaacaaggtgctggtccatcgcaagtgcaatagcaccaaaacaaaccagaccgcctacgactatatctccacaaagggcgatgagcaagtgcggatctacttcgagagagttgacgactggtttaaatctggcattatcagctattccaagatgcagcggcttaaagtgagccacaaggaatacctcgagcgcaagaaaattgggaaggaaaccgagacggataaaaagctgtgggaaaatttcatcgacagacagctgcgggatacacaatatatttctagaaaatcccgcgagatcctccagaaggtctgtaacaatgtgaccaccacagagggaggcgttaccgctaaactgcggaacctttgggggtgggacgatgtgctgatgaatctccagatgcctaagtacagagaactgggacagacagtcatcaaggagtggacgagcgaacatggcaaacgcaagcaccaaaaagaggaggtggaaaactggaccaagagagacgatcaccggcatcacgccattgacgccctggtgatcgcttgcacaaaacaggggttcattcagcgcatcaatacccttaactcttccgatacaaaggacctcatgctgaaggaggttgaagaggccaaagtcaagtttagcgagaaaaccacgctgctcgaaaagtacctgagaacccaggagcccttctctacacaagaagtgatgcgggaggcggataaagtgcttgtcagctttaaggctggcaagaaagtggccaccattacaaagttcaaagccatcggaaagaataaagactccggcgttattgtgccccgcggggctctgcatgaacagagcgtctatggaaagatcaaggtgatcgagaaagataagcctctcaaatacctgtttgaaaactctgacagaattgttgacccgaaggtgaaaaagctggtcgaggtgcggctttccgagaatgaaaacaacagcaagaccgccatctccacgctgaaaaaggctcccattttcctcaatgaggagaaaacagaagttctggaaaaggcctcttgttataacgatgcgaccgtgctcaaatacaagctgcagagcatcaaagcctcccaggctgacgatattgtcgacgagcgcgtgaagtttcttgtgaaggagagactggcccaattcggcaataaagaaaaggaggcttttaaagatatcctctggttcaacgaagagaagcagatccctattatctctgtccggctgtttgcccgccccgacgcgaataacctgcaggttattaaaaaggatgagaatggaaagagcatcgggttcgtgcttacaggcaacaatcaccatattgccatctatgaagacaaagataacaagctgatccaacactcctgcaccttttggcacgctgtggagcggaaaaagtacaatattcctgtcgtgatcaaaaactctagcgacgtttggtcccagctcctggataagcagctccccgaaagcctgcttaataagctgccgaccgacaaactcaacctgaagttctctatgcagcaaaatgagatgttcattctggggctttcccagaaagaatttgacgaggccatcaagaacaatcataagagcttcctgtctaagtatctctacctggtgtggtccattagcaacaacgattactattttagacaccatctcgagacaaagaatacggaactgaaaaacatctctaccgctaaggagtccaaaagatacttccgctttaagagcgtcggcgcccttgtgggaacaaatcctattaaaatccggctgaaccacctgggcgaaatcaataaggttggggagtattga

SEQ ID NO: 4071 - RNA, 3807 nt, synthetic construct
  misc_feature 1..3807: note = Cas9 variant
  source 1..3807: mol_type = other RNA
atgaccaagaacatcctgggcctcgacctggggacaaatagcattggatgggcccttatcgaggtggatgaaaacaatacgcccattagaatcattgctatgggctcccggatcatccctctgtctaccagcgacaaagaggagttccagcgcgggctctccattacaaagaaccaatctagaaccgtcagccggacacagcgcaaaggatacgatagaaagcagctgaaaaagtccgaccttaagaaaatcctgaataagtataacatttttccgtctgaagaactcctgaaactgcccatgctcgatctgtggaaacttcggagcgactccgccaatcctaacgagaatatcagcgcggagcagctgggccgcattctctacatgctgaaccagaaaagagggtataagtctgctcggtccgaagccaatgccgataagaaagacaccgattacgttcaggctgtgaagggacgctatgcccagcttaaagagagaaaccagacaatcggccaatacttctatgaggaactgtacaatgctaacaccaataacagctactttcggattaaggaggaagtgtatccccgcgaggcctacacggaagagttcgacaccatcatcaacgcgcagaaaaataagcacgattttctcacagacgaagtcgtgcatcagctgagaaacgagattatctatttccagcggaaactgaagtctcaaaagggcctcgtttccatttgcgagtttgaagggttcgagaaaaccgtgtttgataaggaaaagaataaggacaaagtcgtgttcgttggacctaaggtggcccccaagacaagccctctgtttcagctttgtcgcatctgggaggtcgtgaacaccatttctctgaaaatcaagaatccggaaggctccaaatacaagtggggagagaaaatccccaacctcaaggagaagcagattctggctgactatcttttcaaaaatgatagcctgtcctttacgaagctcctggaaatcctggacctcaacaaaaatgatgtgtacgtcaacaagcaaattctgaaagggatcaagggcaatgagacattctctacccttcacacagttctgggggacaacgaactcctgaatttcgatgtgagcattatcccttccaaccataccagcatgcttgtggacaagaaaaccggagagatcctggaagagagagccggcctcgagctggatgcttctctggaaaaggagcccctctatcagctgtggcacacaatttactcccttaaagacctggatgaatgcaagaatgccctcatcaaacggtttggcttcgacgatgagacggcggagaagctgagccatattgactttaacaaacaggccttcgggaacaagtctaataagagcatgagaaaaatcctgccttttcttatggaaggatacgactattcccagtcttgtagcctcgctggctacaaccactccaatagcctgaccaaggatgagcgcgaacaacagattacactggaccggctcgagctgctttctaaaaactccctgagacagcccatcgtcgaaaagattctcaatcagatgatcaacgtggttaatgccatcctggagcaatatgggaaactgagcgagattcgcgtggaacttgctcgggagctcaagcagtctaaggatgaaagaaacgacgccgatctgcaaaattccaaaaacaagaaactgaatgaggaaatcggaaagcgcctcgccgagctgggccttccggtcaccaaacggtacattcagaagtataagttcatctttcctagcctgtccaaaaacctcaaggacgctcacgtgaataaccaatgcatttactgtggggagacattcaatctgaccgaagcgctgtctggagatgcctttgacgttgatcatatcgtgcccaaagcccttctcttcgacgatagccagacgaacaaggtcctggtgcacagaaaatgcaactccacaaagaccaatcagaccgcttatgactacatcggcacaaagggcgaggaacaggtccgcgtgtactctgagcggattgatgactggtttaaaagagggatcattagctattccaagatgcaacgcctgaaagttagccataaggaatacctcgagcggaaaaagctgggaaaagagaccgaaacagacaagaaactttgggagaacttcatcgatagacagctgcgggacacgcagtatatttctcgcaaggccagagaaatcctccaaaaggtgtgtaataacgtcaccacaaccgagggcggggtgacagctaaactgcggaatctgtggggatgggatgacgttcttatgaacctccagatgcctaagtacaaagagctgggccagaccgtgatcaaggaatggacgtccgagcacgggaagagaaaacaccagaaggaagagattgaaaattggaccaaacgcgatgaccatcggcaccatgccatcgatgcgctggtcgtggcttgcacaaagcaaggctttattcagagaatcaacaccctcaatagctctgacacaaaagatctgatgcagcgcgagattaaggaggccaagaaacttctgggagaaaactataatgagaaggagttcgaaaacgacaatgagttcgtgaaaaaccacaaggaaagactctcccagctggatgactacctgcggcttcaaaaacccgttaagtttgataccaagtatgtcgagcaggaagccgacaaagtgctggtgagcttcaaggctggcaaaaaggtcgccacgatcacaaaatttaaggctaccgggaagaataaagacacaggagtgatcgttccccgcggcgccctccatgaggcggggctgtacggaattagaaccatctactctaagggcgggattgccgaaaaacacatcattaagaaatataaggtgggcgtcagcgctcaggatcacatcttcaccggaaaagagacatactccgtgaagaaggacaaaaacggcaacgaaaaggttgatgacaaaattaagatcgtgctcgatagcatcgtcgacaataaagtgaaggaggttgtgctgaaccggcttaatcgcgggtttaacaatgaggaagattatagaattgacgtcaagaaagccctgaacaatttcaagaacctcgatgaggaccctctgtggtacaatgaatctaaaggaatcaagattctgtccatcaaacttaagacgggcctgaaggatagcgtggtgccgctccggctgaacgagaaaaatgaggtcattaccctcgttaagacagggaacaatcatcacatcgctatctatgaagacaacgacggaaaactgattcagtactcctgtaccttttggcatgccgtggagcgcaagaaatataatatccccacagtgattaagaactctagcgaagtctggaatcaagtgcttgataagaaactgcctgagtccttcctcaacagactgcccgcggacaagctgaaccttaaattttctatgcagcagaatgaaatgttcatcctgggcctcctggaggaggaatttgataaggccattaaagacaacgataagagcctcctgtccaaatacctttacctggtttggtctatcgctgagggggactattggttccggcaccacctggaaaccaagaatacggagctcaagaaaacaaacggcgccaaggaaagcaaacgctactttagactgtccaccaagggacttatcgatctgaatcctgtgaaagtccggctcaaccatctgggcgagattaccaagatcggggagtattga

SEQ ID NO: 4072 - RNA, 3810 nt, synthetic construct
  misc_feature 1..3810: note = Cas9 variant
  source 1..3810: mol_type = other RNA
atgaacaatagcatcaagtccaaacccgaggtgaccattggcctggacctcggggtcggatctgttggctgggccatcgtggataacgaaacaaatattatccaccatctggggagcagacttttctcccaggctaagacggccgaggaccggcgctcttttagaggagcgcggcgcctgattagacggcgcaaatacaagctcaaaagattcatcaacctgatctggaagtataatagctactttggcttcaagaacaaagaagatattcttaataactatcaagagcagcagaagctgcacaataccgtgctcaacctgaaactggaagctctcaatgccaagatcgaccctaaagccctgtcctggattcttcatgattacctgaagaaccgggggcacttttatgaggacaatcgcgatttcaacgtctacccgacagaggaactcgctaattattttggagagtacggctactataagggcatcattgactctaaagaagataacgacgataagctggaggaggggcttaccaaatacaagttcagcaaccagcattggctggaagagatcaaaaaggtgctctccaatcaaacaggactgcccgaaaaatttaaggaggaatatgagagcctgttctcttacgttagaaactattccgagggccctgggagcattaattctgtgtccccctacggaatctatcacctcgacgaaaaggagggcaaagtcgtgcagaagtacaacaatatctgggataaaaccattgggaagtgcagcatctttcctgacgaataccgggcccccaaaaactctcctattgctatgatcttcaatgagattaacgaactgtccacaatccgcagctattccatctaccttaccggatggtttattaatcaggagttcaagaaggcctatctgaacaaactcctggaccttctgatcaagaccaattctgagaaaccgattgatgcgagacagttcaagaaactccgggaagagacgatcgccgaaagcattggcaaggagacactgaaggacgttgaacgcgaggagaaactggaaaaggaggatcacaaatggaagctcaaaggcctgaaacttaacaccaatgggaagatccaatacaacgacctgtccagcctcgctaaatttgtgcataagctgaaacagcaccttaagctggatttcctcctggaagaccagtatacaaccctggataaaatcaattttctccagtctctgttcgtctaccttggaaagcatctgagatattccaaccgggtggacagcgccaacctcaaagagttttctgatagcaataagctgttcgagagagtgctgcaagaacagaaggacgatctttttaaactcttcgagcagacggacaaggacgatgaaaagattctggctcaaacacactccctgtctaccaaggccatgctcctggcgatcacacgcatgaccaaccttgacaatgatgaggacaaccagaaaaataacgataagggctggaattttgaagccattaagaacttcgaccagaaatttatcgatattaccaagaaaaataacaatctgagcctcaagcaggacaaacggtacctggatgacagattcatcaacgatgctattctgtcccccggggtcaagcgcatccttcgggaggccacaaaggtttttaatgctatcctcaaacaattcagcgaggaatacgacgtgacgaaggtggtcattgagctggccagagaactgtctgaggaaaaagagctcgagaacaccaagaattatgaaaaactgatcaagaagaactccgataaaattagcgagcgccttgaagccctggacatcgctgaggacaagattgaagatatcctcaaatctcctacaaagtcctacaaagtgctgctgtggcttcagcaggaccacatcgatccctatagccagaaggagattgcgttcgaggacatcctcaccaaaacagaaaagaccgagattgatcatatcattccttactccatctcttttgacgatagctcctctaacaagctgctggttctcgccgaaagcaatcaagctaaatccaaccagacgccctatgagttcatcacaagcggaaatgccggcattaagtgggaggactacgaagcctattgtcggaaatttaaggatggggacacctctctgcttgattccacccagagaagcaaaaagttcgctaagatgatgaaaacagacacctcttccaagtacgatatcggatttctggcccgcaacctcaatgacacacggtacgcgacgattgtgttcagagacgctctgaaagattatgccaacaatcacctggtcgaggacaagccgatgtttaaagtggtttgcatcaacggcggcgtgaccagcttccttcgcaagaattttgataagtcttggtacgccaaaaaggaccgggataaaaacattcatcacgctgtcgacgccagcatcatctccattttcagcaatgaaacaaagaccctctttaaccagctgacacaattcgctgattataaactgtttaagaataccgacgggtcttggaagaaaatcgatcctaagacgggagtggtcaccgaggtgacagacgaaaactggaaacagattagagttcggaatcaggtgtccgagatcgccaaggtcattaacaaatgtatccaggatagcaacattgagcgcaaggcgagatactcccggaagatcgaaaataaaaccaacatctctctcttcaatgacacagtgtatagcgccaagaaagttggctacgaggaccaaattaagagaaagaacctgaagacccttgatatccatgaatccgctgaggaaaataaaaactctaaggtgaagaaacagttcgtctatcgcaagctggtgaatgtgagcctcctgaacaatgacaaactggccgatctttttgctgagaaggaggacattctgatgtaccgggccaacccctgggttatcaatctcgcggaacagattttcaacgagtacacggaaaataaaaagatcaagtcccaaaacgtctttgagaaatatatgctggatctcacaaaggagttccctgaaaaattttctgaggccttcgtcaagagcatgctgagaaataaaaccgctatcatttacaacgtggaaaagaaggtggtgcaccgcatcaaaagacttaagattctgtccagcgagctcaaagaaaataagctgtctaacgttatcattcggtccaaaaacgagagcgggacaaagctgtcttatcaggacaccatcaattccatcgcccttatgattatgcgcagcatcgatcccaccgctaagaaacagtacattagagtgcccctgaacacactcaatctgcacctcggagaccaggattttgacctgcataacatcgatgcctatcttaagaaacctaagttcgtcaaatacctgaaggccaatgagattggcgacgaatataaaccgtggcgggtgctcacgtctgggaccctgctgatccacaagaaggataaaaagctgatgtacatttccagctttcaaaaccttaaagacgttatcgagatcaagaatctcattgaaacagagtacaaagaaaacgacgattccgaccccaagaagaaaaagaaagctaatcgcttcctgatgaccctcagcacaatcctgaacgattatattcttctggacgcgaaggataattttgacatcctgggcctctctaaaaacagaattgatgagatcctgaatagcaaacttggactggacaagatcaccaaatga

SEQ ID NO: 4073 - RNA, 3810 nt, synthetic construct
  misc_feature 1..3810: note = Cas9 variant
  source 1..3810: mol_type = other RNA
atgaacaatagcatcaagtccaaacccgaggtgaccattggcctggacctcggggtcggatctgttggctgggccatcgtggataacgaaacaaatattatccaccatctggggagcagacttttctcccaggctaagacggccgaggaccggcgctcttttagaggagtgcggcgcctgattagacggcgcaaatacaagctcaaaagattcgtcaacctgatctggaagtataatagctactttggcttcaagaacaaagaagatatccttaataactatcaagagcagcagaagctgcacaataccgtgctcaacctgaaatccgaagcgctgaatgctaagattgaccctaaagccctctcttggatcctgcatgattaccttaagaaccgggggcacttttatgaggacaatcgcgatttcaacgtttacccgacaaaggagctggccaaatattttgacaagtacggatactataaaggcattatcgatagcaaggaagacaatgataacaaactcgaggaggaactgaccaagtacaaattctccaacaagcattggcttgaggaagtgaagaaagtcctgagcaatcagacaggcctccccgagaagtttaaagaagagtatgaatctctgttctcctacgtgagaaactatagcgaggggcctggatctattaattccgttagcccctacggcatctatcacctggacgagaaggaagggaaagtggtccaaaagtacaacaatatttgggataagaccatcggaaaatgcaacatctttcctgacgagtaccgggctcccaaaaattctcctattgccatgatcttcaacgaaattaatgagctctccacaatccgcagctattccatttacctgaccggctggtttatcaaccaggagttcaaaaaggcttatcttaataaactgctcgacctgcttatcaagacgaacggggaaaagccgattgatgccagacagttcaaaaagctgcgggaggaaaccatcgcggagtctattggaaaagaaacactcaaggacgtggagaatgaagagaaactggagaaggaagatcacaagtggaaactgaagggcctcaaactgaacaccaatggcaagatccagtacaacgaccttagctccctggccaaatttgtgcataagctcaaacaacacctgaagctggatttcctgctcgaggaccagtatgctacactggataagattaactttctgcagagcctcttcgtctacctggggaaacatcttcgctataataacagagttgactctgccaatctgaaggaattttccgatagcaacagactcttcgagagagtgctgcaggagcaaaaagacggactgtttaaacttttcgaacagaccgataaggacgacgagaagatcctcgctcagacgcactctctgagcacaaaggccatgctgctcgcgatcacccgcatgacaaatctggataacgacgaagataatcaaaagaacaatgacaagggctggaactttgaggccattaaaaatttcgatcagaagtttatcgacattaccaaaaccaacaataacctttccctgaagcaggataagcggtacctcgacgatagattcatcaatgacgctattctgtctcccggggtgaaacgcatcctgcgggaagccacaaaggtctttaacgctattcttaaacagttcagccaagagtacgatgtgacgaaggttgtgatcgagctcgccagagaactgtccgaggaaaaagagctggaaaacaataagaactataagaaactcatcaagaaaaatagcgacaagatttctgagggactgaaagcccttgatatcgctgaggacaagattgaagacatcctgaaatcccctaccaagagctacaaggtcctcctgtggctgcagcaggatcacattgacccctattctcagaaagagatcgcgttcgaagatatccttacaaagaccgagaaaacagaaattgaccatatcattccttactccatcagctttgatgactcctctagcaacaagctcctggtgctggccgagtccaatcaagctaaatctaaccagaccccctatgagttcattacgagcggcaatgccgggatcaagtgggaagattacgaggcctattgtcgcaagtttaaagacggagatacatccctcctggacagcacccagcggtctaagaaattcgctaagatgatgaaaaccgatacatccagcaagtacgacatcggctttcttgccagaaacctgaatgatacccgctacgcgacaattgttttccgggacgctctcaaggactatgccaacaatcacctggtggaagataaaccgatgtttaaggtcgtgtgcatcaacggcggggtcacgtctttcctgcggaaaaattttgacaagtcctggtacgccaaaaaggatcgcgacaagaacattcatcacgctgtggatgccagcatcatttctatcttcagcaataaaaccaagacactttttgaccagctcacccaattcgctgattataaactgtttaagaacacagacggatcctggaaaaagatcgatcctaagaccggcgttgtgacggaggtcaccgacgagaactggaaacagattcgggtgagaaatcaggttagcaagatcgccgaagagattgataaatgtatccaggactctaacattgaacggaaggcgcgctactccagaaaaatcgagaataagacaaacattagcctgttcaatgacaccgtgtattccgccaaaaaggtcgggtacgatgaccaaatcaagcggaaaaacctcaagacactggatatcgacgaatctgtggaggagaataaaaacagcaaggtgaaaaagcagttcgtttatagaaaacttgtcaatgtgtccctgctcaacaatgataagctggctgacctgtttgccgaaaaggaggatattcttatgtaccgcgctaacccctgggtgatcaatctggccgaacagattttcaacgagtacaccgaaaatcggaaaatcaagtctcaaaacgtctttggaaaatatatgctcgacctgacgaaggagttccctgagaagtttagcgaagcgttcgtgaaatccatgctcagaaataagacagccattatctacaacgttgagaaaaaggtggtccatcgcatcaaaagactgaagattctttctagcgaactgaaggagaacaaactctccaatgtgatcattcggagcaagaacgaatctggcaccaaactgtcctatcaggatacaatcaatagcgttgctctgatgattatgcgctctatcgaccccaccgccaagaaacagtacatcagagtgccccttaacaccctgaatctccacctgggggatcacgactttgatctccataacattgacgcttatctgaagaaacctaagttcgtcaagtaccttaaagccaatgagatcggcgacgagtataagccgtggcgggtgctgatttccggaagcctcctgatccacaaacgcgataagaaactgatgtacatttcttcctttcagaaccttaatgacctgatcgaaattaagaacctcatcgagacagaatacaaggagaatgttgatagcgaccccaaaaagaaaaagaaagcctcccaaatcctgagaagcctctctacgattctgaacgattatatccttctggacgctaaggataatttcgacattctgggcctcagcaagaaccggatcgatgagattcttaattccaaacttgacctggataagatcgcgaaatga

SEQ ID NO: 4074 - RNA, 3822 nt, synthetic construct
  misc_feature 1..3822: note = Cas9 variant
  source 1..3822: mol_type = other RNA
atgaagaaaatcctgggcctcgacctggggaccaacagcattggatgggcccttatcgaggtggatgaaaataacttccccattagaatcattgctatgggctcccggatcatccctctgtctagcaatgacaaggatgagtttcagcgcgggctctccattacaaagaaccaatctagaacggtcagccggacccagcgcaagggatacgacagaaaacagctgaagaagtccgatgacttcaaatattctcttcggcgcatcctgaataagtacaacatttttccgagcgaggagctcctgaaactgcccatgctcgatctgtggaaacttagatccgacgccgttaatcctaacgaaaatatcagcgcggagcagctgggccggattctctatatgctgaaccaaaaacgcgggtacaagtctgctagatccgaggccaatgccgataagaaagacacagattatgtgcttgctgtgaagggacggtacgcccagctgaaagaccgcaaccagaccatcggccagtatttctacgaggaactccacaatgctaagacaaccaacagctactttagaacaaaagaagaggtctatccccgggaggcctacattgaagagttcgataccatcatcaatgcgcaaaagtctaaacatgactttctgacggacgaagtggttcaccagctgcgcaacgagattatctatttccagagaaagctcaagtcccagaaaggcctggtgagcatttgcgaatttgaggggttcgagaagaccatctttgataaagaaaaggacaaaaacaaggtcgtgttcgttggacctaaggtggcccccaaaacatctcctctttttcaactgtgtcggatttgggaggtcgtgaataccatcacactcaagatcaaaaacccggaaggctccaagtacaaatggggagagaagattcccaatatcaaggaaaaagaggctctggccgattatcttttcaagaacgagaccctgagcttcaataaactcctggacattctggaactcaagaaagagaacgtgtacgtcaataagcagatcattaaggggatcaaaggcaacgaaacgtattccgctctgcatagaatccttggggataatgagctgctcaagtttgacgtttctattatccctagcaaccacacatccatgctggtggataaaaagaccggagaaattcttgaggagcgcgccggcctggaactcgacgtgagcctggagaaagaacccctgtaccagctctggcatacaatctactctattaaggatctggacgagtgcaaaaatgcgcttatcaagcggttcggctttgatgacgagattgccgaaaagctgtcccacctcgacttcaacaaacaggcttttgggaataagagcaacaaatctatgagaaagatcctgcctttcctgatggagggatataattacagccagtcctgtacccttgccggctataaccactctaacagcctcaccaaagatgaacgcgagcagcaggtcacactggacaagctggaactcctgcccaaaaattcccttcggcaaccgatcgtggagaagattctgaaccagatgatcaatgttgtgaacgctattctcgaggaatacgggaagcctagcgagatcagaattgaactggcccgcgagctgaaacagtctaaggatgaacggcatgacgccgatcttcaaaattccaaaaacaagaagctcaatgaggagatcggaaaaagactgacggaactgggcctccccgtcaccaagcgctatatccaaaaatacaagtttattttccctagcctgtctaaatcccttaaggacgctcaggtgaacaatcagtgcatctattgtggggagacatttaacctgaccgaagcgctcagcggagatgcctacgacgttgatcacattgtgcccaagtccctgctgttcgacgattctcagacaaataaagtccttgtgcatcggaagtgcaacagcaccaaaacgaatcaaacagcttacgactatatcgcctccaagggcgaggaagaggtccagatttactctgccagagtggatgactggtttaaacgcggcatcatcagctattccaagatgcagcggctcaaagttagccacaaggagtacctggaaagaaagtctctgaacaaagagaccgaaaccgacaagaaactctgggagaatttcattgatcggcagctgcgcgacacacaatatatctccagaaagagcaaagagattcttcagaaggtgtgtaacaacgtcaccacaacggaagggggagtgaccgctaagctgcgggatctctggggctgggacgatatcctgatgaatctgcagatgcccaaatacaaggagcttagacaaacagttattaaagaatggacctctgagcacgggaagcgcaaacatcagaaggaagagatcgagaactggacaaagcgggacgatcacagacatcacgccatcgacgcgctcgtgattgcttgcaccaaacagggatttatccagcgcattaatacgctgaactccagcgaaaccaaggatctgatgcaacaggagatcaatgaagccaaaaagctcctgggcgagaactataaagacaaggagttcgaaaattctaacgaacttgtcaagaatcataaagggagactgagcaagctcgatgactacctgcggctgcagaaacctattaagttcaacacaaaatacgtggaaaaggaggccgataagatccttatttcctttaaagctggcaagaaagtggccaccatcacaaagttcaaagctaccggaaagaataaagacacgggcgttatcgtcccgcgcggggccctgcacgaagcgggactctatggcgtgagaacaatttacagcaaagggggaatcgccgagaagcacattatcaagaagtataaagtgggcgtctctgctcaggaccatatttttaccgggaaggaatcctacagcgtgaaaaaggataagaacggcaatgagaaagttgacgataagatcaaagtggtcctggactccatcgtggattctaaggttaaagagattgtgctcaaccggctgaatttcggatttagcgacggcgaagattataagaacaacgtcaagaaagcccttaataacttcaagaatctggacgagtaccccctctggtataacgaaaataaagggatcaagattctgtccatcaaactgaagacaggacttaaggattctgtggttcctctgcgcctcaacgagagcaatgaggtgattaccctggtcaaaaccggcaacaatcaccatatcgctatctacgaagacaagaactccaaacccgtgcaacactcttgtacattttggcacgccgtggagagaaagaaatacaatattcctgcggtcatcaagaaaagctccgatgtttggaaccagctcctggacaaggaacttcccgagagcttcctgaataacctcccggaagacaatctgaacctgaagttttctatgcagcagaatgagatgttcgtgcttgggctgtcccaagaggaatttaaagaggccattgaaaacaacgataagagcctcctgtctaaatatctctacctggtgtggtccgtcagcgagaataactattggttccggcatcaccttgaaacgaaaaattctgacctgaagaagaccgagggagctaaggagtccaaacgcctgtacaacatcagaagcgtgtccagcctcttttctctgaatcctgttaaggtgcggcttaaccatctgggcgaaattacaaaaatcggggagtattga

SEQ ID NO: 4075 - RNA, 3825 nt, synthetic construct
  misc_feature 1..3825: note = Cas9 variant
  source 1..3825: mol_type = other RNA
atgaccaagcacatcctgggcctcgacctggggacaaacagcattggatgggccatcattcaggtggataataacaataacgtccccatccaaattatcgctatgggctccagaatcattcctcttgactctaatgatcgggaccagttccagaaagggcaggccatcagcaagaacaaagatcgcacgaccgcgagaacacaacggaagggatacgaccgcaaacagctgaagaagtccgatgactttaaatattctctcaagaaaattctggagaaacttgatatcttcccgaccgaggaactgatgaaactccccacactggacctgtggaagctcagaagcgatgctgtttccaatattgaagacatcacccctaagcagctgggccggattctttacatgctgaaccagaaacgcgggtataagtctgccagaagcgaggccaatgctgataaaaaggacacagactacgtggccgaagtgaaaggacggtatacccaactcaaggataaaggccagacgctgggccagtacttttataaggagctttccgacgctaaccagaataacacctactaccgcgtcaaggagaaagtgtatcccagagaagcctacatcgaggagttcgatgcgatcattaatgttcaaaagagcaaacattcttttctgacagacgaagtgatccactccctccggaacgagattatctattaccagcgcaagctgaaaagccagaaggggctggtctctatttgcgagttcgaaggatttgaaaccacatatttcgataagaaaacccaacaggacaagacgatctttacaggccctaaagtggcccccagaacctcccctctcttccagttttgtaagatctgggaggttgtgaataacattagcctgaaaacaaagaacccggaagggtctaagtacaaatggtccgatcggatccccaccattgaggagaagcagaccatcgctaattatcttcaagaaaacgagaatctgagcttcattgaactcctgaaaatccttcagctgaagaaagagcaggtctacgccaacaagcagatcctcaagggcattcaaggaaatacaacgttttccgctatccataaaattatcgggaactctgaacacctgaagttcgacattgagaccatccctagcaaacatttcgccgtgctggtggataagaaaacaggagagattctcgacgaacgcgattccctggagcttaatagcgcgctggaacaggagcccttttaccagctctggcacaccatctattctatcaaggacctggacgaatgcaaaaaggcccttattaagagattcaactttgaggaggaaatcgctgagaaactgtccaagattgatttcaataaacaggcctttggcaacaagagcaataaagctatgcggaagatgctcccttacctgatgctgggctataaccaatctgaagccgagagcttcgccgggtacaatagacgcctcacaaaggaggaaaaatccaagaacgtctctgacgagcccctgcagcttctggctaaaaatagcctccggcagccggttgtggaaaagatcctgaaccagatgattaacgtggtcaatgcgatcatcgagaaatatggaaagcctgaagagattagagtggagctggcccgcgaacttaagcaatccaaagatgagcgggaagacgctgataagcagaacggctttaataaaaagctcaacgagctggttgccaccaaactgacggaactcgggctgcccacaaccaagcactacatccagaagtataaattcatttttcctgccaaggacaaaaattggaaggaggctcaagtggccaaccagtgtatctactgcggagataccttcaatcttacagaggcgctgagcggcgacaactttgatgtcgaccatattgtgcccaaagctctcctgttcgatgactctcaggccaataaggttctggtgcacagatcctgtaacagcaccaaaacaaataacacggcctacgattatatcaccaagaaggggtctcaggctcttaatgactacgtcgcccgcgtggacgattggtttaaacggggaatcatttcctatggcaagatgcaaagactcaaagtcagcttcgaagagtaccaggaacgcaagaaaatcggcaaggagacagaagctgacaagcggatttgggagaacttcatcgatagacagctgcgcgagaccgcctatattgcgaaaaaggccaaagaaatcctggagaaggtgtgccataatgttacatccaccgaagggaacgtgacggctaaactccggcagctgtggggatgggacaacgtccttatgaatctgcaactccccaagtacaaggagctggagaaaaagaccaaacagacatttacccagctgaaggaatggacatctgatcacggcaacagaaaacaccagaaggaggaaatcattaattggaccaagcgggacgatcatcgccaccatgccatcgacgctcttgtgattgcctgtacgcaacaggggttcatccagagaattaacacactcagctcctctgatgttaaagacgagatgaagaaagaactggaggaggataagaccgtgtataatgaacggctgacactcctggagaactaccttctggaaaagaagccttttagcaccgaggaaatcgagaaggaggcggacaaaattctcgtctccttcaaggccggcaaaaaggtggctaccctgagcaaatacaaggccacaggaatcaatgaaatcaaaggggtgctggttccgagaggcccccttcacgagcaatctgtctatggaaagattaaggtgatcgaaaaagataagcctctcaaatacctgtttgagaactccgacaagattgtgaatcccctgatcaaacatctcgtcaagacgcgcctgcttgaaaacgagaataacgctcaggccgccctggtgaccctcaagaataaacctattctgctgaacaataagcagacagagatccttgaaaaagctagctgctataacgaggcgaccgttctgaagtacaaactccagtctctgaaggcctcccaaatcgacgatattgtggacgaaaagatcaaattcctcattaaggagcggctgagcaaatttggcaacaaggagaaagaggctttcaaggatatcctttggtttaatgaaaagaaacagattcccatcacatctatcagactgttcgcccgcccggacgccaacaatctccaggtcattaagaaacacgaaaaggggaaaaacatcggatttgtgctgagcggcaataaccaccatattgctatctatgaggataagaataacaaactgattcagcacatctgtgacttctggcatgccgttgaaagaaagcggaataacattcctgtgcttatcgaggatacctccacgatctggaatcacctgattaacgaggactttagcgaatctttcctcaataagctgcccaacgattccctcaaactgaagttcagccttcaacagaatgagatgtttatcctggggctccctaaagaacagtccgaggaagcgattaagtctaacaataaaagcctgctgtccaagcacctttacctggtctggtctatcacagacggagattatttctttcgccatcacctcgagaccaagaacaccgagctgaaaaagattgacggcagcaaagaatccaagagatacctccggctgtctacaaaaagccttgtggacctgaaccccatcaaggttcgcctgaatcatctcggggagatcaccaagattggcgaatga

SEQ ID NO: 4076 - RNA, 3846 nt, synthetic construct
  misc_feature 1..3846: note = Cas9 variant
  source 1..3846: mol_type = other RNA
atggaggacgatagccagcacgacatcagagaaatttacctggccatccatcacatggtgaagtatcggggcaacttcctcgtcgaggggaccctggaatcctctaatgcttttaaagaggatgaacttctgaagctcctgggacgcattacaagatacgagatgagcgagggcgaacaaaactccgacatcgagcaggatgacgaaaataaacttgttgcccccgcgaacgggcagctggctgatgccctctgcgccacgcggggatctcgcagcatgagagtggacaatgctctggaggccctgtccgctgtgaacgatctctctcgggagcagcgcgccattgtcaaggcgatcttcgccggcctggaagggaataaacttgacctggctaagatctttgtgagcaaggagttctccagcgaaaacaaaaagattctcggaatctattttaataaatctgattacgaggaaaagtgtgttcaaattgtggactccggcctgcttgatgacgaggagagagagttcctggaccggatgcagggccagtataacgccatcgctctcaaacagctgctggggcgcagcacctctgtctccgatagcaagtgcgcctcttacgacgcgcatagagccaattggaacctcattaagctgcaacttcggacaaaagagaatgaaaaggatatcaacgagaattatggcattctggtgggatggaaaatcgactccgggcagcgcaagagcgttagaggagaatccgcttacgagaacatgcggaaaaaggccaacgtgtttttcaaaaagatgatcgagacctctgatctcagcgaaacagacaagaatcgcctgattcacgatatcgaggaagacaaactttttcctattcagagagattccgacaacggcgtcatcccgcatcagctgcaccaaaatgagctcaagcagattatcaaaaagcaggggaaatactatcccttcctgctggatgcttttgaaaaggacggaaagcaaatcaacaaaattgagggcctcctggccttccgggtgccttactttgtgggcccccttgtcgttcctgaggacctgcagaaaagcgataattctgaaaaccactggatggtgagaaagaagaaaggggagatcaccccctggaatttcgacgaaatggtggataaggacgcctccggacgcaagttcattgagcggctcgtcggcacagatagctatctgcttggggagcctaccctgccgaaaaactctctcctgtaccaggaatatgaggtgctgaatgaactcaacaatgttagactgagcgtgcgcacgggaaaccattggaatgacaagcggagaatgcgccttggccgggaggagaaaaccctgctctgtcagagactgtttatgaaggggcaaacagtcaccaaacgcacagctgaaaacctgcttcggaaggagtacggaagaacctatgaactctccggcctgtctgatgagagcaagttcacgtccagcctgtctacatacggcaaaatgtgccgcatctttggggaaaagtacgtgaatgagcaccgggacctcatggagaaaattgttgaactgcagaccgtgttcgaggataaggaaacacttctgcatcagctcagacagctggagggaatctccgaagcggactgtgccctgcttgtcaacacccactataccggctgggggcggctcagccgcaaactgctgacaacgaaggctggagagtgcaaaatctctgatgactttgcccccagaaagcactccattatcgaaattatgcgggccgaggatagaaacctcatggagatcattaccgacaagcaactgggcttcagcgactggatcgaacaggagaatcttggggctgaaaacggctcctctctgatggaggtggtcgatgacctccgcgtgagccctaaagttaagcggggaattatccagtccatcagactgattgatgacatctctaaagccgtgggcaagcgccccagcagaatttttctggagcttgcggatgacatccagccttccgggcggacaattagccgcaaatctagactccaagatctgtaccggaatgctaacctgggaaaggagttcaagggcatcgccgacgaactcaatgcctgttccgataaagacctgcaggatgaccgcctttttctgtattacacccagctcgggaaggatatgtatacaggagaagaactggacctggacagacttagctctgcttacgatatcgaccatattatcccccaggccgtcacccaaaacgattccattgacaatcgggtgctcgttgctcgcgccgaaaacgcgagaaaaacggatagcttcacatatatgccgcagatcgccgaccggatgcgcaatttttggcagattctgctggataacggcctcatctctagagtgaagttcgagcggctgaccagacaaaatgagtttagcgaacgcgagaaagaacggttcgtccagagatcccttgtggagacccgccagatcatgaagaacgtggctacactgatgcggcagagatacgggaatagcgccgctgttattggcctcaacgccgaactgaccaaggagatgcaccgctacctgggattctctcataaaaatcgggacatcaacgattatcaccatgcgcaagacgccctttgcgtcggcattgctgggcagtttgccgctaacagaggattctttgccgatggcgaggtgtccgacggggcccagaatagctacaaccagtatctgcgcgactacctccggggatatagagaaaagctgtccgctgaggatcggaaacaaggccgcgcgttcgggtttatcgtgggctctatgagaagccaggacgaacagaagcgggtcaatcctcgcacaggagaggtggtttggtccgaagaggataaagactacctcagaaaggtgatgaactatcggaagatgctggtcacgcagaaagtgggcgatgacttcggggccctttacgatgagaccagatacgctgccacagaccccaagggaattaaaggcatcccttttgatggggccaagcaagacacctctctgtatggaggcttcagctccgctaaacccgcctacgcggttctcatcgaatctaaggggaaaacacgcctggtgaatgtcaccatgcaggagtatagcctgcttggcgatcggccctccgacgatgaactgagaaaggtgctcgctaagaaaaagagcgagtacgccaaagccaacattctgctccgccacgttcctaagatgcagctgatccggtatggaggcgggcttatggtgattaaatctgctggagagctgaataacgcccaacagctctggctgccgtacgaagagtattgttactttgacgacctgtcccagggcaaggggagccttgaaaaggatgacctgaaaaagctcctggattctatcctcggatccgtccagtgcctgtacccctggcacagattcacggaggaggaacttgcggacctgcatgtggcttttgataaactgcctgaggacgaaaagaaaaatgtgattaccggcatcgtcagcgccctccacgccgatgctaagacagccaacctgtctattgttggcatgaccgggtcctggcgccggatgaataacaagagcggatatacattctccgacgaggatgaatttatcttccaaagcccctctggccttttcgagaaaagagtgaccgtgggggaactgaagcgcaaagctaagaaagaggtcaatagcaagtacagaacgaacgagaagcggctccctacactgtccggagcctctcagccctga

SEQ ID NO: 4077 - RNA, 3861 nt, synthetic construct
  misc_feature 1..3861: note = Cas9 variant
  source 1..3861: mol_type = other RNA
atgaccaagaacatcctgggcctcgacctggggacaaatagcattggatgggcccttatcgaggtggatgaaaacaatacgcccattagaatcattgctatgggctcccggatcatccctctgtctaccagcgacaaagaggagttccagcgcgggctctccattacaaagaaccaatctagaaccgtcagccggacacagcgcaaaggatacgatagaaagcagctgaaaaagtccgaccttaagaaaatcctgaataagtataacatttttccgtctgaggaactcctgaaactgcccatgctcgatctgtggaaacttcggagcgactccgccaatcctaacgagaatatcagcgcggagcagctgggccgcattctctacatgctgaaccaaaagagagggtataagtctgctcggtccgaagccaatgccgataagaaagacaccgattacgttcaggctgtgaagggacgctatgcccagcttaaagagagaaaccagacaatcggccaatacttctatgaggaactgtacaatgctaacaccaataacagctactttcggattaaggaggaagtgtatccccgcgaggcctacacggaagagttcgacaccatcatcaacgcgcagaaaaataagcacgattttctcacagacgaagtcgtgcatcagctgagaaacgagattatctatttccagcggaaactgaagtctcaaaagggcctcgtttccatttgcgagtttgaagggttcgagaaaaccgtgtttgataaggaaaagaataaggacaaagtcgtgttcgttggaagcaaggtggcccctaagacatctcccctgtttcagctttgtcgcatctgggaggtcgtgaacaccatttccctgaaaatcaagaatcctgaaggcagcaaatacaagtggggagagaaaacgccgaacctcaaggagaaggaaatcctggctgactatcttttcaaaaatgattccctgtcttttacaaagctcctggagattctggacctcaacaaaaatgatgtgtacgtcaacaagcagatcctgaaagggattaagggcaatgaaaccttcagcgcccttcacacagttctgggggacaacgagctcctgaatttcgatgtgtccatcattcccagcaaccatacctctatgcttgtggacaagaaaaccggagaaatcctggaggagagagctggcctcgaactggatgcctccctggagaaggaacctctctatcaactgtggcacacaatctacagccttaaagtcctggacgagtgcaagaatgcgctcattaaacggtttggcttcgatgacgagacggccgaaaagctgtctcatatcgattttaacaaacaggctttcgggaacaagagcaataagtccatgagaaaaattctgccctttcttatggagggatacgactattctcagagctgttccctcgccggctacaaccacagcaattctctgaccaaggacgaacgcgagcagcaaatcacactggatcggctcgaactgctttccaaaaacagcctgagacagcctattgtggagaagatcctcaatcagatgattaacgttgtgaatgctatcctggagcagtatgggaaactgtctgaaatccgcgtcgagcttgcccgggaactcaagcaatccaaggacgagagaaacgatgccgacctgcagaatagcaaaaacaagaaactgaatgaagagattggaaagcgcctcgctgagctgggccttcccgtgaccaaacggtacatccagaagtataagttcatttttccgtccctgtctaaaaacctcaaggatgcgcacgttaataaccagtgcatctactgtggggaaacattcaatctgaccgaggccctgagcggagacgcttttgatgtggaccatattgtccctaaagcccttctcttcgatgactcccaaacgaacaaggtgctggtccacagaaaatgcaactctacaaagaccaatcagaccgcctatgattacatcggcacaaagggcgaagaacaggtgcgcatctacagcgaacgggttgacgattggtttaaaagagggattatctcctatagcaagatgcagcgcctgaaagtgtctcataaggagtacctcgagcggaaaaagctgggaaaagaaaccgagacagacaagaaactttgggaaaacttcattgacagacaactgcgggatacgcagtatatctcccgcaaagctagagagattctccagaaggtctgtaataacgtgaccacaaccgagggcgggatcacagccaaactgcggaatctgtggggatgggacgatgttcttatgaacctccaaatgcccaagtacaaagaactgggccagaccgtgatcaaggagtggacgagcgaacacgggaagagaaaacaccagaaggaggaaattgagaattggaccaaacgcgacgatcatcggcaccatgcgatcgacgctctggtcgtggcctgcacaaagcagggctttattcaaagaatcaacaccctcaattcttccgatacaaaagacctgatgcagcgcgagattaaggaagccaagaaacttctgggagagaactataatgaaaaggagttcgaaaacgataatgagttcgtgaaaaaccacaaggagagactcagccagctggacgattacctgcggcttcagaaacctgttaagtttgacaccaagtatgtcgaacaagaggctgataaagtgctggtgtctttcaaggccggcaaaaaggtcgctacgatcacaaaatttaaggccaccgggaagaataaagacacaggagtgatcgttctccgcggcgcgctgcatgaacagagcgtgtacgggaagattaaagtcatcgagaaggacaaacccctcaagtacctgttcgaaaactccaaaaagattgtgaaccccaagatcaaagttcttgtggaggagagactggccgaaaatgagaacaatagcaagctctctctgtccaccctgaaaaagaaccctatttttcttaatgaagagaaaaccgagatcctggaaaaggctagctgttataacgatgccacagtcctcaagtacaaactgcagtccctcaaggcttctcaggccgacgatattgtggacgatcgggttaaattcctggtgaaggagcgccttgcgcaatttggaaataaagaaaaggaggccttcaaggacacgctgtggctcaacgaagagaaacagatcccgatcattaccgtcagactgtttgctcggcccgatgccaataacctgcaggctatcaagaaagacaagaatggccgcgatattgggttcgtgcttacaggcaacaatcaccacatcgccatttatgaggacaaagataacaagctggtgcaacatagctgcaccttttggcacgccgtcgaaagaaagaaaaataacgttcctgctgtgatcaaaaattcctctgacgtgtggaaccagctcctggacaaggagctccccgagagcttcctgaacaaacttcctatcgataagctgaagctgaaattttccctccagcagaatgaaatgttcgtcctgggacttctgcaagaagacttcgaggcggccattgagaacaatgataagacactcctgtctaagcatctctacctggtgtggagcatcaccgacggcgattactttttccggcaccaccttgaaacgaaaaacacagagctgaagaaaaccgaaggggctaaggagtccaaacgctattttagactgagcaccaagggactcattgacctgaatcccgttaaggtgcggcttaaccatctgggcgaaatcacaaaaattggggagtattga

SEQ ID NO: 4078 - RNA, 3864 nt, synthetic construct
  misc_feature 1..3864: note = Cas9 variant
  source 1..3864: mol_type = other RNA
atgaagaccgtgctgggcctcgacctggggacaaacagcatcggatgggcccttattgagctggatgaaaataacatccccattagaatcgtcgctatgggctcccggattatccctctctctacgagcgacaaagaggagttccagcgcgggctgtccatcaccaagaatcaatctagaacagttagccggacccagcgcaaaggatacgatagaaagcagcttaaaaagtcctatctgaagaaaattctcaacaagtacaatatctttccgtctgacgaactgctgaaactccccatgctggatctttggaagctgcggagcgactccgccaaccctaatgaaaacattagcgcggagcagctcggccgcatcctgtatatgcttaatcagaaaagagggtacaagtctgctcggtccgaggccaacgccgataagaaagacacagattatattcaagctgtgaagggacgctacgcccagctgaaagacagaaatcagaccatcggccaatatttctacggcgaactcaacgatgctaatgagaacaatagctactttcggattaaggaagaggtgtatccccgcgaggcctacacagaagagttcgacaccatcatcaacgcgcagaaagataagcacgactttctgacggacgaagtcattcatcagctgagaaacgagatcatttatttccagcggaaactcaagtctcaaaaggggctggtgtccatctgcgaatttgagggattcgagaaaaccgtttttgataaggagaaaaataaggacaaagtggtcttcgtgggccctaaggttgcccccaagacaagccctctttttcagctgtgtcgcatttgggaagtggtcaacaccatcacactcaaaatcaagaatccggaagggtctaaatacaagtggggagagaaaattcccgatgtgaaggaaaaggagatcctggctgactatcttttcaaaaacgagtccctgagctttaccaagctcctggaaattctgaaactcaataagaacaatgtgtacttcaacaaacagatcctgaagggcattaaggggaatgagacgtattccatccttcactctatcctgggagatagcgaactcctgaacttcgacgtctccattatccctagcaatcatacatctatgcttattgataaaaagaccggcgagatcctggaagagagagccggcctcgagctggacacatccctggaaaaagagcccctcaaccaactgtggcacaccatttacagcatcaaggatcttgacgaatgcaaatctgctctgattaagcggtttgggttcgatgacgagaccgccgacaaactcagcagaatcgattttaataagcaggcgttcggaaacaagtccaataaatctatgcgcaagatcctgccttttctgatggagggctacgactatagccagtcctgtagccttgccgggtacaaccattctaactccttcacaaaagatgaacgggagcagcaaattacgctcgacaagctggaactgctccccaaaaatagcctgagacagccgatcgttgagaagattcttaaccagatgatcaatgtggtgaacgctattctggaacgctatggaaagccttctgagatccgggtcgagctcgccagagaactgaaacagtccaaggatgagcgcaatgacaccgatctgcaaaacagcaaaaataagaaacttaacgaagagatcggcaagcggctcgctgaactggggctgcccctcacaaagagatacattcagaaatataagtttatcttcccttccctgtctaaaaatcttaaggacgcccacgtgaacaatcagtgcatttactgtggagagacctttaacctgacagaggccctcagcggcgatgctttcgacgttgatcacatcgtgcccaaagcgctgctgtttgacgattcccagaccaataaggtccttgtgcatcgcaagtgcaactctacgaaaacaaatcaaaccgcctatgactacattgctaccaagggcgacgaacaggttcgggtgtacagcgagagagtcgatgactggttcaaacgcgggatcatctcctatagcaagatgcagcggctcaaagtgtctcacaaggaatacctggagcggaaaaagctgggaaaggaaacagagaccgataaaaagctctgggagaactttattgacagacagctgcgcgatacacaatatatctccagaaaaagccgggaaattcttcagaaggtctgtaacaatgtggccacgaccgagggcggggttacagccaaactgagaaacctctggggatgggacgatgtgctgatgaatctgcagatgcccaagtacaaggaacttggccaaaccgtcgtgaaagagtggacatctgagcatgggaagcgcaaacaccagaaggaagagatcgaaaactggaccaaacgggacgatcacagacatcacgctattgacgccctcgttgtggcgtgcacgaagcagggcttcatccagcgcatcaataccctgaactccagcgagacaaaggatctgatgcaacaggaaattaaagaggctaagaaactcctgggagagaattataacgaaaaggagttcgaaaataacaatgagtctgtcaaaaaccataaggaaagacttagccagctggacgattacctccggctgcagaagcctgtgaaatttgacaccaagtatgtggagcaagaggccgacaaagttctggtctccttcaagagcggcaaaaaggtggccacaatcaccaagtttaaagctacggggaagaataaagatacaggagtgattgtcccgcgcggcgcccttcacgaacagaacgtgtacgggaagatcaaagttattgagaaggacaaatctctgaagtacctcttcgaaaattccgagaagatcgtgaaccccaaaattaagaacatcgtcgaaatcattctgagcgagaatgagaacaattccaaaatggctctctctaccctgaagaaaaaccctatctttcttaatgaagagaagacagatctgctcgaaaaggccagctgttatgagtacgtgaccgttagaaaatatcccctgaacaccattaaggcgtcccaggccgacgatatcgtggacgagcgggtcaaattcctggtgaaggaacgccttacacagtttggaaataaagagaaggaggctttcaaggatacgctgtggtttaacgaagaaaaacaaattcctatcatcaccgttagactcttcgcccggcccgacgctaataacctgcaggccattaagaaagatgagtctggcaaggagatcgggtttgtggtcatgggcaataaccatcacattgcgatctacgaagacaaagatggaaagctcgtgcagcacagctgcacattctggcatgccgtggagcgcaagaaatataatatttccaccgtcatcaagaactctagcgacgcttggaatcaatttctggacaacgaacttccggagcctttcctgaataaactccccgccgataacctgaacctgaagttctcccttcagcagaatgaaatgtttatcctgggcctcagccaggaggagttcgacaaagctctgaagtctaacgataaatccctcctgagcaagcacctttacctggtttggtctatttccgaaaataactattggtttagacatcacctggagacaaagaatagcgacctcaaaaagaccaacggggtgaaagaatctaagcggctgtacaatatccgctcccttggaagcctgttctccctcaaccctattaaaatcagactgaatcacctcggcgagattacgaagatcggggaatacagctga

SEQ ID NO: 4079 - RNA, 3867 nt, synthetic construct
  misc_feature 1..3867: note = Cas9 variant
  source 1..3867: mol_type = other RNA
atgagactgttcgaggaaggccacaccgccgaggaccggcgcctcaagagaacagctcggcgcagaatcagccggcgcagaaaccggctgcgctaccttcaggcctttttcgaagaggcgatgacggatctggacgaaaatttcttcgctagactccaagagtcctttctggtgcccgaggataaaaagtggcatcggcaccctattttcgccaaacttgaagacgaggtcgcctatcatgaaacctacccgacaatctatcatctgcgcaagaaactcgctgattctagcgagcaggccgacctgagactgatttacctcgctctggcccacatcgttaagtatcgggggcactttcttattgagggaaagctgtccaccgaaaacacatctgtgaaagatcagttccagcaatttatggtgatctacaatcagaccttcgtcaacggcgagagccgcctcgtgtccgcgcccctgcctgaatctgttcttatcgaggaagaactgacagagaaggccagcagaaccaaaaagtccgaaaaagtgctccagcagtttccccaagagaaggctaatgggctgttcggacagtttctgaagctcatggtcggcaacaaagccgacttcaagaaagtgttcgggctggaagaggaagctaagattacgtatgccagcgagtcttacgaggaagatcttgagggaatcctggcgaaagttggcgacgaatactccgatgtgtttctcgccgctaagaatgtctatgacgccgtggagctgagcaccattcttgctgattctgacaaaaagtcccacgccaagctgtctagctccatgatcgtgcggttcacagaacatcaggaggacctcaaaaagtttaaaagattcattcgcgagaactgccctgatgaatacgacaatctgtttaagaacgagcagaaagatggctatgccgggtacatcgctcacgcgggaaaggtcagccaactgaagttctatcagtacgttaaaaagattatccaggacatcgccggcgctgaatattttctcgagaaaattgcccaagagaatttcctgcggaagcagagaacctttgataacggggtgatcccccatcagattcaccttgccgaactgcaggctatcattcaccgccaagccgcgtactaccctttcctcaaagagaatcaggaaaagatcgagcagctggtgacatttcggatcccgtattacgtcggacccctttccaagggcgacgcttctaccttcgcctggctgaaaagacagagcgaggagcctattcgcccctggaacctccaagagacggtggatctggaccagtccgccacagcttttatcgaacggatgaccaatttcgatacatatctgcctagcgagaaggttctccccaaacattctctgctttacgaaaagttcatggtgtttaacgagctgaccaaaatttcctataccgacgatagagggatcaaggccaacttcagcggaaaggaaaaagagaagatttttgactacctcttcaaaacacgccggaaggtcaaaaagaaagacatcatccagttttatagaaatgagtacaacacggaaattgtgaccctgtctggcctggaggaagatcagttcaatgctagcttttccacataccaagaccttctcaagtgtggcctgacccgcgccgagctggatcacccggacaacgcggaaaagctcgaggatatcattaaaatcctgacaattttcgaggaccggcagagaatccggacccagctttctacgtttaaggggcagttcagcgccgaagttctgaaaaagctcgagcgcaaacattatacaggatggggcagactgtccaagaagctgattaatgggatctacgataaagaaagcggaaagaccatccttgactatctcgtgaaagatgacggcgtctctaagcactacaaccggaattttatgcaactgattaacgattcccagctgagcttcaaaaatgctatccagaaggcccaatcttccgagcatgaggaaaccctcagcgagacagtgaacgaactggctgggtcccctgccattaagaaaggaatctatcagtctcttaagattgtcgacgagctggtggcgatcatgggctacgcccccaaaagaatcgttgtggaaatggctcgcgagaatcagaccacaagcacgggcaagcggagatccattcagcgcctcaaaatcgtcgagaaggccatggctgaaattgggtctaacctgctgaaggagcaacctaccacaaatgaacagcttagagatacccggctctttctgtattacatgcagaacggaaaagacatgtacacaggcgacgagctgagcctccaccgcctgtcccactatgatatcgaccatattatcccccagagcttcatgaaggatgactctcttgataatctggtgctcgttgggtccaccgaaaacagaggaaaaagcgacgatgtgccctctaaggaggtcgtgaaagacatgaaggcctactgggagaaactgtatgccgctggcctgatctcccaacggaagttccagcgccttacgaagggggaacagggcggactcaccctggaggataaagcgcactttattcagagacaactggtggaaacacggcagatcaccaagaacgttgccggcattctcgaccagcgctacaatgctaaaagcaaggagaaaaaggtccaaatcattacactgaaggcctctcttaccagccagttcagatccatctttgggctgtataaagtgcgggaagtgaacgattaccatcacggacaggacgcctatctcaattgcgtcgtggctacgacactgctgaaggtttaccctaaccttgccccggagttcgtgtacggcgagtatcccaaatttcagaccttcaaggaaaataaagcgacagctaaggccatcatttacaccaacctgctccgctttttcaccgaggatgaacctagatttacaaaggacggggagatcctgtggagcaattcttatctcaaaacgattaagaaagagctgaactaccaccaaatgaatatcgtcaagaaagtggaagttcagaagggaggcttctccaaggagagcattaaacccaaggggccttccaacaaacttatccccgtgaagaatggcctggacccgcagaaatatggaggctttgattctcctgtcgtggcctacaccgttctcttcacacatgaaaaggggaagaaacccctgattaagcaggagatcctgggaatcaccattatggagaaaacacggttcgaacaaaaccctatcctttttctggaggaaaagggcttcctcagaccccgcgtgctgatgaaactccctaagtataccctgtacgagtttcccgaagggcggagacgccttctggctagcgccaaagaggcgcagaagggaaatcagatggtcctcccggaacatctgctgacgcttctgtaccacgctaagcagtgtctcctgcctaaccaatccgagtctctcgcctatgtggagcagcaccagcccgaatttcaggagattctggaacgggtggtcgactttgccgaggttcatacacttgctaaaagcaaggtgcaacagatcgtgaaactgttcgaagccaatcagaccgctgatgtcaaggagattgccgcgtcctttatccaactgatgcagttcaacgccatgggcgctccctctacctttaaattctttcagaaggacatcgagagagcccgctacacaagcattaaggaaatcttcgatgctaccattatctatcagtcccctacagggctctacgagacgcggagaaaagtggttgactga

SEQ ID NO: 4080 - RNA, 3903 nt, synthetic construct
  misc_feature 1..3903: note = Cas9 variant
  source 1..3903: mol_type = other RNA
atgtggggcgtgagcctgttcgaggccgggaagaccgctgccgaaagacggggataccgctccacaagacggcgcctcaaccacagaaaatttcggctgcgccttctggaggacatgttcgaaaaggagatcctctctaaagatcccagctttttcattagactgaaggaagcgtttctttcccctaaagacgagcagaagcaattcaagggcaatatcctgtttaacgataaagactatacggatgctgactactatgagcagtacaagaccatttatcatctccggtacgatctgatctctcagcaccgccagttcgacattagagaagtctatctggccatccatcacctcatcaaataccgggggcattttatttacgaggatcaaacattcaccacagacggaaatcagctgcagcaccacatcaaggccattatcaccatgattaacagcacacttaatcgcatcattatcccggaaaccatcgatattaacgtttttgagaaaatcctgctcgacagaatgatgaatcggtcctctaaggtgaagttcctgattgagcttacgggcgaagataaacaggacaagcccctgctcaaagagctgtttaacctgatcgtggggctcaaggctaaacctgccagcattttcgaacaagagaatctggctaccatcgtcgaaacaatgaacatgtccaccgaacaggtgcagcttgacctgctcacactggccgatgttcttgcggacgaggaatatgatctgctcctgaccgcccagaagatctacagcgctattatcctggacgagtctatggatggatatgaatacttcgccgaggctaaaaaggaatcctatcgcaagcatcaagaggagctcgtgctggtcaaaaagatgcttaaaagcaatgccattacgaacgacgaaagagcgaagtttgagtacttctatacagattacatcggcgccaaatcttccaattacgaagagagcaagaacattaagaaaggcctgtctgctgcctatgggaagtactccaaagaagagagactctttaagcacatcgagctgcttctggctaaagaaaatgtgctcaccacagttgagcatgccctgctggaaaagaacatcaccttcgccagcctcctgccccttcagagatcctctcgcaacgctgtgattccttatcaggtccacgagaaggagctggtggcgatcctcgaaaatcaagccacctactatccctttctgctggagcagaaagacaacattcacaaacttctcacattccggatcccttactatgtgggaccgctggctgatcagaaggacagcgaatttgcctggatggtcagaaagcaggccggcaaaattacgcccttcaattttgaggaaatggttgatatcgacgcttccagcgaggccttcattaagcgcatgaccaacaagtgcacatacctgatccatgaggacgtgatccctaaacactctttttcctacgcgaagttcgaagtgctcaatgagctgaacaaaattcggcttgatgggaagcccatcgacattcctctgaaaaagagaatctttgaaggactcttcctggagaaaaccaaggtcacacaaaccagcctgaagaaatggcttgctgaacatgagcacatgacggtgtctgttgtgcagggcacacagaaggagaccgagttcgccaccagcctccaggcctttcatcgcttcgtcaaaatttttgatcgggagacagtgtccaatcccgctaacgaagagatgttcgaaaagatcatctattggtctaccgtttttgaggacaaaaagattatgagacgcaagctgagcgagtacccgcaactgacagaacagcaacaggtgcagctcgcccaggtccggttcagagggtggggacgcctgtcccagcggcttatcaatagaattaaaacgcctgtgagcggcgatgaggaccacaagctgtctatcaacgaaattctctggcagaccaatgagaactttatgcaaatcatccggaataaagattatctgttcaagaaaattatcgaggaacagtttgagaacgaaacagctctgcttaataagcagcgcattgacgagctcgccgcgtcccccgccaacaagaaaggcatctggcaagctattaagatcgtcaaagaactggagaaggtgctgcagcagcctgccgagaacatcttcattgaatttgctagaagcgatgaggaatctaaacggtccacccccagagacaagttcatcgagaaggcctacgcgcagctcaaaaaggaaacagatacctttaatctggagcaccttaaagagctgaagcaacgcagcaaacagctctcctctcagcggctgttcctgtatttcattcagaacgggaagtgtatgtacagcggagaacatcttgacatcgagagactcgattcctatgaagttgaccacattctgccccaatcttacatcaaagacaatagcattgagaacctggccctcgtgaagaaggtcgaaaatcagcgcaaaaaggattccctgcttctgaacagctctatcatcaatcagaactactccagatgggagcagctcaaaaatgctggcctgattggggagaagaaatttcggaacctgacgcgcaccaagatcacagacagagataaggaaggattcattgcccggcaacttgtggagacccgccagatcacaaaacatgttacccagctgctccaacaggaatataaggacacgacaaaagtgtttgctattaaggccaccctggtcagcggcctcagacggaaattcgagtttatcaagaatcgcaacgtgaatgattaccaccacgcccaggacgctttcctggtggcgtttcttgggacaaacatcacctctaattatcctaagattgagatggaatacctgttcaaaggatatcagcattacctcaacgaggttggcaagtccgccgctaaaccgaagtttaccttcatcgtcgaaaacctgagcaaacaacagtataattctacaacgggcgaggtgaagtggaaccccgaagtggatattgccaagctgaaaagaatccttaattttaagcagtgcaacattgtccggaaagtggaggagcagagcggggccctgttcaaggaaaccatctaccctgttgaggaatccagctctaaaacaatccccctcaagaagcacctggacaccgctatttacggaggctatacagccgtgaattacgcgtcctatgctctcatccaattcaaaaaggggcgcaaactgaagagagagattatcggcattcctcttgccgtccagacccggatcgataacagcgaaacgtccctgcaggcctacattgctgagcagatcaaatctgaggtggaaatcctcaatggacggattctgaagtatcaactgatcagcaacaatgggaaccgcctttacattgccggcccctccgagcggcataatgcgagacagctgatcgtttctgacgaagctgccaaagtgatttggctcatcagcacaaagcaggccgatgaggctatgtttctgaagtattaccgcctcgaacacctggaggccgtcttcgaggaacttatccggaaacaggctgccgactaccaaatttttgagaagctgatcaaaaagattgaagtgaacaaagtttatttctactcctgtacctataatgagaaggtgaaggtcatcgaggaactgctcaaaattacccaggcgaacgccacaaatggagatctgaaacttctgaagatgtctaacagagagggccgcctcgggagcgtgtccgtggctctggactttaagatcatcaaccagagcgtcaccggactctaccaatctattgaagactataataactga

SEQ ID NO: 4081 - RNA, 3930 nt, synthetic construct
  misc_feature 1..3930: note = Cas9 variant
  source 1..3930: mol_type = other RNA
atgggcagcgtggggttcgccggaatcgacaaccagtacaatctggtcagaaccaagggcaaaaacgttattggggtgcggctctttgatgaggctgactccgccgcggaacgcagaggacaccggacaaatcgcagacggctgcaacgcagacggtggcgccttagactgctcgatgacatcttcgctaagcccctgcaggccgtggatcctaactttcttgcccggctgaaatattcttacgtcaataagaaagaccagggccagcaagatcattattacgggggatatgtgttcggcagcacggctgccgaccaggcttaccaccaggcctatccgaccatttaccatctccgcaagagactgatggaggatgaccagaagcacgatctgcgggaagtttacctcgcgatccatcacattgtgaaatatcgcggcaactttctgaatccccaatcctctcttgacatcgatcagcagttcgacgtcacagactttgcccaggctctggccagattcgctgatcaccaagccctcagctgggcgctggaggcccctatccggtttcttgaagctgagctggccaccgggctctccaactctgctagagtggacgccgccattgaggctttcagctttgatacaaaggttgaccgcgcggccatcaaagaaatgctgaagggactgtccggcaatcagattgatttcaccaaactctttgtgaacgtcgacagcgctgattgggaccaggaggaacggaagcaatggaagatgaaactgtctgaggaggatttcgacgaacaggcccttcccatcctggagagactctcccaggatgaaacagagttctttctggccattaagcgcgcttacgacgggatcgcccttatgcggttcctgggagacgaacagagcctctcttccgcgatgattaaggcttatgaggatcatagacgcgacctgacctttctgaaaacgcaagtgcggacccctcagaatagacaggccctcagcgagggctacacaaactatctgtctgtggatgacaaaaagcacaaacgcggggccaaggaacttgctcagctgatcgaggcctccgatgctagcgaacaagacaaggccaccatgctcgatcggatcgcgaatgaccagttcgcccccaaacagagaacaaaggctaacggactgattccttaccagcttcatctggccgagctcaaaaagatcctggctaaacaaggccagtattacccgtttctgctcgataccttcgccaagcagggccagtccgtcaataagattgaggagctggttcaatttcgcgtgccctactatgtggggcctatggtccccaaatctgagacggcgggaaacgccgaaaaccactgggtggagaagaatgacggccagacaaaagttagcgtgaccccttggaacttcgatcaggtctttaatcgggacagagctgccaagtccttcatcgatcggcttacagggaccgacacctacctgattggagaacccacactcccgcgccacagcctgacgtatgagacctttacagtgctgaacgaacttaataacatcagaatcgacggcaaacggctccctgttgagaccaagcaagctattgtggaggatctgttcaagaaatacagactggtcacaaagaaacgcctccaggactattttgcctctttcgggaagcgggaagtggagctgaccggacttgccgatgaatccagattcacgagctctctgacaagctaccatgacctccagggcctgctgggcaccgattttatcaccaatccccagaaccactcccttctcgagaaaattgtcgagatccaaacagtgttcgaagactctgatattgctgagcgcgaactggggaagctgggactcgagcagaagctgatccctagacttgcgaaaaagcattataccggctgggggaatctgagccggaaactcctggacacatcctttatccacgatcccgaacgccccgaggagcctgttagcattatggacctgctttacacgaccaacaagaatttcatggaaatcctccatgattctgagtacggagtggaagagtggctgaaatcccagaacatgattgacgatcagaaggacatccaaatgagaattgacgaactgacaaccagcccggccaataaacggggcatcaagcaggcttttaacgtcctcgatgacattacacaggccatgggggaggagcccgcctatgtgtacctggagttcgctcgcgaaaagcaggcctctagacggaccgtttcccgcaaaaagagacttgaaacgctgtataaaaatgcggctctcaagaccgagtttaaagccatcaaggaagccctggctgaggagagcgatgaccggatgcaagatgaccgcctgtacctttattacgcccagctcggcagagatatgtatacaggacagtccatctctattgaccaactgagctcccactacgatatcgaccacattgtgcctcgggcgttcatcaaggatgactctctggaaaacaaagtcctcgtgaacagaaccgacaatgctcgcaagacagatagcgccacctttacggccgacgtgaaagctaaggccttccccctgtggcagcagcttaaaaagctgggcctcatttccgctaagaaatttcggctgctgacaagaaccggggatttcacagagatggaacgcgagcggtttatcgccagacagcttgttgagacccgccaaatcattaagaacgtcgcggccctgatcgaaggacatttcagccagacccaggctgtggccattcgggctgaggtgacaggcgaactcagacagctgacgcaaatcaaaaaggaccgcgatattaatgactaccaccatgcccaggatgccctcctggtcgctaccgcggggacatatcttcaccggcacttccctaaaagagacgcccggtttatctacaacgagttcgattattacacccagcattggctgaagaatcagggagaaaaccgcagacggcacccctattcttttgtggttggcacaatgtccaaggggaatgaggactggaccccggataacctcaattacctgcgcaaagtgatgcaatataagacgatgctgatgacaagaaaacctgtcggccccgagggagctctttacaaggaaaccctgatcgccgccgaccctaaaaagcggctcgtgggcgctagcaaagagagacaggatcccaccatttacgggggatatacaaaggaatcttccgcctacatgagcctggttcgcgcgggcgggaagaaccagctcgtgaaaatccctgtccggattgctaatgagatccattctggacagagaaagctggacgactatgtgcaagccaaagttaagaaattcgaacgcattcttctgcccaagatcagcctcggccagctggtggaggatgaggggcagcggttttacctggccaccaacgaaatgaagcacaatgctaaacaactttggctggaccagaaggtcgtgacaacgtataaaagactcaccgccgagtccccggtggaagatttcctgacagtctttgacgcgctcaccagctctgctacaatccatcacttcaagttttaccagcgcgatctggagcttctgcgggacaacagagccggcttccaggatctggccaaagctacccaactcaaggttctgaaggacgtgctttatgaactgcacgataatgccggatggcgcgaccctattaaacagtactttaaggagatcggcctcaaagtgagaatgtggacgaagctgcagaaagaagggggaattaagctcaccgatcaggctgaactgatctaccaatcccccagcggccttttcgagaagcggcgcagagtccaggacctgctgtga

SEQ ID NO: 4082 - RNA, 3939 nt, synthetic construct
  misc_feature 1..3939: note = Cas9 variant
  source 1..3939: mol_type = other RNA
atgcagaacggcttcctggggatcaccgtgagctccgagcaagtcggatgggccgttacaaatcccaagtacgaactcgagagagcttctcggaaagacctgtggggcgtgcgcctttttgataaggccgaaacggcggaggacagacggatgttccgcaccaacagacggctgaatcagcgcaaaaagaaccggattcactatctcagagatatctttcatgaagaggtgaatcagaaagaccctaacttctttcagcaactggatgagagcaatttctgcgaagacgatcgcacagtcgagtttaacttcgacaccaatctttacaagaaccagtttccgacagtgtatcacctgagaaagtacctcatggaaaccaaagataagcccgacattcggctggtttatctggctttctccaaatttatgaagaatcgcgggcatttcctctacaaaggaaacctgggcgaggtgatggattttgaaaattctatgaaggggttctgtgaaagccttgagaagttcaacatcgactttcctacactgtccgatgaacaggtcaaagaggtgagagacattctctgcgaccacaagatcgccaaaaccgttaagaaaaagaatatcattacgatcaccaaagtgaagtctaagacagccaaggcttggattggactgttctgtggctgcagcgtccccgtgaaggtgctttttcaggatatcgacgaagagattgtcaccgatcctgagaaaatctccttcgaagacgccagctatgatgactacattgctaacatcgagaagggcgttgggatctactatgaagccattgtgtctgcgaaaatgctgtttgattggtccatcatgaacgagattctcggagaccatcaactgctgagcgatgccatgatcgctgaatacaataagcaccacgacgatctcaagcggctgcagaaaattatcaagggcacagggtctcgcgagctttatcaggacatcttcattaacgacgtgtccggaaattacgtctgttatgtgggccatgccaaaaccatgagctctgctgatcagaagcaattttacacgttcctgaaaaacagactcaagaatgttaacgggatctccagcgaggacgccgaatggattgatacagagatcaagaatggaaccctgcttcccaaacagacaaagcgggacaactccgtgattcctcaccagctgcaactcagagaatttgagctgatcctggataatatgcaggaaatgtatccgttcctcaaagagaaccgcgagaagctgcttaaaatctttaatttcgtcattccctactacgtgggccctctgaagggcgttgtgcggaagggggaatctaccaactggatggtccccaaaaaggacggagtgatccatccttggaattttgatgagatggtcgacaaagaagcgagcgccgagtgcttcatttccagaatgaccggcaactgtagctatctcttcaatgagaaggtgctgcccaaaaactctcttctgtacgaaacatttgaggttctcaacgaactgaatccgctgaagatcaacggggagcctatttccgtggaactcaaacagcgcatctatgagcagctgttccttacgggaaagaaggtcaccaaaaagagcctgacaaaatacctcattaagaatggctatgatgaggacatcgaactgtctgggatcgataacgagtttcacagcaatctgaaatcccacattgacttcgaagattacgacaacctttctgacgaggaagtggagcggatcattctcagaatcaccgtttttgaggataagcaactgctgaaggactatctcaatcgcgagttcgtgaaactgagcgaggatgaacggaagcagatttgctcccttagctacaaaggatggggcaacctgtctgagatgctcctgaatggcatcacagtcaccgactccaacggggtggaagtgagcgttatggatatgctgtggaatacgaaccttaatctcatgcagatcctgtctaagaaatacggatataaggctgagattgagagatacaacaaggaacatgagaaaaatatctataaccgcgaagacctgatggattacctcaacattccccctgcccagcggagaaaggtcaatcaactgatcacaattgtgaaatcccttaagaaacgctgtggcgtgcccaacaagatctttttcaaggtcagccgggagcaccaggacgatcccaaaagaacctcctctcggaaggagcagctgaaatatctctacaagagcctgaaatccgaagacgagaagcatctgatgaaagaacttgatgagctcaatgggcacgaactgtctaacgacaaggtgtatctgtactttctccagaagggacgctgcatctacagcggcaaaaagctgaatctttccagactgcggaaaagcaactatcaaaatgatattgactacatctatcctctctctgctgttaacgacagatccatgaataacaaggtgctgaccgggattcaggagaatcgcgccgataaatacacatatttcccggtcgaccccgagatccagaagaagatgaaaggcttttggatggaactggtgcttcagggattcatgagcaaggagaaatactttcggctctctagagaaaacgatttctccgagaatgaactggttagcttcattgagcgcgagatctctgacaaccaacagagcggcagaatgatcgcctccgtgctgcagtattactttcctgaaagcaagattgtcttcgtgaaagagaagctcatctcttcctttaagcgggatttccatctgattagctcctacgggcacaatcaccttcaagctgcgaaagacgcctatatcaccattgttgtgggaaacgtctaccatacaaagtttacgatggatcccgctatctatttcaaaaaccacaagcgcaaagactacgatctgaatagactctttctggaaaacatttctcgggacggccagatcgcctgggagagcgggccttatggatccatccagaccgtgcgcaaggaatacgcccagaatcatattgctgtgacaaagagagtcgttgaggtgaaaggcgggctgttcaagcaaatgccccttaaaaagggccacggagagtatccgctgaaaaccaacgatcctcggtttggcaatatcgcccagtacgggggatacacaaacgtgaccggctcttatttcgtcctcgtggaaagcatggagaaggggaagaaacgcatttccctggaatacgttcccgtgtatctccacgagagactggaggacgaccctggacataaacttctgaaagaatacctcgtcgatcaccggaagctgaatcatcccaaaatcctgcttgcgaaggtgcgcaaaaactctctgctcaagattgacggcttttattacagactgaatgggcggagcggcaacgctctcatcctgacgaatgccgttgagcttatcatggatgactggcagaccaagacagccaacaaaatttccggatatatgaagagacgcgctatcgataaaaaggcccgggtgtaccagaatgagttccacattcaagaactggaacagctctacgacttctatctggataaactggagaacggcgtctacaagaatagaaagaacaatcaggctgagcttatccataacgaaaaagagcagtttatggaactgaagaccgaggaccaatgtgtgctcctgacagaaattaaaaagctgttcgtttgcagccctatgcaggccgatctcacccttatcgggggatctaaacacacgggcatgatcgcgatgtccagcaacgtgacaaaggccgacttttctattatcgctgaggatcccctggggctgcgcaataaggtcatttattcccacatgggagagaaatga

SEQ ID NO: 4083 - RNA, 3939 nt, synthetic construct
  misc_feature 1..3939: note = Cas9 variant
  source 1..3939: mol_type = other RNA
atgcagaacggcttcctggggatcaccgtgagctccgagcaagtcggatgggccgttacaaatcccaagtacgaactcgagagagcttctcggaaagacctgtggggcgtgcgcctttttgataaggccgaaacggcggaggacagacggatgttccgcaccaacagacggctgaatcagcgcaaaaagaaccggattcactatctcagagatatctttcatgaagaggtgaatcagaaagaccctaacttctttcagcaactggatgagagcaatttctgcgaagacgatcgcacagtcgagtttaacttcgacaccaatctttacaagaaccagtttccgacagtgtatcacctgagaaagtacctcatggaaaccaaagataagcccgacattcggctggtttatctggctttctccaaatttatgaagaatcgcgggcatttcctctacaaaggaaacctgggcgaggtgatggattttgaaaattctatgaaggggttctgtgagagccttgagaagttcaacatcgactttcctacactgtccgatgaacaggtcaaagaggtgagagacattctctgcgaccacaagatcgccaaaaccgttaagaaaaagaatatcattacgatcaccaaagtgaagtctaagacagccaaggcttggattggactgttctgtggctgcagcgtccccgtgaaggtgctttttcaggatatcgacgaagagattgtcaccgatcctgagaaaatctccttcgaagacgccagctatgatgactacattgctaacatcgagaagggcgttgggatctactatgaagccattgtgtctgcgaaaatgctgtttgattggtccatcctcaacgagattctgggagaccatcaactgctcagcgatgccatgatcgctgaatacaataagcaccacgacgatctgaagcggcttcagaaaattatcaagggcacagggtctcgcgagctgtatcaggacatcttcattaacgacgtgtccggaaattacgtctgttatgtgggccatgccaaaaccatgagctctgctgatcagaagcaattttacacgttcctcaaaaacagactgaagaatgttaacgggatctccagcgaggacgccgaatggattgatacagagatcaagaatggaacccttctgcccaaacagacaaagcgggacaactccgtgattcctcaccagctccaactgagagaatttgagctgatcctcgataatatgcaggaaatgtatccgttcctgaaagagaaccgcgagaaacttctgaaaatctttaatttcgtcattccctactacgtgggccctctcaagggcgttgtgcggaagggggaatctaccaactggatggtccccaaaaaggacggagtgatccatccttggaattttgatgagatggtcgacaaagaagcgagcgccgagtgcttcatttccagaatgaccggcaactgtagctatctgttcaatgagaaggtgcttcccaaaaactctctgctctacgaaacatttgaggttctgaacgaactgaatccgctcaagatcaacggggagtccattagcgtggaactgaaacagcgcatctatgagcagcttttcctgacgggaaagaaggtcaccaaaaagtctctcacaaaatacctgattaagaatggctatgataaagacatcgagctgagcgggatcgataacgaatttcactccaatcttaagtctcacattgacttcgaggattacgacaacctcagcgacgaagaggtggaacaaatcattctgcggatcaccgtttttgaggataagcagctgctcaaagactatctgaatagagagttcgtgaaactttccgaagatgagcgcaaacagatttgcagcctgtcttacaagggatggggcaacctctccgaaatgctgctgaatggcatcacagtcaccgacagcaacggggtggaggtgtctgttatggatatgctttggaatacgaacctcaatctgatgcagatcctgtccaaaaagtacggatataaggctgaaattgagcattacaacaaagagcacgaaaagacaatctataatcgggaggacctcatggattacctgaacattcctcccgcccaaagacgcaaagtcaaccagcttatcaccattgtcaagagcctgaaaaagacctatggcgtgcctaataagatctttttcaaagtgtcccgggaacatcaggacgatcccaagagaacatctagccgcaaagagcagctcaagtacctgtataaatccctgaagtctgaggacgaaaaacaccttatgaaggagctcgatgaactgaacgggcatgagctgagcaatgacaaggtgtacctctactttctgcaaaaaggacggtgtatctattccggcaagaaacttaacctgagcagactccggaagtctaattaccagaacgatattgactatatctaccccctgtccgctgttaatgaccgcagcatgaacaataaagtgctgaccgggattcaggaaaacagagccgataagtatacatacttccctgtcgacccggagatccagaagaaaatgaagggcttttggatggagcttgtgctccaaggattcatgtctaaagaaaagtattttcggctgtccagagagaatgatttcagcgaaaacgagctggtttctttcattgaacgcgagatcagcgacaatcagcagtccggccggatgatcgccagcgtgctccaatactactttcccgagtctaaaattgtcttcgtgaaggaaaagctgatctccagctttaaaagagatttccaccttatttcctcttatgggcacaaccatctgcaggctgcgaaggacgcctacatcacgattgttgtgggaaatgtctatcacgctaaatttaccatggatcctgccatctacttcaagaaccataaacgcaaggactatgatctcaacagactgtttctggagaatattagccgggacggccagatcgcctgggaatccgggccctacggatctatccagacagtgcgcaaggagtatgctcaaaaccacattgccgtgaccaaaagagtcgttgaagtgaagggcgggcttttcaaacagatgcctctgaagaaaggccacggagagtaccccctcaagacaaatgatccgcggtttggcaacatcgcgcagtacgggggatataccaatgtgacgggcagctacttcgtcctggtggagtccatggaaaaggggaaaaagcgcatttctctcgagtatgttcctgtgtacctgcatgaaagacttgaggacgaccccggacacaaactgctcaaggagtatctggtcgatcatcggaaactgaaccaccctaagatccttctggctaaagtgcgcaagaatagcctcctgaagattgacggcttttactatagactcaacgggcggtccggcaatgccctgatccttaccaacgccgttgaactgatcatggatgactggcagacaaaaaccgctaataagattagcggatacatgaaacgcagagccatcgataagaaagctcgggtgtaccaaaacgagttccatattcaggaactcgagcagctgtatgacttctacctggataaacttgaaaatggcgtctataagaacagaaagaataaccaggccgagctgatccacaatgagaaggaacaatttatggagctcaagacagaagaccagtgcgtgctgctcaccgagattaagaaactgttcgtttgttctcccatgcaggcggatcttacgctgatcgggggatccaagcacacaggcatgatcgccatgagctctaacgtgaccaaggctgactttgccgtcattgctgaagatcctctggggctccgcaacaaagtgatctactcccatatgggagagaagtga

SEQ ID NO: 4084 - RNA, 3942 nt, synthetic construct
  misc_feature 1..3942: note = Cas9 variant
  source 1..3942: mol_type = other RNA
atgcactacctggacgagatcttcgctccccatctccaggaagtggatgagaactttctgagacggcttaagcaaagcaatattcaccctgaagacccggctaaaaaccaggccttcatcggcaagctgctctttcccgatctgcttaaaaagaatgagcgcgggtatcctaccctgattaaaatgagagacgaactccccgtcgagcagcgggcgcattaccctgttacaaacatctataagctgcgcgaggctatgattaatgaagatagacagttcgacctgcgggaggtgtacctcgccgtgcaccatatcatgaagtatcgcggacactttctgaacaatgcctccgtcgataaattcaaggtgggcagaatcgacttttacaaatctttcaacgttcttaatgaagcctatgaggagctgcaaaacggggaagggagctttacgattgagccctccaaggtggaaaagatcggccagctcctgcttgataccaagatgcggaagctgaatcgccagaaagccgtcgctaagctcctggaggtgaaagttgccgacaaggaagagacaaaaagaaacaagcagattgcgaccgccatgtctaaactggtgctcgggtacaaggctgatttcgccacagtcgctatggccaatggaaacgagtggaagatcgacctgagctccgaaacctctgaggatgaaattgagaaatttcgggaggaacttagcgacgcgcaaaatgacatcctgacagagattacctccctcttcagccagatcatgctgaacgaaatcgtgcctaacggcatgtctatttccgagagcatgatggatcgctactggacgcacgaaagacagcttgccgaggtgaaggaatatctggctacccagccggcctctgctcggaaagagtttgaccaagtctacaataagtatatcggccaggcccccaaagagcgcgggttcgatctcgaaaagggactgaagaaaattctgtccaagaaagagaactggaaggaaatcgacgagctcctgaaagccggcgatttccttcctaagcagagaacaagcgctaatggggttattccccatcaaatgcaccagcaggagctggaccggatcatcgaaaagcaggcgaaatactatccttggctcgccaccgagaaccccgctacaggagaaagagatcgccatcaagccaagtacgagctggaccagcttgtgtcttttcggattccgtattacgtgggccctctggtcacccccgaagtgcagaaagccacgtccggggctaagttcgcctgggcgaaaagaaaggaggatggagagatcacaccttggaatctctgggacaagattgatcgcgctgaaagcgccgaggcctttatcaaacggatgaccgttaaggacacatacctgctgaacgaagacgtgctccccgctaattccctgctttatcagaaatacaacgtcctgaatgagctcaacaatgtgagagttaacggccgccggctgtctgtgggcattaagcaagatatctataccgaactgttcaaaaagaaaaagaccgtcaaggtgagcgacgtcgcctcccttgtgatggctaaaacaagaggggttaataagcccagcgtggagggactctctgatcctaaaaagtttaactccaatctggccacgtacctggacctcaaaagcatcgtcggcgataaggtggacgataaccgctatcagaccgacctggagaacattatcgaatggcggtctgttttcgaggatggggaaatttttgcggacaaacttacagaggtggaatggctgaccgatcagcagagaagcgccctcgtcaaaaagcgctacaaaggatggggccggctgtccaagaaactgcttacagggatcgtggacgagaatggacaaagaattatcgatctcatgtggaacaccgaccagaatttcatgcagattgtgaaccagccggtttttaaggagcaaatcgaccagctgaatcagaaggctatcacgaacgatggcatgacactgcgggaatgggtcgagtctgtgctcgacggcgcctataccagcccccaaaataaaaaggctatttggcaagtggtccgcgtggttgaagatatcgtgaaagccgtcgggaacgcgcctaagtccattagcatcgagttcgccagaaatgagggaaacaaaggcgaaattacccggtctagacgcacacagctgcagaaactttttgaggaccaggctcacgaactggtgaaggatacctccctcacagaggaactggagaaggcccccgacctgagcgatcggtactacctttatttcacgcagggaggaaaggacatgtacaccggcgatcctatcaattttgacgagatctctacaaaatatgatattgaccacatcctcccccagtccttcgttaaggatgacagcctggacaacagagtgctggtctcccgcgctgaaaataacaaaaagtctgatagagtgccggccaaactctacgccgctaagatgaagccttattggaatcagctgcttaaacaagggctgattacccagcggaagttcgagaacctcacaatggacgttgatcagaacatcaaataccgcagcctgggctttgtgaagagacagctggtcgaaacccggcaagtgattaaacttacggcgaatatcctcggatccatgtatcaggaggccggcaccgacatcattgaaacacgcgctgggctgaccaagcagctgagagaggagttcgatctccccaaggtgcgggaagtcaacgactaccatcacgccgttgatgcctacctgacaacctttgctggacaatatcttaatcgcagataccctaaactgcggtctttctttgtgtatggcgagtacatgaagttcaaacatgggagcgacctcaagctgcgcaactttaatttctttcacgaactgatggagggagataaatcccagggcaaggtggtcgaccagcagacgggggaacttatcacaaccagagatgaggtggccaagagcttcgaccggctgctcaacatgaaatatatgctggtttctaaggaggtgcatgacagatccgatcaactctacggcgcgacaattgtcaccgctaaagaaagcggaaagctgacctctcccatcgagattaaaaagaagcgccctgtggacctttatggcgcctacacaaatgggacgtccgcctttatgaccatcatcaaattcacaggaaacaagcccaaatacaaggttattggcgtgccgaccacaagcgctgtcgggctgaaacgggtgggaaagcctggctctgaaagctataatcaggagctccacagaatcattaagtccaaccccaaagttaagaaagattttgagatcgtggtcccccacgtgagctactctcagctgattgtggacgatgactgcaagttcaccctggcctccgatacgtatcagcatcctgcgacacaacttgtcctgagcaaagaatccatggagatcattgctgacgatttcaagtttgttaaagaaaataccgccaccgccgacgagcagctcgtgcgcgtgttcgatgaaatcgtcaaccagatgaatcactactttacaatcttcgaccagcggtctaacagacaaaaggtgaccaaggctcgcgataaatttgttagcctgccgacagagtccgagtatgaaggggccaagaaaacccaggtgggcaagacggaggtcattacaaatctcctgatgggacttcatgctaactctgcccagggcgacctgaaagtgctcgggctgagcaccttcggatttttccagtcctctggcgggctgaaccttagcgaagacgcgatgatcgtttaccaatcccccacaggactgtttgagcggagaatttgtctcaaggatatctga

SEQ ID NO: 4085 - RNA, 3942 nt, synthetic construct
  misc_feature 1..3942: note = Cas9 variant
  source 1..3942: mol_type = other RNA
atgagcttcaaggagaactccaaaatctactatggcctggacattgggaccgattctgtgggatggagcacaacgaatgaaaagtacgagctcctgagatataaaaacaatcttatgtggggcgtctccctgtttgaagccgcttctctcgccgaggaacggcgcgggcacagaacccagcggcgcagatacgaccggcgccaacagagagttgcgctgcttggagagctgttcgctaaggagatcctcaaaacagatcccgactttttcctgcggctgaaggaaagctccctctatcctgaggatcgcacctctaagaacgtgaatacatactttgacgatgccgacttcaaagatagcgactattttaagatgtacccgaccgtgcatcacctgattaaagaactttccgagagcaacaagccccatgatgtcagactggtgtacctcgcctgcgctttcatcgttgcccaccggggccattttctgaatggggctgacgagaacaatgtgcaggccgtccttgatttcgactcttcctattgtgaatttacagactggttcaaaagcaacgatattgaggacaatcctttttctgaatccgtgaagaacgagttcagcgttatcctgcgcaagaaaatcggaattaccgcgaaggaaagagagatcaaaaatctcctgttcggcacgaccaagacacccgattgctacaaagacgaggaatatcctattgatatcgacgtgctgattaagtttatctctggcgggaaaaccaacctcgccaagctgttccggaatccctcctacgatgagcttgacattcagacagtcgaagtgggaaaggctgattttgccgacaccatcgatctgctcgctagctccatggaggacacggacgtgcctctgctttctgccgtcaaagcgatgtatgattggagcctgctcatcgacgttctgaagggccaaaagacaatttccgatgccaaggtgtgtgaatacgagcagcacaaaagcgacctgaaggctctcaagtatatcgtgcgcaaatacctggatagagcccagtacgacgagattttccggaccgctggggaaaagccgaactatgtctcttactcctataacgtgacagatgttaaacttaagcagctgcccagcaattttaaaaagaagaactctgaggagttctgcaaatacatcaagagcaaactcgaaaagattaaacctgaatccgacgatgaggccgtgtataatgagctgatcgaaaagtgtaactctaagaccctttgccccaaacaagtcaccgacgagaatagagtgatcccttaccagctgtattaccacgaactcagcatgattctggataaggcctccgcttacctggactttctcaacaaaacagaggatggaatcagcgttaagcagaaaattctgacgcttatgaagttccgcatcccctattttgtgggcccgctggtcaaacggaatgagaccgacaacgtgtggattgtcagaaaggcggaagggcgcatctacccttggaatttcgagaacatggtggactttgataagtctgaagacggattcatccggagaatgacatgtaaatgcacctatctcgccggcgaggatgttctgcccaagtactccctgctttatagcaaatacacagtgctcaatgaaattaacaatatcaaggtcaacggcgagaaaatttctcctgagctgaagcaggacatctttaatgaactgttcatgaagacctcccgcgtgacggttaaaaagattacagagctcctgaaacggaagggggctttcagcgaagagaaaggagattccctttctggcgtggacatcaacattaagagctccctgaagtcttatctcgattttagacgcctgctggaaaacgggagcctttccgagaatgacgtcgagcggatcatcgaaagaattaccgtgaccacagataaaccccgcctcgtgagctggctgaaggccgagtactctgacctgcccgccgaagatatccggtacatttccagactcagctataaagactacggacggctgtctgctaaacttctgaccggctgttatgagctcgatacaaacacgggggaaatcggaggccgctccattatcgacttcatgtgggccgagaatatcaacctgatgcaaattctgagcgactcttacggctataagagctttatcgaggaagagaataagaagtactatatgattaaccctaccgggtccatcgcgcagacacttagagaaatgtacgttagcccgtctgtctcccgggctattatcagaaccatggagatcgtgaaagagctccgcaagattaccaaaaaggatcccgacaaaatcttcgtggaaatggcccggggaggcaagcctgaggaaaaagggaagagaacaagctcccgcagagagcagattgaaaagctgtacgattctgccaaggcttttgtcagcgacgaggatatctcccatatgcggtctcaactgggaagcctctccgacgagcagctgcgcagagaaaagtattacctttatttcattcagtttggcaaatgcatgtactctggggaggccatcgatttcagccggctgggcgacaatcactgttatgatatcgaccatatttttccccagtccaagatcaacgatgacagcctccacaataaagtgctggttaagtctcaactgaacggagaaaagtccgacgattaccctattaaagctgagatccgcaataagatgcaccccctttggaaaaacctcttctatagagacccgaagaatcctgccgataaagtgaagtacgaacggctgacgcgcagcaccccctttacagaggacgagctggcgggcttcattgaaagacagctcgtcgagacccggcagtctacaaaggccgtggctaccctgcttaaagaaatgtttcctgattccaagatcgtttacgtgaaagccgggcaggtcagcgagttccgccatgacttcgatatgctgaagtgcagagaaattaacgacctccaccatgctaaagatgcctatctgaatatcgtgatcggaaacgttcacgacgtgaagtttacgtctaaccccatgaatttcgtcaagaacgcggataaacattacacaattaaggtgaaagagaccctgaagcacaaagtgtcccggaatggcgagacagcctggaaccctgaaaccgactttgataccgtcaagagaatgatgagcaaaaattccgttcgctatgtgcggtactgctataaaagaaaagggggattctttaaccaaaatcccgaccgcgctggcaacccggaccttgcccggctgaaaaaggatctcgaccctgtgaaatacgggggctataatagcaagtctatcagctgtttctccctgattaaatgcacaggagtcggcgctgtgatcattcccgttgagctcctgtgtgaaaagagatacttttctgatgacagcttcgcctccgagtacgcctattctgtgcttaagaacgctctgcccgcgaaaaatatcgccaagatcagcattgatgacatctcctttcctctcaaacgccggccgattaagatcaacacgctgttcgagtttgatgggtacagagtcaatattcgctctaaagacagctatcactacttcaccatctccagcgctatggccgccatctattctaaggatacatccgactacattaaggctgtgagctcttatatcgataaatccgacaagggaagcaaattcaagcccggcgaagcctttgatgttctgtccaaccttaaagtgtacgacgagattgcgaagaagtgcatctctgaacctttcagcaaaatttccaagctggctgaggccgggaaacggtggaagaaagaagagatcagcctccagaattgtctgctctga

SEQ ID NO: 4086 - RNA, 3945 nt, synthetic construct
  misc_feature 1..3945: note = Cas9 variant
  source 1..3945: mol_type = other RNA
atgctgaagaaagactacagcatcggcctcgatattgggaccaactccgtgggacacgccgtcgttacagacgattataaggtgcccacgaaaaagatgaaagtgttcggcgacacctctaagaagacaatcaaaaagaatatgctgggggtccttctgtttaacgagggacagaccgctgccgatacaagactcaaacggggcgcgcgcagacggtacacccgcagaaagaatcggctgcgctatcttcaagaaattttcgctcctgccctggccaaagtggacccgaactttttctacagactcgaggaaagctccctggttgctgaggataagaagtatgacgtgtaccccatctttgggaaacgggaagaggagctgctctatcatgatacacacaagaccatttaccatctgcgctctgaacttgccaataacgacagacctgctgatctgcggctcgtctacctggcccttgcgcacatcatcaaatatcgcggaaatttcctgctcgagggcgaaattgacctgagaacgaccgatatcaacaaggtgtttgccgagttcagcgagacactgaatgaaaactccgacgagaatctcggcaaactggacgttgctgatatttttaaggacaacaccttctctaaaacaaagaaaagcgaggagcttctgaaactctccggggccaagaaaaatcagctggctcatcagctttttaagatgatggtgggaaacatgggcagcttcaaaaaggtcctggggaccgatgaggagcacaagctctcttttggaaaagacacgtacgaggatgacctgaatgatctgctcgccgaagcgggcgaccagtatctggatatcttcgtggccgctaagaaagtgtacgacgccgctattcttgcctccatcctggatgtcaaggacacacaaaccaaaacagttttcagccaggccatgattgagcggtatgaggaacaccagaaggacctcatcgaactgaagcgcgtgtttaaaaagtaccttcccgagaaatgccatgatttcttttctgagcctaagatctccgggtatgctggatacattgacggcaaagtgagcgaagaggatttctacaagtataccaagaaaaccctgaagggcatccccgaaacagaggaaattctccagaaaatcgacgcgaacaactacctgagaaagcaacggacgtttgataatggggccattcctcaccaggtccatctgaaagagctcgtggctatcgttgagaaccagggaaagtattacccgttcctgagagaaaataaagacaagtttgagaagatccttaacttccgcattccctattacgtgggccctctggcccggggaaattctaaatttgcctggctcaccagagctggggaaggcaagatcacaccctataacttcgatgagatgattgacaaagagacctccgccgaagattttatcaagcgcatgacaattaatgacctgtacctgcctaccgagcccgtccttccgaaacacagcctcctgtacgaacggtatacgatcttcaacgagctggcgggggtgagatacgttacagaaaatggagaggctaagtattttgatgcccagaccaagcgctccatcttcgaactcttcaaactggaccggaaggtgtctgaaaagatggtcattaagcaccttaaagtggtcatgcctgccatccgcattcaagctctgaagggcctcgataacggcaagtttaatgccagctacgggacctataaagacctggtggacatgggagttgctcccgagctgcttaacgatgaagtcaattccgagaagtgggaagacatcattaaaacactcaccatcttcgagggcagaaagctgattaaacggagactggagaactaccgcgattttctcggggaagacatcctgcggaaacttagcagaaagaaatatacaggatggggccggctgtctgccaagctcctggatgggatctacgacaaaaagacgcataaaaccattctggattgtcttatgacagaggactactcccagaatttcatgcagctcatcaacgatgacacctatagctttaaggaaacaattaaaaacgcgcaagtgatcgagaaggaagagaccctggccaagacggtgcaggagctgcctggctctcccgctattaaaaagggaatcctccagagcctggaaatcgttgatgagattatcaaagtgatgggctacaagcccaaatccattgtcgtggaaatggcccgcgagacccagaagacacacgggaccagaaagcgggaggacagagtgcaacagatcgttaaaaatcttaaggatgctaacgaactgcctaaaaagctcccgtctaatgccgagctgagcgacgaacgcaaatatctgtactgccttcagaacggacgggacatgtatacaggcgcgcccctcgattacgaccatctgcagttctatgatgtcgaccacattatccctcaatcctttctgaaggatgacagcatcgagaataaggtgctcaccattaaaaaggaaaacgtgagaaaaacgaatgggctgccctctgaggccgtcatccagaagatgggatccttctggaaaaagctgcttgatgctggcgccatgacaaacaagaaatacgacaatctccgcagaaacctgcatgggggcctgaatgagaaacttaaggaacggtttattgagcgccagctggtggaaaccagacagatcacaaagtacgttgctcaactcctggatcagcggctcaactatgacggaaatggcgtggagctggatgaaaagattgccatcgtcacccttaaggcccagctggctagccagttccgctctgagtttaagctcagaaaagtgcgggcgctgaacaatctgcaccacgcccatgacgcttaccttaacgccgttgtggccaacctgatcatggctaagtatcctgagctcgaacccgagttcgtctacgggaaatatcgcaagaccaaatttaagggactgggcaaagccacagcgaagaatacgctctacgctaacgtgctgtatttccttaaggaaaatgaggtttacccgttctgggacaaagccagagatctgcctaccattaagcggtacctctatcgcgcccaagtgaacaaagtcagaaaggctgaacggcagacagggggattttccgacgagatgctggtgcccaaaagcgattccggcaagctgcttcctagaaaggaggggctggaccccgtgaaatacggcggatatgccaaggcggtcgaatcttacgctgttctcatcaccgccgatgaggtgaaaaagggcaaaacaaagaaggtgaaaaccctggtcaatattcctatcattgacagcaagaaatatgaagccgatcccacggcttacctcgcctcccgcgggtatacaaacgtgaccaattctttcatcctgccgaagtacagccttctggaggaccctgagggacggagacgctacctggcttcctttaaagagttccagaaggccaacgaactcattctgccccaacaccttgttgaactgctctattgggtgaatgcgaaggatggcgagcagaaactggaagaccataaggccgagtttaaagaactcttcgataagatcatggaatttgctgacaaatacgtcgtggcccccaagaacagcgagaaaatccggagactgtatgaagagaatcaggatgctacccctatggaacttgggaagaacttcgttgagctgctgcgctacacagccgacggagccgcttctgactttaagttctttggcgagaatattccgcggaaaagatataactccgcggggagcctcctgaatggcacccttatctaccagtctaagacaggactgtatgaaacgcgcattgatctcggcaaactgtga

SEQ ID NO: 4087 - RNA, 3948 nt, synthetic construct
  misc_feature 1..3948: note = Cas9 variant
  source 1..3948: mol_type = other RNA
atgggctacagcgtggggctggacatcggaaccggctccgtcgggtgggttgtgacaaacgaggatggaaagctcgccagagctaaaggcaagaatctgattggggtgcggcttttcaaaacggccgaacccgcggctgaccgcagaaccaaccggacaacccgcagacggctgtctcgcagaaagtggcggctccgcctgcttgatgagctgtttgccaatgaactcggaaaaatcgacagcaacttcctgacaagactgaagtattcctacgtccaccctaaggatgacgccaatcgggctaactattacggcggctatctctttccgacccaggaggaaacaaagaagttccatgccaaataccccaccatttatcatctgcgccttgctctgatgacggagtctagacaatttgatctccgggagatctacctggccatgcaccagattgtgaagtaccgcgggcacttccttaatagccagtccaaaatgaccatcggaaacacatataatcctcaggacctgcaaaccgcgatggaaaactacgccgaggctaagggcctctctatcgaactgaagcagcccgaggagatggttgccattctgacaggggaagctggatttggcctcagcaaaaaggccaaagcggagaagctgcttaataacttctttttcgataccaaagaagagaaggccacggtgcaggctatcctggccgggattgtcggaaatacaatcgactttaccaaagtgttcaacagacagctcacaggcgataccctgaaggcttggaaacttaaactggactccgaaacctttgatgttgacagcgagcctattctctctgacctggatgacgatgagacagaactgttcttcgccatccggcaagcctttgacggcttcacgctcatgaatctgcttggggatcagacctccattagcgctgcgatggtggagagatatacacagcatcacgacgatctgctcaccgtcaaacaggtggccaagaagcaaggactgtctcacaaagaattttccaacatctacagcgctttccttaaggacgatacagacaagggcatgaaaaagctgctcgaggaatctaacctgtccaccgaggatgtgaatgggatccagctgcgcatggacagccatgactttctcccccagcaacggacgaaagccaactccgtcattcctcaccagctgcatcttgccgagctggaagctatcattgagaatcagggacagtattacccgttcctcctggaaacatttgagaaggaaggcaccgccgcgaacaaaatcgctgagctgcttaagttccgcattccctattacgttgggcctatggtgaccaagaaagatgtggagaatgccggaggcgacgccacaaaccactgggtcaccagaaatgaaggctacgagaagtctgctgtgacagcctggaactttgatcaagttttcaatcgggaccaggctgccctcgattttatccagagactgacggggaccgacacatatctgatcggagaacccaccctccctcagaacagcctgaaataccaaatgttcacagtgcttaatgagctgaacaatgtcaaggtgaacggccgccggattgataatcagaccaaacacgacctcatccaggatctgtttaagtccaagaaaacggttagcctgaaggcgttccaggactattaccaatctcaggggaaatccgatattcaggtggtcggacttgccgacaagaccaaattcaacagcaacctctctacatatatcgatctgagcaagaccttttccgctgaggaaatggagaatccccagaaccaagacctgctcgaacagattgtggagatccagacagtcttcgaagactctaaaatcgccgagagagagctgagcaaacttgaactgaccccggagcaagtgacgaagctcgctaagacacattacaccggctgggggaatctgtccaacaagctgcttacaacccctattgttgatgtgagcggcaaaaaggtctctatcctcgaccagctggccaaaacctccaagaattttatgagcattatctctaacgaacagtatggagtgcaggattggattaaggagcaaaatacaacggaaaccacaggcaccctggaggacaaactcgcggatctgacaacctcccccgccaacaagcgcgggatcaaacaggctttcaatgttctttttgacattcagaaggccatgaaaagcgagcctgatcgggtgtacctggagttcgctagagaaacgcagacatccgtccgcaccatgtctcggtacaactatctcaagggactgtaccaaagcaagtccctggacgccgaagccaaaaatcttaagaaagagctcgctgaaaccgatcagaagaaatttgacaacgatagactgtatctgtacttccagcagcaaggcaaggacatgtatacagggcagcccatcaatatcgataagctctctagcgactacgacattgatcacatcattccccaggcgtttaccaaagacgattccatcgacaaccgggtgctggtgagccgccctgagaatgccagaaagtctgattccggaacatatacgaccgaggttcaagctgccgccagcggcctttggaaaacactggtccagtctgggttcatttcccggaagaaatacgacagactcacccatgctggcgattacagcgaaggacagaagacaggctttatcgcccgccagctggtggagacccggcaaatcattaaaaacgtggcggctctgatcgaatctgagttcgaccagacgcaggccgtcgccattagagctgagatcaccggggatatgcgcagacttgtggccattaagaagcaccgggaaatcaacagctttcatcacgcgttcgacgctctgctcatcacagccgccggacagtatatgcaaaaacgctacccggatagagactccaataacgtttataatgagttcgaccggtacaccaacgattatctgaagaaactccgcgaatctagctccaaggacgaggtgagaaaactgaagccctttggcttcattgtcgggacaatggctaagggaaatgaagattggaccacagagcagaccgagtaccttcggcacatcatgaactttaaaaatattctgacgacatataagaccggccctgaccgcgggcccctcagcaaagaaaccatctacgccgtggatcctaaggctaaactgattggcacaaacaagcatagacaggacgtttccctgtacggaggctatacctacccctattctgcctacatgacgcttgtgcgggcgaatgggaagaaccagctggtcaaagtgagccgctccgccgcttctctcatgaaaagcggacaactgaagctcgaggattatgttcagcagcagccggaagtgaagaaattcgagaagatcctgcttgaacatctgcctctcggccaactggtcgacaatgatgggaagctgatgtaccttacatcctatgagttttaccacaacgccaaacagctgtggctctctaccgagaatgctgacctgatcagctccctcagcattgattctgacgatcagaagctgatcaaagccttcgacattcttacagccgactccgtgatcgaaagatttcccttctacgagattgatctgaagaaactgatcgaactccgggacaagtttgtgctgattgataacaaacttgacgtcctgagagttgtgctcaaggctctgcaactcgatagcgcgcagcagaagcctctgaaacttatcgacaaggccgctaccgattggaaaaattatcgccaggccggaggcatcaagctgtctgacaacgccgagattatctaccaatccacaaccgggattttcgaaaaacggatcaagattagcgatctgctctga

SEQ ID NO: 4088 - RNA, 3951 nt, synthetic construct
  misc_feature 1..3951: note = Cas9 variant
  source 1..3951: mol_type = other RNA
atgctgcagaagaactacaccatcggcctcgacattgggacaaatagcgtgggatatgccgtcatcaacgataattacaaagttcccgctaagaaaatgaaggtgctgggcaacacggacaaaaagaccattaagaaaaatcttatgggggtgctcctgttcgatgccggagagacagcggctaccacaagactgaagcggggcacccgcagacggtatacacgcagacggaaccgccttagatacctgcaagaaatcctcgggcctgagctggccaaagtcgacgccaattttctgcaccggctcgctgaatcctctctggtgaccgaggataaggagttcagcgcctatccgatttttggagaccgcgaggaggaacttctgtaccataaaacgtataagaccatctaccacctcagatccgctctggccaacaaggatgagaaagcggaccttcggctgatctacctcgccctggctcatattatcaagtatcgcggcaatttcctgattgaaggcgagatcgagctctctgatacagacattgataaagtttacgccgacttttgccggagcttcaacgaactgtttgataccgaggtgcttcaggaaatcgaggtcgaagctattttcaaggacaaaacactgtccaagaccaaaaaggccgaggagctcgtgaaggtttctggggtgaaaaagaatcaggtcgcgcaccagtttctgaaaatgatggtgggaaacacggtgaatttcaagaaagtctttaaccttacagaagaccaaaagctgagcttcggcaccgattcctatgaggacgaactcaatgatctgctggccaagagcgacgatagatacctcgacgtttttgtggctgccaaaaaggtgtatgatacagctatcctggccaacatccttaacaccaaaaattctgtcgccaccaagacaattttctcccagagcatgatcgagcgcttcaaagaccatcagaaggatctgaaggaactcaaacagctgtttaagacgtaccttcccgagaaatatcctgacttctttgggaactctaaggaggatggatacgctggctacattgaagggaaaaccaatgaggaaaagttctatacacacaccaagaaaatcctgaagaacattccccaagcggcctccgtgctcgctcagatcgacgttggaaattacctgagaaaacagcggacatttgacaacggcgtgatccctcaccagattcaactgaaggagctcctggccatcattgaaaatcagggcaaatattaccccttccttctggagaacaaggagaaaatcgccaagattctcacctttagaatcccttattacgtcgggccgctggctcgcggaaatagccggttcgcctggctgaagagagtgggcaaagaaaagatcacgccctttaacttcgagaatgttgtggatcttgaatcttccgcggagcgctttattgagcggatgacactcaacgacctgtatctgcctgaagagaaagtcctccccaagcatagcatgctgtacgaaaaattctccatctttaatgagcttgctgggattagatacatcaccgataacggagaaatgaagttcctggacgcccagaccaagcaatctattttcgagctctttaaacaggagcgcacagtgaaggaaaagaaggtcctggatctgcttaaaaccctcatgcctagcgagcgggtggttgccatcaagggcattgacaatgggaagttcaacgcttcctttggaacatatcacgatctgagcaaaatgggcttcaagacggagaaaatcgcctctgaatccaaccaggctagatgggaagagatcattaagaccctgacaatctttgaggaccgcaaactcattaagagccggctgagaaagtacgatgacttccttaatgaaaaagagatcggcgccctgtctaagcgcaaatataccgggtggggacggctcagcgcgaagctgattgatggcatctacgacaaaaagacacatcagaccatcctggattttcttatgaacgaagactataatcaaaacttcatgcagctcatttccaatgacaactactcttttaaaaagatcattgaggatagccaggtgatcaaggaagaggggtccctgacggaggtcattcaggaactgcccggaagcccggccatcaaaaagggcatcctccaatctattgagatcgtggacgaactggttaaagtgatgggcgggaatcctaagaaaattgtcgtggagatggctagagagacccagaagacacacggaaccacacggcgcgaagccagaatcaaggagattatcaaaaaccttaataagctgaaactcaacgaactgcccaaggatctgccttccaatgaggaacttagcgacgagaaagtgtatctctactgtctgcagaacggccgggatatgtacaccggggctcccctggacctcgataatctgtctcagtatgaggttgaccacatcattccccaatccttccttaaggatgacagcatcgaaaacaaggtcctgacggccaaaattgaaaattccagaaagacaaacggactcccttctgtggaaatcgcgaaaaagatgggcgccttttggcgcagcctgctgaaagtgggggctatttccgagaagaagtaccggaaccttagacgctctctgcatggaggcatgaccgaaaaactcaaggagacattcgtcaaaagacagctggtggagacccggcagatcaccaagtatgttgcccagattctcaatagccgctttaacgaagagaaaaatgaagataaggtggctatcgtcacactgaaggcccaacttacgtcccagttcagaaaagacttcgagctgtacaaggtgcgggaaatcaacaatctccaccatgcccacgatgcttatctgaacgcggttctggccacccttctgatgaccagctttccggagctcgagcccgagttcgtgtacgggaaatatcgcaagacaaaatttaagggcctgggaaaagctacagccaagaataacctctacaccaatattctgcagcttctgaaggaagaatctgcccaatactgggacacgaaagagagagacctcgctacaatcaagaaaaacgtctatcaggcccaggtgaataaggttcggaaagtggagcgccagaccggctccttctacgatgaaaccgtcgcgaaaaagagcgcttctcaaaaactgtttcctagaaagaacgggctggaccccgtgaaatatggaggctaccagcgggccaatgaggggtattcccttctgttccgcgccgatatgctcaacaagagaggaaaaacaaagagcgtgaagaccctggtcaaaattcctatcattgaatctgctcagtacctcgccgaccccacagagtatctggcgaagcggggctactacaatgttagcgaacattcccttctgctgccgaaatttagcctcctggagaacaacaatgggcttagacgctatctggcttcttccaacgagttccagaaggccaatgaactcatcctgcctaaacacctcgtgcggctgctttactggagccaatccaagcagagaaaggaggaactgaacaaacaccgcgccgagtttgctgaactgttcacgtatatcatggattttgccgacaagtacgtggtcgctcccaaaaattctgagaagattaaaaacatctatgagaataacaaggatagctccgtggaagttctcggcaaaaatttcattgagctgcttaagtacaccgccgacggagcggcctctgatttcacatttttcgacaccaagatccctcggaaaagatataacagcgctggcgatctgctcgacgggacactgatttaccagtccaagaccggactctacgaaacgcgcatcgacctgggcgccatctga

SEQ ID NO: 4089 - RNA, 3957 nt, synthetic construct
  misc_feature 1..3957: note = Cas9 variant
  source 1..3957: mol_type = other RNA
atgatgatcaagctgaacaatatgaaaaagattctcggcctggaccttgggaccaacagcatcggatgggccgtggtcgagacagaagataataaaaagttcgagctgctcgacaaaggcgttagaatttttcaggaaggggtgaagatcgagaagggaattgaatcctctaaagctgccgagcggacgggctaccgcagcgcgagacggatcaagttccgcagacggctgcgcaaaatcgagacccttaaggtgctgattgaaaacaatatgtgccccctctccatggatgagctgatcgtctggaaagaaaacaagaataactatcctaagaataaaatcttttacaactggctgaagacaaaagacccgaaggaggggaccaatggaacatatattaacccctactatttcagaaccgaggctattaaacggaagctcgaaaatacaaacgatgtgggccgcgccctgtaccaccttgcccaaagacggggctttaaatctaatcgcctggagagcaccgacgaaaagtccagagggatcgttaagacggagattaacaaactctctagcgaactgaacggacggtatcttggcgagtacttctacgagctgtatctcaagggggaaaagatccgcaagagacatatctcccgggaggaacactacctgaatgagtttaaaaagatttgtgaagtgcagaacttcaataaggagctggctgagaaactcgaaagagccatcttttatcagcgccctcttaagagccagaaaggactggtcggcaagtgcaccctgcaaaacaataaacatcggtgtcccatttctagacctgagttcgaagagtttcgcatgtggcagttcatcaactccattaagtacaagaatagcgatgggaaatttgacttcctcaacaaggaacagcgggagaatatcatccccgctttcgtgtctaacaaaaatgccacatttgagttctccaagattgagaaaatcctgaacaagggagttcacatttatcagtttaattacaagagcaaccataccatcggctctaatcaaacaatgattaacttcatggatgtgtttgacatcgatagaaaacttaccaacgcgtggctgctctgcgtcaataagatctatgaactgtacacggccaaaacaaagaaagacggctccctcaagagcaaatccgaagtgattaccgatgtgtggcacgtcctgttcacatttgacaacgaggagaatctgaaggagttcgctcgcaacaaacttctgctcgacgaatctagcgcccagaaattttccaagatcaatctgaaacaggattacagccagctttctctgaaggctattaacaaaatcctcccttatctgcaagaagggctgatttactcctatgccgttttcatcgcgaatattgagaacgtgatcggaaagagcatctggaatattaaggaaaaccagcagatcattcggacctctatcaaaaagattatcgacaatcacaaaaccgagctcgatatcaacacaattacgaatagcctgatcaacgactttaaggtgaattacaacaacgcccataaagagtataaggtcgatgacattgatcttaagaatatcagagagaaaattatcaagtactatggcaacaaaacctggaattgtctgccggaagacgaaaagctctacgtgaaagagaaggttgaaaagctgtacgagaaacaactgaagtccgggaaacgcggaatcttcattgagaagatccggcttgatgacagaattgaaaactttctcaaagataatttcgactctagcgagctgaacctgaagaaactctatcacccctccgacgtgagcgtctacaagtctgtgaagatcacagatctgggccttcgcctgctcgggtcccctatgattcccagcatcaaaaatcctatggctatgcgggccatgcatcagctgagaaagctgatcaaccaccttattatcgaaggagttattgacgattctaccatcattaatgtggagatgtcccgggaactcaacgacgctaatatgcgcaaagccatcgagagatatcagcggcagagagccacagagaacgaagagttcaagaccaaaattaaggaactgtacaagaaagagtgcggcacggattttgagcccaataacgacgatatcatgaagtatcgcctgtgggaggaacaaaatcacaaatgtctctacacaggcaagagcatcgggatttgcgacttcatcggatccaacccggcttttgaaattgagcataccatccctcggtctctgagctatgataactcccttgaaaataaaaccctgtgtgagaaggagttcaaccagcaggtcaagaaaaatcgcattccctttgaactctctaactacaaggagatcatcagcagaattaataactgggaaatcaaagcggaggaactgttcaagcagattcaaaaagtgaagatccagtccagaatggccgctacaaaggagattaaagacaatgccatccagcggaagcatctgcttcagatggagtttaactactggaatggcaaactcagccgcttcaccagagaagatgtccctgaggggtttaagaactctcaactggtggacatcggaattatcacaaaatatgcccgggcttacctgaagacggttttcaataacgtgaataccgtcaagggctccacagtggccgaatttcgcaacatttgggggctccaggagtatttcgagaaaaaggatagaagcaatcacatccaccattgcattgacgcgatcaccattgcttgtctgacaaaagacaagtacgattttcttgcccacctgtatcacctcgacgaacagaacaatcgggatgccgttcatcgcgctatgatcaaatctaagccctgggagaacttcgtgcaggacgtcaaagaaatcgagaaccaaattctggtgtcccactacacccccgataatctgcctaagcagagcaagaaaatccttagaaagcggggcaaaattcagaagaacgaaaatggagacctcatctatgagaaaggcgatgccgtgcgcgggtctctgcataaggagagcttctacggagctattaagagagaaatcatcaacaaaaagggcgagacggaagagaaagttctgtacgtcaagcggaaaccgctcgaattttccgacctggggttcaagaccattagcgagcttgagaatatcgtggatgacgccgtgagagataaggtcctgaacgcggtgaaagacaagggactcaaacaagccctgaatgaacccatttggatgaacgaggaaaagcagatccctattaaaaaggttcgctgctatacaccctctgtgaccaatcctatcaacctgaagaaacaccgggataagtccaaacacgagtacaagcagagctatcatgtcacaaatgacggcaactaccttatggtgatctatgaagggaaagactcccaggagaaggttaaaagagattacgagattgtgtctaatctgcaagctggcgaatattttaagcagagcgtccacggagtgctcaaggcccagggcatcaacaatctggaggggctcattcccaaattcaaggaatccggcaaaaacatcctgccgcttaagtacattctgaaaaccggaacgatggttatcttttgggagaactaccctgaagagatttgggacatcgataagaatcagctctataagcgcctgttcaaagtgacacaatttgagtctgacgggcggatccaggctagattccatcagattgccaagcccgataacgaactgaccaaagtcagcgagcttgacttttccaatatcgcggaaaagattcgcctgtctaaaggaaacctcaatatgctggtgaacggctacgatttcaagatcaatgtgctcgggcacattgagaagctgagctga

SEQ ID NO: 4090 - RNA, 3957 nt, synthetic construct
  misc_feature 1..3957: note = Cas9 variant
  source 1..3957: mol_type = other RNA
atgggcagcaacatgctgaagaaagactactccatcgggctcgatattggaaccaattctgtgggccacgccgtcgttacagacgattataaggtgcccacgaaaaagatgaaagtgttcggggacaccagcaagaagacaatcaaaaagaacatgctgggagtccttctgtttaatgagggccagaccgctgccgatacaagactcaaacgggggacccgcagacggtacacacgcagaaagaaccggctgcgctatcttcaagaaattttcgcgcctgagctggctaaagtggacccgaattttctctacagactggaagagtcctctctggttgccgaagataagaagtatgacgtgtaccccatcttcggaaaacgggaggaggaactcctgtatcatgatacctacaagacgatttaccaccttcgcagcgccctggctaacaatgaccagcctgccgatctcagactggtctatcttgctctggcccatatcatcaaataccggggcaactttctcctggagggcgaaattgacctgcgcaccacagatatcaataaggtgttcgcggagttttccgagaccctcaacgaaaattctgacgagaacctggggaaacttgacgttgccgatattttcaagaataacacatttagcaaaaccaagaagtccgaggaactgctcaaactgagcggagctaagaaaaatcagcttgcccaccagctgttcaagatgatggtgggcaacatggggtcttttaaaaaggtcctcggaacggacgaggaacataagctgtccttcggcaaagatacatatgaggacgatctgaacgacctcctggctgaagccggggatcaataccttgacatctttgtggcggccaagaaagtgtatgatgctgccattctggctagcatcctcgacgtcaaggatacccagacaaaaaccgttttctctcaggccatgattgagagatacgaggaacaccagaaggacctgatcgaacttaagcgggtgttcaaaaagtatctgcccgagaaatgccacgactttttctccgagcctaagatcagcggatacgccggctacattgatggcaaagtgtctgaagaggacttttataagtacaccaagaaaacactcaaggggatccccgaaacggaggaaattctgcaaaagatcgatgctaataactatctgcgcaagcagagaaccttcgacaatggagcgattcctcatcaggtccacctcaaagagctggtggccatcgttgagaaccagggcaagtactatccgtttcttcgggaaaataaagataagttcgagaagatcctgaactttcgcattccctactatgtggggcctctcgctagaggaaattccaaattcgcctggctgacacgggccggcgaagggaagatcaccccctacaactttgacgagatgattgataaagagacaagcgctgaagacttcatcaagcatatgaccattaatgatctgtaccttcctacggagcccgtcctcccgaaacactccctgctgtatgaaagatacacaatctttaacgagctcgccggagtgcgctatgttaccgaaaatggcgaggcgaagtacttcgacgctcaaaccaagcggtctatctttgagctgttcaaacttgatagaaaggtgagcgaaaagatggtcattaagcacctgaaagtggtcatgcctgccatccgcattcaggccctcaagggcctggacaacgggaagttcaatgcttcctatggaacatacaaagatctggtggacatgggcgttgcccccgagcttctcaacgacgaagtgaatagcgagaagtgggaagatatcattaaaaccctgacaatctttgaggggcggaagctgattaaaagacgcctcgagaactatcgggacttcctgggagaagatatccttagaaagctgtctcgcaagaaatacacgggctgggggcggctctccgctaagctgctggacggcatctacgataaaaagacccataaaacaattcttgactgtctcatgaccgaggattatagccagaactttatgcaactgatcaatgacgataactactctttcaaggaaacaattaaaaatgcccaggtcatcgagaaggaagagaccctggcgaagacggtgcaggagctccctggaagccccgccattaaaaagggcatcctgcagtcccttgaaatcgttgacgagattatcaaagtgatggggtataagcccaaatctattgtcgtggaaatggctagagagacccaaaagacacacggaacccggaagcgcgaggatagagtgcagcagatcgttgaaaacctgaaagacgccaatgagctccctgaaaagctgccgagcaacgctgagctgtccgatgaacggaaatacctttattgcctccagaatggcagagacatgtacacaggggcgcccctggactatgatcatctgcaattttacgacgtcgatcacattatccctcagagcttcctcaaggacgattctatcgagaacaaagtgctgaccattaagaaggagaatgtgcgcaaaacgaacggacttccctccgaagccgtcatccagaagatgggcagcttttggaaaaagctgctcgacgccggggctatgacaaataaaaagtacgataacctgcggagaaatctgcatggcggacttaacgagaagctgaaagaacgcttcattgagagacagctcgtggaaacccggcaaatcacaaagtatgttgcccagctgctcgaccagcgcctgaattacgatggcaacggggtggagcttgacgagaaaattgctatcgtcaccctgaaggcccagctcgcctctcaatttagatccgagttcaaactgcggaaggtgcgcgctctgaacaatcttcaccacgcgcatgatgcctatctgaacgctatcgttgccaatctcattatggccaagtaccctgaactggaacccgagtttgtgtatggaaaatacagaaaggctaaattcaagggcctcgggaaagccaccgcgaagaacacactgtatgctaatgtcctttactttctgaaagaaaacgaggtgtacccgttctgggacaaggcccgggacctccctacgatcaagcgctatctgtacagagcccaggttaataaagtgcggaaggctgagcgccagattggaggcttcagcgatgaaatgctggtccccaaatccgactctgggaaacttctgcctagaaaagagggcctcgatcccgtgaagtatggaggctacgccaaggcggtggaaagctatgctgtcctgatcaccgccgacgaggttaaaaaggggaaaacaaagaaagtgaagaccctcgtgaacattcctatcattgattccaagaaatacgaggccgaccccacagcttatctggcctctcggggatacaccaatgtcacgaacagctttatccttccgaagtactccctgctggaagatcctgagggcagacgccggtatctcgctagcttcaaagaatttcaaaaggccaatgagctgatccttccccagcacctggtggaactcctgtactgggttaacgcgaaagacggggagcagaagctcgaggatcataaggccgagttcaaagaactgtttgacaagattatggaatttgctgataaatatgtggtcgcccccaaaaattctgagaaaatcagacgcctttacgaagagaaccaggacgctacacctatggagctgggaaagaatttcgtggaactgctccggtataccgccgatggcgccgcttccgacttcaaatttttcggggagaacattccgagaaagcgctacaacagcgcgggctctctgcttaatggaaccctgatctatcaatccaagacaggcctctacgaaacccggattgacctggggaaactctga

SEQ ID NO: 4091 - RNA, 3960 nt, synthetic construct
  misc_feature 1..3960: note = Cas9 variant
  source 1..3960: mol_type = other RNA
atgttcagccagagaaacaatccctactgcgagctgctctttaagatcattgtgaccaacatcgaagagaaaaatctggaagtcattatgggcatccggaactccgacattttctttatctctaatttcatgtggtatcaaaaacttatcatgatgattaaaaacatcctggggctcgatctgggaacaaatagcattggctgggcccttatcgaggttgacgaaaacaatattcctatccgcattatcgctatggggtccagaatcattccgctgtctacgagcgataaggaggagtttcagcggggactctccatcaccaaaaaccagaatcgcacagtgtctagaacccagcggaagggctacgaccgcaagcaactgagacggagcgatctgaaaaagattctcaaaaagtataacatcttcccctccgaggagctgcttaaactgcctatgctcgacctgtggaaacttcgcagcgattctgccaatcccaacgaagacatttccgcggagcagctggggagaatcctctacatgctgaatcagaagcggggatataaaagcgctcgctctgaggccaactccgataagaaagacacagattacgtgcaggccgtcaagggcagatatgctcaactgaaagaccggcgccagaccatcggccagtacttttacgaggaactcagcacagccttctctgataagaacaatcagcaatattttagagtgaaagaagaggtttaccctcgggaggcttatattgaagagttcgacaccatcattaacgcccagaaggacaagcacgggtttctgacggataaagtgatccatcagcttagaaatgaaattatctacttccaacgcaagctgaaatcccagaagggactcgtcagcatctgtgagctggaaggctttgagaaaaccgtgtatgacaaggaaaagaacaaaaataaggttgtgttcgtcgggcccaaagtggcgcctaagacatccccgcttttccagctgtgccggatttgggaggtggtcaacaccatctctctcaaaattaagaatcccgagggaagcaagtacaaatggggcgaaaaggttcctaacctgaaacagaaggagatcctggccgattatctctttaaaaatgaaaacctgtccttcagcacacttctggagattctcgaactgaagaaggaggacgtgtacgtgaataaacaaatccttaaggggattaaaggaaacgaggcttacgccgctctgcacaatgtcctcggcgatcatgaactgctgaactttgacgtgtctatcatcacctccgatcacacggccattctcgttgacaagaaaacaggcgagatcctggaagagagagcggggcttgagctggatgccagcctcgaacgcgagcccctgtatcagttctggcataccatttactctctgaaggaccttgatgaatgtaaaaatgctctcatcaagcggtttggactggacgaggacattgccgaaaagctgagccacatcgatttcaacaaacaggcttttggctccaagtctaacaaaagcatgagaaagatcctccctttcctgatggaggggtataattactccgagagctgctctcttgccggatataaccactccaatagcctgacaaaagacgaacgcgagtctcagattaccctcgaacggctggagctgcttcccaagaacaatctcagacaaccgatcgtggaaaagattctgaaccagatgatcaatgtcgtgaacaccattctggagaaatacggcaagccttccgagatccgcgttgaactcgcccgggagctgaaacagagcaaggatgaaagaaatgacacagatcttcagaactcccgcaataaaaagctgaacgaggaaatcgggaagcggctcgctgagctgggactgcccgtgacgaaaagatatattcaaaagtacaaatttatcttcccttctcttagcaagaatctcaaagacgcgcatgtcaacaatcagtgtatttactgcggcgagacctttaacctgacagaagccctgaacggcgatgcttatgacgtggatcacatcgtccccaaggccctcctgttcgacgattcccagaccaataaggtgcttgttcatcggaaatgtaactctacaaagaccaatcagacggcctacgactatattacagctaaaggggaggaagaggtgcgcatctacagcgagagagtcgatgactggtttaagaaaggaatcatttcctatagcaagatgcaacggctgaaagtgtctcacaaggaatacctcgagagaaagaaactgggcaaggaaaccgagaccgacaaaaagctgtgggaaaacttcatcgatcgccagcttcgggacacacagtatatttccagaaaaagccgcgagatcctccaaaaggtttgcaataacgtgaccacaacggaagggggagtcaccgccaagctgagaaatctgtggggctgggatgacattctcatgaacctgcagatgcccaaatacaaggaacttgggcagacaatcaccaaagagtggacatctgaacacggcaagcggaaacatcagaaggaggaaattgagaattggaccaagcgcgatgaccacagacatcacgcgatcgatgctctggtggtggcctgtacgaaacaaggattcatccagcggattaacaccctcaattccagcgagacaaaggacctgatgatcaaagaagttgaggaagccaagattgagtttaacgaaaagaccacactgcttgagaagtacctgaagacccagaaacctttcacgacacgcgaggtcatgaaggaagctgataaaatcctcatttcttttaaggccggcaaaaaggtggctaccatcacaaagttcaaagccaccgggaagaataaagagaccggagtgatcgtcccgagaggcgcgctgcatgaacagagcgtgtatgggaagattaaagttatcgagaaggacaaacccctcaagtacctgtttgagaaccctgataagattgtcaattcccggatccgcgaccttgtggaaacaagactgagcgagaacgaaaacaattctaaaaaggccctctccacggtgaaaaagaaccccattttctttaatgaggaaaagaacgagatcctggagaaggctagctgctataatgatgccaccgttctgaagtacaaacttcaaaacctgaaggctaatcaggtggacgacatcgtcgatgaacgggtgaaattcctcgttaaggagcgcctgacacagtttggatccaaagaaaaggaggccttcaaggacattctctggtttaaccaggaaaaacaaatccctattatcaccgtgagactgttcgcgcggcccgatgccaataaccttcagattatcaagaaagacaagaatggcaaagatattgggtttgtcctgacaggcaacaatcaccacatcgctatctatgaggacaaggattctaagctcgtgcagcatagctgtgccttctggcacgctgtggagcgcaaaaagtacaacattccggccgtcatcaaaaattccgccgacgtttggtctctgctgcttgataaggaactgcctgtcctcttcctggacaaactccccgctgatgagctgaaccttaagtttagcatgcaacagaatgaaatgttcattctgggactgtcccaggagggctttgacgaagcgatcaaaaacaacgacaagtctctcctgagcaagcatctttatctggtgtggtccattagcaataacgattactacttcagacaccacctcgagaccaaaaatacggagctgaagaacatccctacagccaaagactctaagcggtattttagattcaaatccgtgggggctctcgtgggaatcaatcccattaaggttcgcctgaaccatcttggcgaaatcaccaagattggggagtga

SEQ ID NO: 4092 - RNA, 3960 nt, synthetic construct
  misc_feature 1..3960: note = Cas9 variant
  source 1..3960: mol_type = other RNA
atgggctacaacatcgggctggacattggaaccggcagcgtggggtgggccgctctcacagatgagggaaagctggccagagcgaaaggcaagaatcttatcggggtccggctgttcgactccgctcagtctgccgcccaacgcagaagctatcggacgacccgcagacggctctcccgcagaaaatggcggctgcgccttctggaaaacattttctctgatgagatgggaatgatcgacgaaaatttctttgctagactcaagtacagctatgttcaccccaaagatgaggtgaacaatgcccattactatggcggctacctgttccctacacagcaggaaacccacgactttcatgagaagttccagacaatttatcatctgcggctcaagctgatgatcgaggattgcaaatttgaccttcgcgaaatctacctggctatgcaccacattgtgaagtacagagggcacttcctcaactcccaatctaaaatgaccatcggagatagctataatccgcgggactttcagcaggccattcagaactacgcggaggccaagggcctgatctggtcccttaatgatgctcaagaaatgacagacgtcctggtggggcaggccggattcggcctcagcaaaaaggctaaggccgagcgcctgctgtctgcgttttccttcgataccaaagaggacaagaaagccattcaggctatcctcgccgggattgttggaaacacgaccgactttacaaagatcttcaatagagaacggagcggcgatgagctgaaaaagtggaaacttaagctggactctgaagcgttcgatgagcagtcccaagccatcgtggacgaactcgatgacgatgagatggagctgtttaacgccattagacaggctttcgacggctttacccttatggatctgctcggggaccagacaagcatctctgcggccatggtcaagcgctatcaacagcatcacgatgacctgaaaatggtgaaggaaattgctaaaaagcagggactgtcccatcaggacttcagcaaaatctacaccgcctttctcaaggatgacacggataagggcatgaaagccctgcttgacaaggctgatctggccgacgatgttctcgtggagattcaacagcggatcgaatcccacgacttcctgcccaaacagagaacaaaggctaattctgtcatcccttatcagcttcacctggctgagctcgagaaaattatcgaaaaccaagggaagtactatccctttctgctggataccttcacaaataaggccggagagaccattaacaaactcgtggaactggtgaagtttcgcgtcccttactacgttggccccatggtgaccgccgctgacgtggagaaagccgggggagatgctacaaaccattgggtcaagcggaatgaaggctatgagaaaagccctgtgacgccgtggaacttcgaccaggtttttaatagagatcaggccgcgcaggacttcatcgaccgccttaccggcacagatacctacctgattggggaacccacactcctgaagaactccctgaagtatcaactttttaccgtgctcaatgagctgaacaatgtcaaaatcaacggacacaagatcgacgagaaaacgaagcatgtgctgattcaggatctcttcaaaagcaagaaaacagtttctgaaaaggccatcaaggactactatctgtcccagggcatgggggagattcagatcgtgggacttgctgataaaaccaagttcaatagcaacctgtctagctacattgacctctccaaaacctttgatgccgaatttatggagaatcctgctaaccaagagctgctggaaaatatcattcagatccagacagtctttgaggacgtgaagatcgccgaacgggagcttcaaaaactcgcgctgcccgatgaacaggtccagcagctggccaagacccactatacaggctgggggaacctctctgacaagctgcttagcacgcctattatccaagagggctcccagaaagtgagcattctgaataagctccagaccacatctaaaaacttcatgtccatcattaccgataacaagtttggagttcagcaatggatccaggagcagaatacagctgaaaccgccgacagcatccaggatagaattgacgagctgacgaccgctcccgccaacaaacgcggcatcaagcaagccttcaatgtgctgtttgacattcagaaggctatgggggaggaaccgaaccgggtctaccttgagttcgcgaaagaaacacaaaattctgtgagaaccaactcccgctacaatcggctcaaggatctgtataaaagcaagacactgtccgacgatgttaaagccctcaaggaggaactggagtctcaaaagagctcccttcagtctgaaagaatcggagaccggctgtacctctattttctgcagcagggcaaagatatgtacaccgggcaacctattaacatcgacaagctgagcacggattatgacatcgatcatattatcccccaggcttacacaaaagacgattccattgacaatcgcgtgcttgtcagcagacctgagaacgcccggaagtctgactccgccacctatacaaccgaagtgcagcagagcgctggaggcctctggaaatctctgaagaatgccgggttcatctcccagaaaaagtacgatagactgaccaagggcggagactacagcaaaggccagaagacagggtttattgcgcgccagctcgtggagacgcggcagatcatcaaaaacgttgcttctctgattgagagcgagttctcccaaaccaaggccgtcgccatcagaagcgaaattacagctgatatgcgcagacttgtggccatcaaaaagcaccgggaaattaattcttttcaccatgcgttcgacgctctgctcatcaccgccgccggacagtatatgcaggctcgctaccccgatagagacggcgccaacgtgtataatgagttcgattactatacaaacacctacctgaaggagctgcggcagtccagctcctctagccaagtccgcagacttaaaccctttgggttcgtggttggaacgatggctaagggcaacgaaaattggtccgaggacgatacacagtatctgcggcacgtgatgaactttaaaaatattctcaccacccgcagaaacgacaaggataatggggccctgaacaaagaaacaatctacgcggtcgaccctaaggccaagctcatcggcaccaataaaaagcggcaggatgtgtctctgtacggaggctatatttacccgtatagcgcttacatgacacttgttcgcgccaacgggaaaaatctgctcgtgaaggtcacgatctccgctgccgagaaaattaagtctggacaaatcgaactgagcgagtatgtgcagcagagacccgaggttaagaaattcgaaaagattctgatcaacaaacttgccatcggccagctggtgaataacgacgggaatctcatttacctgacctcctatgagttttaccataacgctaagcaactctggctgcctacagaagaggcggaccttatcagccagctgaataaagattcttccgacgaagatctcattaagggattcgacatcctgaccagccccgccattctgaagcggtttcctttctacgagcttgatctgaaaaagctcgtcaacatcagagacaaatttatcgctgtggagaacaagttcgatattctgatggtgatcctcaaagccctgcagcttgacgccgctcagcaaaagcccgtcaaaatgattgataagaagtctgccgactggaaagattatcgccagcggggcgggatcaagctgtccgacacaagcgaaattatctaccagtctaccacgggcatttttgagaaaagagttaagatctccaatctgctctga

SEQ ID NO: 4093 - RNA, 3963 nt, synthetic construct
  misc_feature 1..3963: note = Cas9 variant
  source 1..3963: mol_type = other RNA
atgaccgagcagcaaagaccctacaacatcggcctggacattgggacaagctccatcggatgggccgtgacggatcagaatgacaagctcctgcacattcggggccataacgggatcggagtccgccttttcaaagaaggcgagtctgctgccgaaagacgggggtttcgcaccacaagacggcgcctgagcagacggcgctggagactccggttcctggatcgcatttttgacgcggagcttgctaaggttgatcctaatttcctggccagactcaaacagtccaacatctctccgctggaccccaataagcagatgtttggaaacatcctgttcgatgacgcccaatttgatgaccagaaattccaccagcagtatcctaccatttaccatctccggagcgctctggcccaacccgatgctcctcaggccgacgtgcgccttatctatctggcgctccaccatatgattaagtttagaggccacttcctgaatggcgccgctgtggaaaagtttcacgggggacagcttcatctggaggccgagttccaggaactcaaccaaatcttttccaatcagcagcgggatcacgtccaactgcagacatctagcctggacgaggtggctaccattctcaaagacaaccagagaacaccctccgatcgccagcgggaactgagcgccagacttttcgttcctgtggacaagaccatcgataaagagaataagaaactggcgacggagctcctgaaggccgtccttggcctgaaggctaaattcgacgtgattctcggggttgaagccaccgatccgcaggcttttaagctgcaattctcttccgacgattttgacgataaaatcgccgagctggccagcgaactcacagacgaggctaacgaaatcctgaccgtgcttcagcgcctgtacttctctctcaatctggcggatattcttacaaaccggcagaccaagcaagtcgccgactccatcagcacggctatgattaatagatatgacgatcataaacaccacctgaagatgctcaaagagctggagacacaggtgacccaggaacagcgcgacggactgaagaaggcctacgatgagtatatcgacggcgataaacccacaattgacaccttttacaccaacgtgaagaaaaacctcgatgactctgaactggccaatcaaatcaagtcccttatcgatctgcaggctttcatgcctaaacagcggagcaaggagaacgggtccattccccatcagctccaccaaagagaactggaccagctgatcgaggtccagggaaagtactatccttggcttctcgccgcgaaagataagctggacgctctgattgcctttcgcgttccctactatgtgggcccgatgatcgatcctaatgagtctgacgacccccaaaacacaaaattcgcctggatggtgcggaaggaagctggcgagattacgccttggaattttgaagagaaagtcgataagaccgggagcgccacaaacttcatcaagagaatgaccacaaccgacacgtacctcctgggagaacccgtgcttcccaaaaattccctgctctatcagcagtttacagttctgaacgagctgaataaacttaaagtggatggcaaggctctcaccgtcgaccagaaaaagtacctgtatgagcatgtgtgcaagaaacaacgccgggttaccctgaagaaactcagcgattgtctgatggccagaggggacttccctatgggagcgatctttacaggcaccacagatcagaagaacatgaataacacgcttaaaacctaccaggacttccaggaaattttcggggatgagatcgacaatccggatcggcaagtggactttgaaaagatgattgagtggtctacaatcttcgaggatcgcgaaatttttaaactgaagctcgccgagctgaactggctgacctccgaacagcttgagagagtcagcaagaaacggtaccagggatggggcagactctctcagaagctgctgacacacatcgtgaatgaaaacggcgagcgcattatcgaccaactctggaacaccaatcagaacttcatggagatcatggggcaggacggagtcaaacaagctattcaggaacataatggcgccaacgtggctcagacggggatcaatgagaccattgatgaactgtatacaagcccccagaacaagaaagccatccggcaaattcttctggttgtggacgatatcaagaaggcggtcggatacgcccctgctaatatcatgatggagtttgccagagaagaccgcgatgaccacagactcattgcttcccgggcccgccagctggagaaaacctatcaggagatctctaagaactggttcgataatgaaagcgtgacacaggagctgaaagaccaaattaagaacaaaaccaagtttacggatagactttacctctatttcatccagggcgggattgacctgtacacaggccaccccctgaatatcgatcagctctccagctatgacatcgaccatattctgcctcagtcttttcttctggataactccctcaataaccgggttctgaccagccaatctgaaaatcgcgtgcacaaggaggacagactgcccggagaaacagtcgccaacaaaatgcggccgacctggaagatgatgcgcgagcagggccttatgacccagagaaaatacaacaatctgacactcaagcctgatcagatctccaaattcaacaatcgggggcaatttattaaccgccagctggtggagacgagacaggtgatcaagctcgctgcggacattatgaatcaaaagtaccaggccgatcagaccaaagttgtcacagtgaaggctaacctgacccatcacatgcgggaaaaattcaatttttataagagcagaaacgtgaatgactaccaccatgccttcgatgcctatcttacagtcttcgtgggaaactggctgctcaaagagtaccccaagctgcagccttattttgtttacggcgacttcgctaaaaccgggacgaataacctgaagtcctttaatttcctttatcgctttgaacgggatcacaagctgaacgacaaaggagccatcgatacagacaaggatcaacagctcggctacatgaaaagaatctaccgcttcaagaaaatgctggtgaccaagcagctcgagaccaatgagggggcgctgtataagcagacaatttacaaagctcccgccaacgaaaagaacaccaaaaagaatcggtctcttatcaacacaaagaagaatagacctagcgacatttatggcggatactcccaatctgtcacggcctatatgagcctggtgtttttcaagaacacctttaaactcatcaagatgcccctggttgctgccaatgcgattaaaaactccctgagctcttaccatgacacaatccttaagattctgggctccaatgagttcaaagtgctcatcccgaaggtcaagatgaaccagctgatcaaagaaggggatagcctctataccgtggttggagtgtacaagcacaatgctcagcagctgattctttctgacaactccatgggcatcattacaaaacctatccgcgagatttgcgatagcgacctggattctgtctttaatgaactggtggacaacatcgataagtacctcaatctgtataaaatcgaggacaaacttaccattaaggagaagttctacgccctgaagaacaaagaaagcaagttcaaatgtatctccgatattctcgtggggacgcattgcaatgccggacggagcaacctgaagatcattggcctctcttcctattgggggatgtttagcggcaataacgacggactgaaaatcaacgaaaattcccaacttatctaccagtctcccaccggcctgttcgagcacagagtcaaggttagcgatctgtga

SEQ ID NO: 4094 - RNA, 3972 nt, synthetic construct
  misc_feature 1..3972: note = Cas9 variant
  source 1..3972: mol_type = other RNA
atgaaggacttctacatcggcctggatatggggaccgacagcgtgggatgggccgtcgctgatgaggactataacctctgcaaatttaagggcaaagccatgtggggagttagactgttcgatgaatccgcgacagctgccgagcggcgcggatttagaacggcccggcgcagagctcagcggaagcgccaacggattctttggctgcagatgcttttcaatgaagagatctctaaaaaggacattgcctttttccagagactgaacgaaagcaagctctacctggaggataaatccaccaatgtgccctatgctgtgtttgccgacgagtctttcacagatgtcgactaccacaagctctatcctaccatctaccatctgcgcaaagaactggtgcagagcgatgagccgcacgacgttagactcgtgtatctggcgcttcatcacctgattaagaaccggggccattttctcttcgaaaatgtcgggtccgattttgagaaagagtctagcttcgaagtgctgtttaagaaccttcaaaattacatcctgggagagtacgaactcgccctggagtgtatcagccccctgcagattgctgacatcctcaaggacaaatccaagcgcaaaacaaccaagtcttccgaaatttgcaaactgcttggcatcagcaagaaaggccagcctagactgaacgccattgttctcctgatgtgtgggcagtctgtgaaacttgctgatctgtatggagacgagaattacaacaaggaggaaaaatccagcatctctttcgagaagggctatgaagataatgaggaaacataccgggagctcctgctggagcgcttcgaactcattgagaaaatcaaggccctgtatgactgggcgatccttgccgatattctgaaaggggaaacctacatctcctttgctaaggtcaagacgtatgacgagcacagacacgatctccaacagctgaaagccttcgtgaaggaacggtgcagaagcgactacaacgagatttttcgcgagacctccgataaacttaataactacacagcttattgtggaaagttcaaagaaaatggccggaacggggtgatcctgcattctgccaaccagaccgacttttgcaagtacctcaagagcaaattcgataagctggacaaatccggatatgaggacatgtttgaaaagattgagaatggcagcttcatgcccaaaatcgtcgttaaggataacggcgtgatccctatgcaagtgaatgagtctgaagtcagagccattctgaagaacgcttccgggtacctcgactttctgaataaccaggataaagacggaatcacagtggcggataagattcttcagatcttcgagtttcgcattccctattacgttggccctctgaatgtgcacagcgacaactcttggctcgtccggaaagatgggaagatctatccgtggaatttcaacaaaatcgtggacgttgataagagcgccgaagagtttattaataaactgaccgctaagtgtacgtacctgcccgacagagatgtgatccctaagaactccattctttactctcgctatatggtcctcaatgaactgaacaatctgaaactcgacggaaagaaacccgatgtgagcttcaagcaggccgtcttcaacgacctgtttatgcatcggagaaaagtgacacaaaaggcccttcgcgagtacatcaaggctcagaccggcacagagcctgaaattaccgggatcgacggagatttcaaagccaacatgcggcccgcgattgagctggctggctataatctctccgaaccggacaaggaggaaatcatcaaagccattaccatctttggcgatgacaagaaactgctgaagagacgcattaaggataaatacagcgagatgctttctgaggacgaaatcaagaaaatttgcaagctcaaatataaggattgggggcggctgtccagagagttcctgacagaaatctttgacgttgatacggccaccggagagtgtaaggacaacatcattaatacactctggaacaccaatgataacctgatggaacttctgggcgctaaatacaatttcacacagagcatcgagcaggccatttctaagtccacccacaaagctagcatcgagaagatggtggaagacatgtatgtctcccctaaagtgaagcggacggtttttcaatctctcaaaattatgaaggagatcgtgaagatcaaagggcacgcccccaagaaagtcttcgtggaaatgacacgccatgatggaaccaagggcgacaacgggagaaccaaaagccggaagaagcagctggaggagctgtacaaaaagtgcaaagaagactccacagagctttgggatgaactcgagaagaccgacgatgacgaatttagacaggataaactgttcctgtactatacacagatgggccgctgtatgtactctggagagcggattgagctcagagacctgtttaataagaacctttatgatatcgaccacattttccctcgcagcaaggtgaaagatgactccatcgataatagagttctggtcaagaaacaaattaacagccataaggacaatgactaccccctcgattctacggtgcgggaaaagatgcgcggccactggcagtatctgctgagacatgggtttatctccaagaagaaatacgaccggcttacccgcgtgacacccctcaccgatgacgagctggcggatttcatcgccagacagctggtcgaaacaagccagtctaccaaggctgtggccacgctcctgaaaaccctttatcctacaaccgagattgtttacgtgaaggctgaactggtctcccggttccgcacagagtacaaatttatcaagtgcagagaggtgaacgacctccaccacgccaaggatgcgtatctgaatattgttgtgggaaacgtctacaacgtgcggtatacccatagcaaagccatcttcattaagggcctgcaaacgaaaaagtactctcttaatcgcatgtttgctttcgacacaccgggggcctggaacatcgaaaatgagaaaagcctgtccattgttaagaaaaccgtgatgaagaacaatatcctctatacaagatacagctatatgaagaaaggaggcctgtttaagatccagcccctcaaaaaggggaacggccaggctcctctgaaaaaggatcttcccctgtctgacattggaaagtacggcgggtacgataaacctaccgcctcctatttcagctacatcaagtatgaagggaaaaagggcaaagagtgccggcagctcgtcgccattgacaattacctgaagaagtattacgaagagaaccccatcgagtatctgaccaatagacttgggctgaaaaacccggctgtgctcattcctgtgatcaagtacaattcctgtatcgaaattgatggatttcgcatgaacatctctagcaaatccaatgagggcaagacaattgtctacaaacccgcggttcaactggtgctcggggccgaaaaggaggcttatgtgaagaaaatctctaaggtcctgagcaaacctgaggaacagaagattacgtcctacgacggcgtgtctgccgaggaaaacatcgagcttttcgacgccctgaccgctaaaatgacaaataccatctttaagattaaactcgaagatatcggaaacaagattaagagcggccgggacaaattcgttacactggatgtgaagaaacagtgctatgtcatcaacgagattctgaagatcatgcactgtaatgtggttaccggggacctttccctgattggagccgcgaaaaaggctggcatcgtgagcacgaactctgccctctccgagatcaagaaagtcagctctattatgctgatcaatcaatccgtgacagggctctttgaaaccaagattgatctgcttaacatctga

SEQ ID NO: 4095 - RNA, 3975 nt, synthetic construct
  misc_feature 1..3975: note = Cas9 variant
  source 1..3975: mol_type = other RNA
atgagagccaagggcaaaaccctgatcgggacaagcctcttccgggagggaaacacggctgccgaacgcagaggctaccggaccacacagcgcagactgaagcggcgcaaaagacggcttaagctgctcgaggcgtttttcgacccctatatttttgaagtggatgagaatttcctggctcgccttcacgaagccgacatctcccctaaagatgagaacaagagattttgggggtctctgctgttcccgaatgagaaggacgccaacttttaccggaaatatcccaccatttaccatctgcgcaaggctctgatggaagaggatagaaaattcgacgtccgggccatctttctcgctattcaccatatcatgaagtatcgcggaaatttcctgagccctctttccgttgattcttttaaacaagaaggcctggagctcaaggagcagctggacagacagcttaagcgggtggccgaactgtacaacgagctcaatacagatgtgaaaatcaacgtcagcgacgtggaaaccattcaggatatcattatcgacaagaataaatccagacgcgataaggcgggggccctgaaaaagctgctcgctgtttctagcgaccggaaagagattaacaagctgaatgcctcccttgctaaggaactgagcaacgccatcctcggaatgaaagcgcaattcgccaatctgcttctggctgacgatctcgagattgacaagaacaaaaagaatttttctctgctggatacaaacgccgaggaaaacgtgtccggcctcctggagcttgtcaatgaaaaacaggctgagctgttcgacgccatcaagaccatccacgatcagattatcctcaacgaaattgtgcccgacggcaagagcatctctcagtccatggttgataaatatgaggcccatagagagcaactccaggtgcttaaggctctgtacgaaaagatggacgcgaagcagattaaagccatcaagaaggcttacagcctctatatcgatgggaaagaccctaaggccaaaaaggtcgataaacgcgcccaccagaatcgggctgacttctacaaggaggtgaagaaagtgctggtcgaactggacgattctagagccgagaagctcctgggacttattgaaatgggccaatttctgcccaaacagcgcacggcgatgaacggggttatccctaatcagctccaccaagtggagctggacaagattatcgagatgcagtccaaatattacccgtggctggctgaaaagaaccccgtgaaaagccatcagaagcgggccccttataaacttgatgagctcctgaccttcagagtcccctactatgtgggacctatggttacatccaaaaagcagcaacagacctctaatagcaactttgcctggatggtgcgcaaacaggaaggcgagattacaccctggaatttcgaggaaaaggtcgacaccatcgcttccgccaacgattttatcaaacggatgacggctaaggacacatacctggtgggggaggatgttctcccggccaatagcctgctttaccagagatataaggtgctgaacgaactcaataacattaaagtcaatggacgccggctgcctgtggagctgaagagagaagcgtacgtcgcccttttcgagaacggcgactctaaaaccgtgtccgctaagtgctttaaaaactggctcaatgttaagctgaagaacctgaatagcctcaaactggagggcctttctacagggaccaagttcgataacaatctgagcacctatcacgacctcaaaaagatctttggaaaagccgtggatgacgctggccggcaaaaggatttcgaacagattatcgagtggctgacaatttttgaagacaagaaaatcctgcgcattaaacttaaagagatcgaatggctcacggaggagaacatcacccagctgacaagactgaattacaacgggtggggacggctctccagacgcctgcttaccggcatttgtgactctaatgggcagcggatcatggattggctgtgggacacaaccaacaatttcatgcaaattcagagccagcccgattttcagaaggccatcgtcgaatataactccgacaaactcgagcaaggagatattgaacagatcctgggcgaggcgtacacgagccctcagaataagaaagccatcagaaaggtgattaaggttgtgcaagacgtcgaaaaagctatgggcgccaagcccacatctatctccattgagttcacccgcagcgatgggagatctgagctgaccaactcccggatgacacagcttcagaaaaccctcatgagcctgtccgaagagatgacagaccaggctctgctcgccgagttcaaggattttcaagcctctaaaaagaagctgacgaataaatattacctttacttcacccagctgggacgcgacatgtatacaggcgaacccctcaacatcgatcagctgagcctgtactccgacggggatcatattcttcctagatcttttatcaaggacgacagcctggataaccgggtgctcaccaaacgcgctgtgaataacgagaagtccgacacagttccggtctgcgaatatggagcgaaaatgaaggatttctggaatgacctgtacgataacggcctcatcagcaagcagaaactggccaatcttctgaccgaccccgatgagattgggccttataaggctaacggctttatcagacggcaactcgtggaaacgtctcaggtgattaaactgtccgccgagatcctgcagaccctttaccaggacacaaagattatcgaagtccgccaaaaatatacccacgagctgagagagcacttcaattttgtgaagatccggcagctcaacgattaccatcacgccttcgacgcttacctgacagcctttagcggacgctatctctaccagagatatcccaagctgcggggctacttcgtttatggggattacaataaatttgacgcgaagaaagacagaaactatcttaagtcttacaatttcctgtacgatctcgaagagggaaaaaccgaccaaattgtggataacgtcgaacataaggtgtttatgaatcgccaggacgctatcaaccagctgaagaaagcctatgagtacaagtatatgctggtttcccaggaaacgtacacaaatagcggcgccatgttcaaagagaccatttatcctgtgaaccccaagcaaaaacttatccagaagaaaaacgataagccggtcgacatttacgggggatattctaataactacgatgcttacctgagcatcgtgcggctcgaggacaagaaaggcattaagttcagagttgtggggatccctatgcgcaataaagccgaactggataacctcgcgaaggaggaccacaatggctatatgcagcggctgaacgaaatcgtcgatgagcagattaattccagcggaaagaagaagacatttagaatcattcttcccaaagtgcatttcaagcaactggtggaagacgattctggcaaatttatgctggggtccgctgcctacccttataacgccaagcagctcgtcctgagcgttaaatccatcgagtctcttgctaataaggacgccagcgaccgcgagctggtggctgtgtacgaagagattctcaacgtcgtgaatgataagttcaccctgtatgacgcccggcagtttagaaacaaactcacctcctctaaggataaattcgttgaactgaatacagcggacaaggtgacggagcttctggatatcctggacggactccacgccaaccccgtcgtgaaaaagctgaagatcattagcggctccccttttgggttccttcagcgcccctctggaatcgttctgaccgagaatgctaaactcatttaccaaagcccgacaggcatctttgaacgggtggtctatctgagagatctctga

SEQ ID NO: 4096 - RNA, 3984 nt, synthetic construct
  misc_feature 1..3984: note = Cas9 variant
  source 1..3984: mol_type = other RNA
atggagggccagatgaagaacaatgggaacaatctgcaacagggaaactactatctcggcctggacgtggggaccagctccgtcggatgggccgttacagatacggactacaatgtgcttaaattcagaggcaagtctatgtggggagctcggctgtttgatgaagccagcaccgcggaggaacgcagaacacaccgggggaaccgcagacggctcgctcgcagaaaatatcggctgcttctgctcgagcagctgttcgaaaaggagatccgcaaaattgacgataatttcttcgtgagactgcatgagtccaacctctgggccgacgataagtctaagcccagcaaatttctgcttttcaatgacaccaactttacagataaggactacctgaaaaagtatcctaccatctaccacctccggtccgatctgattcataattctacagaacacgacatccgccttgtcttcctggccctccatcacctgattaaatatagaggccactttatctacgataacagcgctaatggcgacgtgaagaccctggacgaggccgtttccgatttcgaagagtacctcaacgagaatgacatcgaatttaacattgagaacaagaaagaatttatcaatgtgctgagcgataagcatcttacgaaaaaggagaaaaagatttctctgaaaaagctctatggggacatcaccgattccgaaaacattaatatcagcgtcctgattgagatgctttctggatccagcatctctctgtccaacctctttaaggacatcgagttcgatggcaaacagaatctgagcctggactccgatattgaagagacactcaacgacgtggttgatatcctgggggacaatattgaccttctgatccacgctaaggaagtgtacgatattgccgtcctcacctctagcctgggaaaacataagtatctttgcgacgcgaaagtggagctgttcgaaaagaacaagaaagatctcatgatcctgaagaaatacatcaagaaaaatcacccggaggactataagaagatcttttccagccccacagagaaaaagaactacgccgcttattctcaaaccaattccaaaaacgtgtgtagccaggaagagttctgcctgtttattaagccttacattcgggatatggtcaaatctgaaaatgaggacgaagttcgcatcgccaaggaggtggaggataagagcttcctcacgaaactgaagggcacaaacaattccgtggtcccctaccagattcacgaaagagagcttaaccagatcctgaaaaacatcgtggcttatctcccttttatgaatgacgaacaagaggatatttctgttgtggacaagatcaaactgattttcaagtttaaaatcccctactatgtcgggcctctgaacaccaagagcacacggtcctgggtgtacagaagcgatgagaagatttatccgtggaatttctctaacgttatcgaccttgataaaaccgcccatgaatttatgaatcgcctcattggacggtgtacctacacaaacgaccccgtgctgcctatggactccctgctctatagcaagtacaatgtcctgaacgagatcaatcccatcaaagtgaacggcaaggcgattcctgtcgaagtgaaacaggccatctacacggatcttttcgaaaattctaagaagaaagttaccagaaagtccatttatatctacctgctcaaaaacggctatattgaaaaggaggacatcgtgagcgggatcgatattgagatcaaatccaagctgaagtctcaccatgactttacacagattgtccaggaaaataaatgcacccccgaggaaatcgagcgcattatcaagggaatcctggtgtacagcgatgacaaatccatgcttcggagatggctcaagaacaatattaaaggcctgtctgaaaacgatgttaagtatctggctaagctcaactacaaagagtgggggcgcctgagcaagacacttctgaccgacatctatacgattaatccggaggatggagaagcctgttccatcctcgacattatgtggaacacaaatgctaccctgatggagatcctgagcaacgaaaaataccaattcaagcagaatatcgagaactacaaagccgaaaattatgatgagaagcagaaccttcacgaggaactcgacgatatgtacatttctcctgccgctcggagatccatctggcaagcgctgcgcattgtggacgagatcgtcgacattaaaaagagcgcccccaagaaaatctttattgaaatggctcgggagaagaaatctgccatgaagaaaaagagaaccgagtcccgcaaggatacactgctcgaactgtataaaagctgcaagtctcaggccgacggcttctacgatgaggaacttttcgagaaactgagcaatgaatccaacagccggctcagacgggaccagctgtatctgtactatacccagatggggcgctctatgtacacaggaaagagaatcgattttgacaaacttatcaatgataagaacacgtacgacattgatcatatctatcctcggtccaagattaaagacgatagcatcaccaatagagtgctcgtggagaaggacattaacggcgagaaaacagacatctaccccatctccgaagatattcgccaaaagatgcagcccttctggaaaatcctgaaggagaagggcctgattaatgaagagaaatataagcggctcaccagaaactacgaactgacagacgaggagctttctagctttgttgctcgccagctggtcgaaacccagcaatccacgaaagccctcgcgaccctgctgaagaaagagtatccttctgctaagatcgtgtacagcaaggccgggaacgtgtccgagttcagaaatcggaaagataaggagcttccgaaatttcgcgaaattaacgacctgcaccacgccaaggatgcttatctcaatatcgtcgtgggaaacgtttacgacacaaaattcaccgagaagtttttcaataacatcagaaatgagaactactctctgaaacgggtgtttgatttcagcgtccccggcgcctgggacgctaaggggtccacatttaataccattaagaaatatatggccaagaacaatcctatcattgcgttcgccccctacgaagtgaaaggagagctctttgatcagcagatcgttcctaagggcaaagggcagttccccattaagcaaggcaaggacatcgaaaaatatggaggctacaacaagctgagctctgctttcctttttgccgtggagtataaagggaagaaagctcgcgagagatccctggaaacggtctacattaaggatgtggagctctatctgcaggacccgatcaagtactgtgaaagcgttctgggacttaaagagcctcagatcattaagcccaaaatcctgatgggctctctcttctccattaataacaagaaactggtggtcacagggcggagcggaaagcagtacgtgtgccatcacatctatcaactctctattaatgatgaagactcccagtacctgaagaacatcgccaaatatcttcaggaggagcctgacggcaatatcgaacgccaaaacattctgaacatcaccagcgtgaataacattaagctctttgatgtcctgtgtacaaaattcaattccaacacctacgagatcattctgaatagccttaagaacgacgttaatgaagggagagagaaattttctgaactggatatcctcgagcagtgcaacatcctgctccagctgcttaaggcgttcaaatgtaatcgggagagctccaacctggaaaagctgaataacaagaaacaggccggcgtgattgtgatcccccatctctttaccaagtgctctgtcttcaaagtgattcaccaaagcatcacaggactgtttgagaaggaaatggaccttctgaaatga

SEQ ID NO: 4097 - RNA, 3984 nt, synthetic construct
  misc_feature 1..3984: note = Cas9 variant
  source 1..3984: mol_type = other RNA
atgaagaactacagcatcggcctggacattgggaccggatccgtgggctgggtctgcatcgatgagaattatcagattctcagatacaacaatcgggccgctttcggggttcacgaatttgagacagcccatgtggcggaagaacgcagaatcaagcggggagctcgcagacggtataaccgcagaaagaaacggattcaactgcttcagtctctgttcgtgccccacatgcagcagaaggcctttttcgcccctacgatcaccgaacattactggaaaaatgacaaccaatttgagaatcgcacactcagcgaggtcctgatgtcccttggcatgaacccgaatacctatcccacaatcttccacctgagacatgaactcattgagtctagcgtgaagaaggatgctcggctgatctacctggccctccacaacctggttaaatttcgcgggcacttccttcaggaaggatccacctggaatgctaacatgtctgacgccaatctgagcgagcagtttgagcagctcctgcatatttatacagaaatggaggaacttcctcaagtgtccctgaccgcgcagcagagcacggatgtcgagcacatcctcctgaacaatcatatttctaaggccgaaagagctcggcagctgaccgccctcttcgagcgcacatacgagccctttttcaaactgatcgtgggccttgacattgctgccgcgcaactgtttaagcagtccgaacagcaactcctgtacaaagagagcaagaccaaggttaaccttacagccgaaaccctgcctgaggtgctccagacgatgctggaacccgaggtcgctttcatcgaggccgtgcagcctttctatcagcaaacagtgctgtttgatctcctgaaaggccagtcttacgtcgctgccgccaaggttgaggctttcaaccagtatgagagagaccttgcgctgctcaaatccgtgatcaatgaagtggggagcgagaagcagtaccgggcctttttcattacctctaaacaaaagaaaagacagtttgaacagaagccgaacatggagctgctttgtcacctggatcgcttcaatcgggagaagaaatatgaagagacattttacaaggaagtctccaaactcctgaccgctctgatcaaggaggccaccggagaggtgaaagaacacattgagcagatcattcaagccatggaaagccagtccttcctcgttaagcagaagggcatccagaacgcttctatcccctatcaaaatagcctgtacgaggccgaaatgattcttagaaaccagcaggcgtactatccttggatcacagacgagtttattgagaaagtgaagcaactgatcgctttccgcattccctactatatcgggcctctcgtccagggagatgaacagccctttggctggctgcagcggcaagccgacgggaatatcacgccgtggaacttcgatgagaaagtgaataaggccgcttccgccgagagctttattaccagaatgacaaagaactgcacctacctgaaggaggaaaaggttcttcctaaacagtctctcatgtatgagaagttcacactgctgaatgagctcaactccgtgcagatccgcagctctctggaacagccccataaaaagcaccggctttgtgaggacatgaaacaatggattatcgaacatgtcttcaagaagaccaaaacggtgacacacaagaccctgattcaggctctcaaaaagagcccttacaaagacgagctgtatgatgaatccaccggaaattggaaggacgtctacggcacacagaaagaggatagatttgcctctagcctgtccacctacatcagccttaaggagattgtgggcgacatcgttgataacgcgttcatggaagagatcatttattggctcacagtgtttacggaccgcgatatcattaccctgaagatgaatgacaaataccccttcatcacagaacagcaaattcagcggctgctctctctgaacatctccgggtggggacagcttagccaaagactgctccagtctatccccgtcgatgacatgaaccgctccgtgattgagtatatggagaagcatgccgttaattttatggaactgctgagccctcggcagtccgatcttgcttacaaaatcgaacaggtgaacaagcaacactctaaaaagattcacaagatcagatatgaagacattgagcagctcaccggcagcccggccctgaaacgggggatctggcgctccgtcaagatcattgaggaactgacagctatcttcggagagcccaaaaatattatgatcgaagtggccagagaggaccaggcgtctcatcggaccaagagcagaaaagaacagtgggagtccattggcaagagcctcgccaaggaagagaaagagctgaaggcctttttcaaagaaatggctcaataccctaagcagcagtttgatcgcacgcggttctggctttatgtgacccagcaagggaaatgcctgtacacaggaaagaccctcagactggaggacctgtcttcctacgaaatcgatcacatccttccccgcaactttgttaaggacgatagcattgacaatctcgctctggtctatcctatggccaaccaggagaaaaataaggccggcaacaataaaatgcccctggaaatcattgatgctaagcagcagccggcgatgatggcccattggaaaagactcaaccaactgaaacttatctctgactccaaactgcacaagctcatgaagcctagcttcaatgatgtggacaaagagaactttattgctcggcagctggtggagacacgccagatcattaagcacgtcagagatctgcttcaagaacggttcgagcataccgacatccacgtggttaaagccaagatggtgtctcagttccgcaaatttagcagaatccccaagattcgggattacaataacaagcatcacgccatggacgctctgttcacgacagtcctcatccagtttattctgcagaaatatggcaagaatttcctccaatttgacctgcagcataaagatatctccaagaaatggagcaagattgcccagtctaccaagcacttctttcttttccagcaatttgcggaacagcagatcaaatcccctgtgacaaaggagctggttagcggggtgcagtacttcgagcacatcttttatgaacaatcctggcagaccaccaaaatgacacagacgattgactctaacttctacaaggagaccatcttcagccccaaactcaagacagctaagtatacctccgccaaagccgaaaagtttgtccatgatgctattgtgaaatacgccgtttgtggaatccaatacacatctctgaagaaaaacaaggagcagcaccatgtgctgcttaccgacattaatgtcatcgaacactatcagctgaaggaggcgagcctcaacgagctggctctccatctggccaaacgcgaatccaaggatgacgtgatcgatgcccagatgcttgtggtcattcctaaatacaagaaaatcatgctgaatggctctccctattactgcattagctccgacgagagacacatcgctacgcaattcgttctccggaaggatctgctggaagccgtgcttcacgtgaacgacgagacaagcgtcgatgaactgcgcaccctctttagatctattgtggaggagatgatgacccagtataaagtttacaataaggacacaatccggaacaagattgatgctttcatcgaaaccgagctgatcgacgtggaaacatttcaggtcgggttcacggagattaaaaagatggtggccgcgaatgcccagagatccgacaaatttggaggccgcctccggcaagttatgaaggtggaagatatctatattatcgacgagagcattaccgggctgagataccgcaaaccgcggaaacttgtcaagtga

SEQ ID NO: 4098 - RNA, 3984 nt, synthetic construct
  misc_feature 1..3984: note = Cas9 variant
  source 1..3984: mol_type = other RNA
atgaagaaaaactacaccatcggcctggacattgggacagccagcgtgggatgggctgtcctcacggaggattatgaactgatcaagagaaaaatgaagatttccggcaatacccagaaaaaggccgttaagaaaaacttctggggagtgcggctttttgagcaaggagaaacagcggagggccgcagactgaagcggaccacacgcagacggatcgctcgcagacggcagcgcattcagtacctcagaaccatcttcgacgaagggatgaatcaggtggatgccaactttttcgcccggctggacgagtcttttagcatcattgatgagaaagaaaatgagcgccaccccatcttcggaaacgtcgctgaagaggccgcttatcatgagcaatttcctacaatttaccaccttagagaacatctggccaattcctctgagcaggcggacctccggctggtgtatctggccctcgctcacatcattaagttccgcggccattttctgatcgaaggcgagcttaacaccgaaaatagctccgtttctgggacgttcgagcagtttattaaagtgtacaacgagaccttcaatgtcgaaaaggccctggatctcacagtggacctggatggaatcgctgagcagaagatcagcagaatgaaacgggccgaacttattctgtccctctttccggaggaaaagagcaccggcgacttcgcgcaattcatcaaaatgattgttgggaaccagggaaatgtgaagaaaacattttctctgaacgaggatgccaagatccagttctccaaagaggaatatgaggaaaatctggagaccctcctggctgaaattggcgaggactttagaagcgtcttcgatgccgctaagtctgtgtacgacgccatctcccttgccaacatcctgaaggtgacggacgctacaacccgcgcgaaactctctagctccatggtcgttcggtttacagatcacaaggaggacctgaaaacccttaagagattcgtgcgcgaaaacctgcccgatgagtacgacgatctctttaaaaataagaaggtggccgggtatgctggatacattgacggcaacgaaacccaggaggccttctataaatacctgaagaaaacactggccaaggctacgggcgccgaggggtttctcgcgaaaatggaacaagaggatttcctgcggaagcagagaacctttgacaatggagtcatcccttatcagcttcacctggaggaactcaaggctattatcaaaaaccaaaagagctactattccttcctggatgaagagaaaatttctcagcttatgacatttcgcatcccctactacgtgggccctctggccaaggagaaagggcagttcgcctggctcacccggaaggaaatgggaaagatcacaccctggaatctgaacgagaaagttgacattgaaaagagcgctaccgatttcgtggagagaatgacgaataacgactcctatctgcctatggaaaaagtcctcccgaagcatagcctgctttacgagacatttaccgtgtataatgagctgaccaaagttcgctacatcgacgataacggccgggcccagaatttctcttccaaggagaaaagacaaattatcaacgaactctttaagcagcagcgcaaggtgaaaaaggaaatgctggaggctttcctgaaaaatgaatatgggattgagaaccccaaggtcgagggaatcgaaaagagctttaatgcctgccttggcacataccacgacctcattaaactgggcatccggcctgagctgttcgaacagcccgagcatgagcaacagtttgaacagatcgtgaagattctcaccgtcttcgaggatagaaaaatgcggcgcaagcagctggaaaaattttctaacatccttacagaggaggaacaaaagcagctggagagaaaacactataaggggtggggacggctcagcgcgaagctgattcacggcatcgtggaccagaaaacgcagaagaccattctggattaccttatcgacgatgacgatctccctaaaaacagaaatcgcaacttcatgcaactgatcaatgacgaaaacctgtcctttaaggaggaaattgagaaaatcgccttcgataatgacaagtctacagaagagattgttcaggagctcgctgggagccccgccatcaagaaagggattctgcagtcccttaagatcgtggaagagatcattgatatcatgggcgaactgccgaccaacattgtcgtggagatggctcgggaaaatcaaacaaccgcccaggggaacagagcgagcaaagcccgcatgaagtacctcgaggagtctatcaaaaagctgggctccagcattctggaagacgagcctatctctaaagacgctaatcttctcagaaacgatcggctgtttctgtattacctccagaatggacgcgacatgtatacgggcaacgaactggatatcaataacctttccagctacgacattgatcatatcgttccccagtccttcgtgaaggacgattctattgacaatagagtcctgaccacaagctccatgaaccgggggaagtctaacaccgtgcctgccgagagcgtggttaaaaagatgcgccccacatgggagagactcctggcttccggactgatcagcaaaaagaaattctcttatcttaccaaggccacgaatggcgggctcacagaagaggataaggcccactttattcaacggcagctggtcgaaacccgccagatcaccaaaaacgtggctcagattctgcatcaaaagtacaataacgagcagctctccgaaaaacccgtgagagtcatcacacttaagagcgcgctggcctctcagttccggaaagacttttccctgtataagatccgcgagctcaatgattaccaccatgctcaggacgcctacctgaacggagtgattgcccaagctctgcttaaggtttatcctaaactggagccggagttcgtgtacggcgaatatcagaaggtcagcatcagagccctcaataaagcgaccgctaagaaagaattttactctaacattatgaatttctttacaagcgatgagatggtggccaacgaagagacgggggaggttctgtggaatcggcagagagacatcaagaccattaagaaagtgatgaactatcaccaaatgaatatcgtcaagaaagtggaaatccagacaggcgccttcaccaaggagtccattctccccaaaggacctagcaagaagctgatcgctcgcaaaaacaattgggcccccgttaactacggcggggtggactctcctacagtcgcgtattccgtgattatcacccacgaaaagggaaaagctgccaaggtggtccagcagcttgttggcattaaaatcctggagcggcaagcctttgaacaggatgaggtggctttcctcgaggaaaaggggtttatccatcccaaagtgcagctgaagctgccgaagtacagcctttaccagttcgccgacggaagacgccggctgctcgcttccgccgaggaatctcaaaaaggcaaccagatggtcctgcctgtgcacctcattgagctgctttatcatgcgaagcacgttagcgattcctctgggaaaagcctggagtacctcaatgaacacagacatgagttcgccgaactgctggaggctatccttcagtttacggaacagtatattgacgccggcaagaaccagaaaaaggtgcgcgatctgtacgagaagaatcaagacgctgatatgcgggagctcgcctcctctttcatccagctgctccagctgaacaaacaaggagcccccgctgactttaagttctttggcgaaacaattcctagacgccggtataaaaataccgcggagatcgtcgatgccaccttcattaaccagagcatcacagggctttacgaaacccagaagagactggtgtga

SEQ ID NO: 4099 - RNA, 3984 nt, synthetic construct
  misc_feature 1..3984: note = Cas9 variant
  source 1..3984: mol_type = other RNA
atgaccgagcagcaacagccctacaacatcggcctggacattgggacaagctccatcggatgggccgtgacggatcagaatgacaagctcctgcacattagaggccataacgggatcggagtccggcttttcaaagaaggcgagtctgctgccgaacgcagagggtttcggaccacacgcagacggctgagccgcagacggtggcgcctcagattcctggatcggatttttgacgcggagcttgctaaggttgatcctaatttcctggcccgcctcaaacagtccaacatctctccgctggaccccaataagcaaatgtttggaaacatcctgttcgatgaccctcagtttgatgaccagaaattccaccagcaatatcccaccatttaccatctcagaagcgccctggctcagcctgatgctccccaggccgacgtgcggcttatctatctggccctccaccatatgattaagtttcgcggccacttcctgaatggcgcggccgtggaaaagtttcacgggggacagcttcatctggagtccgagttccaagaactcaaccagatcttttctaatcagcaaagagatcacgtccagctgcagacaagctccctggacgaggtggctaccattctcaaagacaaccagcggacacctagcgatagacaacgcgaactgtctgcccggcttttcgttccggtggacaagaccatcgataaagagaataagaaactggctacggagctcctgaaggccgtccttggcctgaaggcgaaattcgacgtgattctcggggttgaagccaccgatccccaggcttttaagctgcagttctccagcgacgattttgacgataaaatcgccgagctggcttctgaactcacagacgaggccaacgaaatcctgaccgtgcttcagagactgtacttctccctcaatctggccgatattcttacaaaccgccaaaccaagcaggtcgctgacagcatctctacggcgatgattaatcggtatgacgatcataaacaccacctgaagatgctcaaagagctggaggcccaggtgacacaggaacaaagagacggactgaagaaggcttacaacgagtatatcgatggcgacaaacctaccattgatacattttacaccaacgtgaagaaaaatctcgacgattccgaactggccaaccagatcaagagccttatcgacctgcaggccttcatgcccaaacagcgctccaaggagaatgggtctattcctcatcaactccaccagcgggaactggatcagctgatcgaggtccaaggaaagtactatccctggcttctcgctgccaaagacaagctggatgcgctgattgcttttagagttccgtactatgtgggccctatgatcgaccccaaccagagcgatgaccctcagaataccaaattcgcctggatggtgcgcaaggaggccggcgaaattacaccctggaactttgaggaaaaagtcgacaagacgtccagcgctaccaatttcatcaagcggatgacaaccacagatacctacctcctgggggagcccgtgcttcctaaaaactctctgctctatcagcaatttacggttctgaatgaactgaacaaacttaaggtgaatggaaaggccctcacagtcgaccagaaaaagtacctgtatgatcatgtgtgcaagaaacagagacgcgttaccctgaagaaactctccgactgtctggtggctcggggcgatttcccgatgggggccatctttaccggaacaaccgaccagaagaacatgaataacacacttaaaacgtaccaagatttccaggagattttcggcgacgagatcgataatcccgacagacaggtcgattttgaaaagatgattgagtggagcaccatcttcgaagaccgggagatttttaaactgaagctcgcggagctgaactggctgacatctgaacagcttgagcgcgtgagcaagaaaagataccaagggtggggacggctctcccagaagctgctgacccacatcgtcaacgaaaatggcgagagaattatcgatcagctctggaacacaaatcaaaacttcatggaaatcatgggccaggactctgtgaaacaggccattcaggagcataatggggctaacgttgcccaaaccggaatcaatgagacgattgacgaactgtataccagccctcagaacaagaaagctatccgccagattcttctggtggtcgatgacatcaagaaggccgtgggctacgcgcccgccaatatcatgatggagtttgctcgggaagatagagacgatcaccgcctcattgcctccagagctcggcagctggagaaaacatatcaagaaatcagcaagaactggttcgacaatgagtctgttacccaggagctgaaagatcagattaagaacaaaacaaagtttaccgaccgcctttacctctatttcatccagggaggaattgatctgtacacgggccaccctctgaatatcgaccaactctccagctatgatatcgaccatattctgccccagtcttttcttctggacaactccctcaataacagagtgctgacaagccaggccgaaaaccgggtccacaaggaggatcgcctgccgggggaaaccgtggccaataaaatgagacctacatggaagatgatgcgggagcagggccttatgacccaacgcaaatacaacaatctgaccctcaagcccgaccagatctccaaattcaacaatagaggacagtttattaaccggcaactggtggaaacacgccaggttatcaagctcgctgcggatattatgtctcagaagtaccaggccgaccaaacgaaagtcgtgaccgtgaaggctaatctgacacatcacatgagagagaaattcaacttttataagagccggaatgtcaacgattaccaccatgccttcgacgcctatcttaccctgttcgtgggcaattggctcctgaaagagtaccctaagctgcagccctattttgtttacggggatttcgctaaaacaggaaccaacaatcttaagtcctttaacttcctgtatagatttgaacgcgaccacaagctcaatgataaaggcgccatcgacacggataaggaccagcagctggggtacatgaaacggatctacagattcaagaaaatgctcgtgacaaagcaactggagaccaacgaaggagcgctttatggccagaccctgtaccctgctcccaagaacgataaaaagacacgcaatctcattaactctaaaaagaatcggccgagcgacatctatgggggctactccaacgagaatgggagctttctgaccctggtcaaacttaagaagggctctaaatatgactacagactggtggccgttcctgtgtccaagattagcgagatcaaagaatctgagctcgccacaattgaaaaggctatcgcgccccagttcctgaaatccagcgggaagtatcgcgattttcaggtcgtgctctctaagattctgatcaaccaaaaagttatcgacgatggaatgattttcacgatcggcagcaagtcctacaaacataatgccaaacaggtggtccttagcgacaactctattcagatcgtgtccaccctgagccggatttccgataaggagaagctgatcacagtgtttgacgaaatcgtcgatattacctctaagtacctcccctggtataaagttaatgacgtggagaagacaaaaatgctgttcagacaaatgcaggatatcgacgagatgaagaaaattatcgataacagccttattgggctgcactgcaatgcttccatcaccgacctcggaaaggtgggcctgtctaaatactgggggcgcttcgtcctcacggccggcatcagcctgaccgtggatgcccagcttatttatcagtcccctacaggactgtttgaacatcgggttaaggtgtctgacctgtga

SEQ ID NO: 4100 - RNA, 3990 nt, synthetic construct
  misc_feature 1..3990: note = Cas9 variant
  source 1..3990: mol_type = other RNA
atgaacaagcagccctacaatatcggcctggacattgggaccagctccgtgggatggtctgccacagagctcgataacagactgcttcacatcaaaggccataatgggattggagtccggctgttcaaggaaggcgagagcgctgccgaccgcagagggtttcggacgacccgcagacggctcgcgcgcagaaaatggcggctgcgccttctgaacgaaatcttcgctacagagattgccaaggttgatccttcctttttcgccagactcaaacaatctaatgtgagcccgaaggaccccaacaagaccatgtttggaaatatcctgttcgatgacgaaaacctggatgaccagaaatttcaccatgattataagacaatctaccacctccggcaggctattatcaatcatcctgagcagaaattcgacattcgcctgatctatcttgccatgcaccacattatcaagtacagaggccattttctgaaccaagctaatgtgcaggatttcaaaggcgggaagattgacctcgagaagtcctttaaagccctgaacgatatcttcgaaaatcagggacgggaccttcgcctggtcaccgacgaggcgaaccagtatgtgaaggttctctctgataatgccaaaacaagaagcgaccggaagaaagaactgtccaagctgctctacgtgcccatcgataaagacaccgataagaacagcaagaaagtcacgggcgagattctgaaggctatccttgggaacaaagccaagtttgacgtgattttcggaatcgaggttgaaaatcctaaagagtgggtgctgaccttcaactctgatgactttgatgacaagattgaaggcctctccagccaaatgacagatgaggactctgaaatcctgcttatcctgaaggagctctatttcgctctgaatctgtccgacattctcaacaatagcgtcaccgataaaaacgccaagacactgtctgaggcgatgatcaatagatacgacgatcacaaaaaccagcttgccatgctgaagaaagtgattgactccagcgataagaagcatgctaaagaactcaaggaggcctactccgcttatatcgacggggaaaataacaaaaagatttcttttgaggatctgaaaaagcgcatccagaagaatcttgtggacagcgaactgtcccagaaaatcaacgatctcctggaccacgattacttcctgcccaagcaacggagcaaagagaatggagccattcctcaccagctccagcaacaggagctggaccagatcattgaatctcagaagcaatattacccgtttcttgccgagctgaaccccaatgaaaagagatcccgccaggctaagtataaactcgatgagctggtcgcgttccgggttagctactatgtgggccctatggtggaagtcaccgactctaaccaggagaacaatggcaagtttgcctggatgatcagaaaggagcagggggaaattacgccctggaacttcgacgagaaagtggatcgcacagaaaccgctacaaagtttatcacccggatgaccacaacggacacctacctgattggagagcctgttcttcccaaaaatagcctcctgtaccaaaagttcgtggtcctgaacgagctcaataacctgaaaatcaatcaggaaacaatcaccccgggccagaagcagtatctttacgagcatgtgatgaagaaaaacaagagagttacactgaaaaagattgccgatgccctcgtgatcaaaggggactatccttacgctcccgaagtcaagggaaccacggatcaaaagaatctgaacaatggcctgacaacctatattgaccttgccaaaatctttgggaacgagctcgatgacgtggatcgcgaagcggacttcgagaagattatcgagtggtccaccatctttgaagatcagcacattttcgtcctgaaactgcaggagctcaagtggctgacagaaaaacagcggaatcaagtggttaaacttagataccagggatggggcaagctgtctaaagagctcctggctggcctggtggacgataacgggcagcgcatcattgaccttctctggagcgacaatcaaaacttcatgcagatcgtcaaccagaagtcctttaaagaaagcattgccgatcataatggagcccacctggaggagaagaacctgaaagacgtgatcaatgatctctatacctctcctcagaacaagaaagctatccggcaagttattctggtggtcgacgatatcattaatgccgtgggctacgaacccgctaacatcatgatggagttcgccagagaagactccaatgatcatcggcttacaaacagccgctctagacagctggagaatgtgtacaaggacattacgaactcctggtttgataatgacagcgttaaggatgaactcgaggacaaaatcaagaacaaagacaagttcaccgatcggctgtatctgtactttacacaagggggaaaagacctttataccggcgagcccctcaatatcgatgacctgtcctcttacgatattgaccacatcctgcctcagagcttcattctcgataactccctggacaatagagtccttacatctcagcgcaacaaccgggtgagcaaggaagatcagctgccgggggagctctttggcaccaagatgcacgcgttctggaaaagactgaaggccgctcatctgatctccaataaaaagtattacaaccttacgctgacccccaatagcatttctaaatttaacaatcagggacgcttcatcaacagacagctcgtggaaacacggcaagtcattaagctggccgctgagatcctccacaatcgctattccgaggaaaagggcaccaacatcgtgacaattaaagccaatctgacccatcacatgagagagaagtttaacttctacaaaaatcggaacgttaatgactaccaccatgcgtttgatgcctatcttacggctttcgtggggaactggctgctccagcagtaccctaagctgaaaccctatttcgtctacggagactttgccaagacagaaatcaataacctcaagagcttcaatatgctttataaatttgagcaagctcaccagctgaacgaaaaggatggcaaaattgccaaggacaccgacgccctcctggggtacatgaaaaacgtgtatcatttcaagaagatgctcgttacaaaagagctggagaccaatcacggagctctttttaaccagaccctgtacccttctcccgcgcatgatatcaagaaacgccagctcattaagccgaaagacaatagacctacagatatctacggcgggtatacgcacgaggaacggaagtacatgtccctggtgaaagtcatcggcaagaaggacaacgaatatcgcatggccaatgtgcccctgcttaaaattaacaagaataacgatatcaaagagattctcaagagccaattctctaataaaaagtttgaaatcgttctgcctaaggtgctgaaaaaccagctgttcagcgagaatggagctctgtttgtcattggctccaaggggtacaaatataacgccaatcagcttgtgctgagcgacctggatatgaagctcctgaacgacctttctaataacaaatccatcgatgaggtgaccatcaaccagctgttcaagaatattgtcgacagcacaaacaagtacatgcccctctatgaaatcaaaaatctgaacgaggttgtggaaaagtttaataacctcgagttcaatgataaaaagaaaaccattacagacttcctgcttgccacccacgctaaccctacgatgtccaatctgaagaacatcggactgccctactttggcagattcattcggaatacagggatcaagctctctgaaaacgccaatgtgatttaccaaagcccgaccggactgttttcccgcaaaatcaagatctctgatttctga

SEQ ID NO: 4101 - RNA, 3993 nt, synthetic construct
  misc_feature 1..3993: note = Cas9 variant
  source 1..3993: mol_type = other RNA
atgaagaacgactacaccatcggcctggatattgggacaaatagcgtgggatattccgtcgttacggacgattacaaagtgatctctaagaaaatgaacgtgttcggcaataccgagaagaaaagcattaagaagaacttttggggagtcagactcttcgaatccggacagacagcccaagaggctcggatgaaacgcacctctagacggcgcatcgccagacggaagaatcgcatttgctatctgcaggaaatctttcagcccgagatgaaccaccttgacaataacttcttttacagactgaatgaatccttcctcgtggcggatgacgctaaatatgataagcatcctatctttggcacactggacgaggagattcacttccatgaacagtttccgaccatctaccaccttcggaaatatctggccgatggggacgagaaggccgatctccgcctggtttacctggctattgcccatatcattaagttcagaggaaactttctcatcgaaggcgagctgaatacagagaacaattccgtgattgaactttctaaagtcttcgtgcaactgtacaaccagaccctcagcgagctggaaggctttcagttcatcgacgagtccatcgatttcagcgaagttcttacgcagcaactgtctaagtccgagcgggctgacaatgtgctcaaactgtttcccgacgagaaggggaccggaattttcgcccagtttatcaaactgattgtcggcaaccaggggaacttcaagaaagtgtttcagctcgaagaggatcaaaagctgcagcttagcacagacgattatgaagagaatatcgaaaacctgctcgcgattatcggagacgagtacggcgatatcttcgtggccgctcagaatctgtatcaagccattcttctggctgggatcctcacctctacagagaagacccgcgccaaactgtccgcgagcatgattcagagatacgaagaacacgccaaggacctgaaactcctgaagcggtttgtcaaagaacacatccctgataagtatgctgagattttcaacgacgccacgaagaatggatacgctggctatatcgatggcaaaacaaaggaagaggagttttacaaataccttaagaccacactggttcagaaatctgggtatcagtacttcatcgaaaagattgagcaagaaaactttctccgcaagcagagaatctatgacaatggagtgattccccatcaggtgcacgccgaggagctgcgggccatccttagaaaacaggaaaagtactattccttcctgaaagagaaccatgaaaagattgagcaaatctttaaagtccgcattccttactatgtgggccccctcgctaagcacaatgaacagagccggttcgcgtggaacatcagaaagtccgatgagcctatccgcccgtggaatatgaacgacgttgtggacgagaatgcctctgctgtcgccttcattgaacggatgaccatcaaagatatttacctgaacgagaatgtgctgcccagacacagcctcatctacgaaaagtttaccgttttcaacgagctgacaaaagtgctttatgccgacgatcgcggggtctttcagcggttctccgctgaagagaaggaggacatttttgaaaaactgttcaagagcgagagaaaagtgacgaagaagaaactcgaaaactacctgcgcatcgagctgtctatctccagcccttctgtcaagggaattgaggagcagtttaatgccaacttcggcacctatcttgatctcaaaaagtttgacgagctgcatccctacctggatgacgaaaaatatcaagatacactcgaggaagtgatcaaggttctgaccgtgttcgaggaccggagcatgattcagaatcagcttgagcagctgcctctcaacctgtccacaaagaccatcaaagcgctgtctagacgcaagtacacggggtggggacggcttagcgctagactcattgatggcatccacgacaaaaattccggcaagacaatcctggattatctgattgaagacgagagcgactcttacatcgtcaaccggaattttatgcaactcattaacgatgaccatctgtccttcaaaaagatcattgaagatagccagccctacaaggagcagcaatctgccgaagagatcgtgtccgagcttagcgggtccccggccatcaaaaaggggattctgcagtctctcaaaatcgttgacgaactggtggctattatgggctataagcctaaaaatatcgtcgtggagatggcccgcgaaaaccagaccaccgggagaggaaagcagaatagcaagccccggctgaaaggcattgagaacgggcttaaggaattttccgattctgtgctcaaaggcagctccatcgacaataagcaactgcagaacgatagactgtacctctattacctgcagaatggaaaagacatgtatacaggccacgagcttgatattgaccatctgagcacctacgatatcgaccacatcattcctcagtctttcctcacagataactccatcgacaaccgcgttctgacgaccagcaagtctaatcgggggaaatccgacaacgtccccagcgaggaagtggtgagaaagatggatcgcttctggagaaagctgcttaatgctaaactcatttctgagcggaagtatacaaacctgaccaaaaaggaactgacagagagcgacaaagccggatttctcaagcgccaactggtcgaaaccagacagatcacgaagcacgtggcgaccattcttgattccaaattcaatgaggacagcaacaatcgggatgttcagatcatcacactgaagtctgccctcgtgtccgagtttcgcaaaaccttcaacctgtacaaggtcagagaaattaatgacctgcatcacgctcatgatgcctaccttaacgctgtggttgccctgagcctcctgcgggtgtatccccagctcaaacctgagtttgtctacggcgaatatgggaagaatagcatccacgaccaaaacaaggcgacaattaaaaagcagttctactctaatatcacccgctattttgccagcaaagattacattatcaacgacgatggagagatcctgtggaataagcaggagacgattgctcaagtgatcaaaacacttggcatgcaccaggttaacgtggtcaagaaggtggaaattcagaaagggggcttctccaaggagtctatccagccgaaaggagaaagccaaaagctgattagacggaaacagcagtggaacaccaagaagtatggcgggtttgactcccccgtggtcgcctacgctatcctcctgtctttcgacaaaggaaagcgcaaagcccggagctttaagattgttggcatcacaatccaggatagagagtccttcgaagggaatcctattctgtaccttagcaaaaaggactatcataaccccaaagtggaggccatcctgcctaagtactctctcttcgagtttgaaaatggaagacgccggatggtggcttccgcgagcgagacccaaaagggcaaccagctgattatccccgggcacctcatggaactgctttatcattctaaaaagattatcaatggcaaaaactccgatagcgtctcttacatccagaataacaaggagaaattcagagaaatttttgagtatatcgtggacttctccagcaagtacatttccgccgatgctaatctgaacaagatcgagaaaatttttgaaaataacttccacaaggccagcgagcaggaaatcgccaaatcttttatcaatctcctgaccttcacagctatgggagccccggcggactttgagttctttggcgaaaagattcctcgcaaacggtatgttagcatctccgagattatcgatgctgtgttcattcatcaatctatcacggggctgtacgagaccagagtccgccttacagaagtgtga

SEQ ID NO: 4102 - RNA, 3993 nt, synthetic construct
  misc_feature 1..3993: note = Cas9 variant
  source 1..3993: mol_type = other RNA
atggagaaggaatacaccatcggcctggacattgggacaaacagcgtgggatgggccgtcctcacggatgactatagactggttgctcggaaaatgtccatccagggcgattctaatcgcaagaaaattaagaaaaacttctggggagccagactttttgaggaagggaagaccgcgcaattccggcgcatcaagagaacaaatcggcgcagaattgctcggcgcagacagcgggtgctggccctccaggacatctttgccgaggaaatccacaaaaaggatcccaacttctttgctcgcctggaggagggcgacagagtggaagccgataaacggttcgctaagtttcctgtcttcgccacccttagcgaggagaaaaattaccatcgccagtatccgacaatttaccacctgagacatgacctcgcgaactccaaggagcaagccgatatccggctggtgtatctggctattgcccactgcctcaagtacagagggcattttctgttcgagggagaacttgacaccgagaatacatctgttaccgaaaactatcagcagtttctgcaggcttaccaacagttctttcccgagcctatcggcgatctcgacgatgccgtgcccattctgacggaacgccttagcaaagcgaagcgggtcgagaaagtgctggcctactatccttccgagaagtctaccggcaatttcgctcagttcctcaaactgatggttgggaaccaggccaattttaagaaaacattcgacctggaagaggaaatgaagctcaactttaccagagactgttacgaggaagatctgaatgagcttctggagaagacaagcgacgattatgctgaactcttcctgaaagccaagggagtgtacgacgccatccttctgtcccaaattctcagcaaatctgatgacgagaccaaggctaaactgtccgcgaacatgaagctgcgctttgaagaacaccagcgggatctcaagcagctgaaagaacttgtcagacgcgacctgcccaagaaatatgatgacttctttaagaatcggagcaaaaacggctacgccgggtatgtgaagggaaaggctacgcaagaggatttctacaaatttctcagaacagagctggccggccttgaagagtctcagtccatcatggaaaagatcgacctggagatttacctcctgaaacagcgcaccttcgccaacggggtgatccctcaccagattcatctggtcgagatgcgggaaatcatggacagacaaaagcgcttttatccgttcctcaaaggagctcagggcaagattgagaagctgcttacatttcggatcccctactatgttggccctctggcccaggaagggcagagccccttcgcgtggatcaaaagaaagtctccttcccaaattaccccctggaatttcgctgaggtggtggataaagaaaacagcgccatcgagtttattgagcggatgaccaatcaggacacatacctcccgaaggaaaaagtcctgcctaagcagtccctgatctatcagcgcttcatgatttttaacgagcttacgaaagtgtcttacaccgatgaaagaggaaagagccactatttctccagcgagcaaaagcggaaaatctttaatgaactcttcaagcagcatcccagagttacagagaaacagctgcgcaagtttctggagctcaacgaacagatcgactctaccgagattaaaggcatcgaaacatccttcaatgccagctactctacctaccacgatctgcttaagctgagcgaccaaatggatacgctcctggacgatcctgacatgacaaccatgtttgaggaaattatcaagattctgaccatcttcgaggatcgggagatgattagagaacagcttaaaccctatgagacagtgctcgggctgcccgctatcaagaaactggccaagaaacactacaccggatggggccgcctctccgaaaagatgatccaggggatgagagagaagcaatctcggaaaacaattctggactatcttatcgatgacgacgattttccttgcaaccgcaatagaaacttcatgcagctgattaatgacgatcatctcagctttaaggagacgatcgctaacgaactgattatgtccgacagcaatgtcctgcttgatcaggtgaaagccatcccgggatctcccgcggttaagaaaggcatctggcagtccattaagatcgtggaggaaattatcggcattatcgggaaggcccctaaaaacatcgtcattgagatggctcgggaaaatcaacgcaccagcagatctcggccccgcctcaaggccctggaggaggctctgaaaaacatcgactcccctctcctgaaggattaccccacagacaaccaggcccttcagaaagatagactgtatctctactatctgcagaatggaaaggacatgtacaccggcgaaccgctggagattcaccggcttagcgaatacgatatcgaccatattatccctcgctccttcatcgtggataactctctcgacaataaagtcctggtgagctccaaggttaacagagggaagctggacaatgcgcccgatcctctcgtggtcaaacggatgagatctcactgggagaagctgcatcaagccaaacttattagcgacaagaaactggctaacctcacaaagcagaatctgaccgaagccgataaggctcgcttcatccagcggcagctggtggagacgagacaaattaccaaacacgttgccaaccttctgcaccagcattttaatctccccgaggaagtgtccgccacagagaagaccagcatcattacactgaaatctaccctcacgtcccagttccgccaaatgtttgacatctataaggtccgggaaattaaccaccatcaccacgctcatgatgcgtacctgaatggagtggtggccatgacacttctgaaaaagtatcctaagctcgctcccgagttcgtttacggcagctatatcaaaggggacatcaaccagattaataaggccaccgccaaaaaggaattttactctaacatcatgaaattctttgagtccgaggaaattatctgtgatgagcagggcgaagtcatttggaataagaagagagacctgagcacaatcaaaaagaccatcggagctcaccaggtgaacattgtgaaaaaggtcgagaaacaaaagggcgggttctataaggagaccatcaactctaaagccaatccggaaaagctgattcctcgcaaagcgagccttgatcccctgaagtacggaggctacgggagccccctcgtggcttatacagttatctttattttcgagaaaggaaagcagaaaaaggtgacgaagggcatcgaagggatcaccgtcatggagcagctgcggtttgaacaggaccctagagagttcctcaaaacaaagggctacgagggagtgaaacaatggctgattcttccgaagtatatcctgttcgaagcccagggcgggtaccgccggatgattgcctcccatcaggagacccagaaagctaactctctcatcctgcccgaaaatctggttacacttctgtatcacgccagacattacgatgagattaaccacaaggtgtcctttgactatgtcaatgcgcacaaggaaggattcaacgacatctttgatttcattagcgactttggcgtgcggtacatcctcgctcctcaacatctggagaaaatcaaggttgcctacgagaaaaataaggaagtggatctcaaagagatgattgacgccatcctgtcccttctgaagttcaccctgtttggggcttctgtcgagttcaagtttttcgatattaaaatcctcaagcgctataaaagcctgacggacatttgggaagccacaatcatctaccagtccgtgaccggactttatgaaagacgggtggaggtccgcaagctgtgggatggcgagagactctga

SEQ ID NO: 4103 - RNA, 3996 nt, synthetic construct
  misc_feature 1..3996: note = Cas9 variant
  source 1..3996: mol_type = other RNA
atgaacaagcagccctacaatatcggcctggacattgggaccagctccgtgggatggtctgccacagagctcgataacagactgcttcacatcaaaggccataatgggattggagtccggctgttcaaggaaggcgagagcgctgccgaccgcagagggtttcggacgacccgcagacggctcgcgcgcagaaaatggcggctgcgccttctgaacgaaatcttcgctacagagattgccaaggttgatccttcctttttcgccagactcaaacaatctaatgtgagcccgaaggaccccaacaagaccatgtttgaaaatatcctgttcgatgacgagaacctggatgaccagaaatttcaccatgattataagacaatctaccacctccggcaggctattatcaatcatcctgagcagaaattcgacattcgcctgatctatcttgccatgcaccacattatcaagtacagaggacattttctgaaccaagctaatgtgcaggatttcaaaggcggcaagattgacctcgaaaagtcctttaaagccctgaacgatatcttcgagaatcaggggcgggaccttcgcctggtcaccgacaaggcgaaccagtatgtgaaagttctctctgataatgccaagacaagaagcgaccggaaaaaggaactgtccaaactgctctacgtgcccatcgataaggacaccgataagaacagcaaaaaggtcacgggagagattctgaaagctatccttggcaacaaggccaaatttgacgtgattttcgggatcgaggttgaaaatcctaaggagtgggtgctgaccttcaactctgatgactttgatgacaagattgaaggactctccagccaaatgacagatgaggactctgaaatcctgcttatcctgaaagagctctatttcgctctgaatctgtccgacattctcaacaatagcgtcaccgataagaacgccaaaacactgtctgaggcgatgatcaatagatacgacgatcacaagaaccagcttgccatgctgaaaaaggtgattgactccagcgataagaaacatgctaaggaactcaaagaggcctactccgcttatatcgacggcgaaaataacaagaaaatttcttttgaggatctgaagaagcgcatccagaaaaatcttgtggacagcgaactgtcccagaagatcaacgatctcctggaccacgattacttcctgcccaaacaacggagcaaggagaatggggccattcctcaccagctccagcaacaggagctggaccagatcattgaatctcagaaacaatattacccgtttcttgccgagctgaaccccaatgaaaagagatcccgccaggctaaatataagctcgatgagctggtcgcgttccgggttccttactatgtgggacccatggtggaagtcaccgacagcaaccaggagaacaatggcaagtttgcctggatgatcagaaaagagcagggcgaaattacgccttggaacttcgacgagaaggtggatcgcacagaaaccgctacaaaatttatcacccggatgaccacaacggacacctacctgattggggagcccgttcttccgaagaatagcctcctgtaccaaaaattcgtggtcctgaacgagctcaataacctgaagatcaatcaggaaatcattacacctggacagaagcagtatctttacgagcatgtgatgaaaaagaacaaaagagttaccctgaagaaaatcgccgatgccctcgtgattaagggcgactatccctacgctcctgaagtcaaggggacaaccgatcagaaaaatctgaacaatggactgacgacatatatcgaccttgccaagatttttggcaacgagctcgatgacgtggatcgcgaagcggacttcgagaaaatcatcgagtggagcaccatttttgaagatcagcacatcttcgctctgaagctgcaggagctcaaatggctgaccgaaaagcagcggaatcaagtcgtgaaacttagataccaggggtggggaaagctgtccaaggagctcctggccggcctggttgacgataacggccagcgcattatcgaccttctctggtctgacaatcaaaacttcatgcagattgtgaaccagaaatcttttaaggaatccatcgccgatcataatggggctcacctggaggagaaaaacctgaaggacgtcatcaatgatctctatacaagcccccagaacaaaaaggccattcggcaagtgatcctggttgtggacgatattatcaatgctgtcggatacgaacccgccaacattatgatggagttcgcgagagaagactctaatgatcatcggcttaccaactcccgcagcagacagctggagaatgtgtacaaggacatcacaaactcttggtttgataatgactccgtgaaagatgaactcgaggacaagatcaaaaacaaggacaaattcacggatcggctgtatctgtactttacccagggcgggaaggacctttatacaggagagcctctcaatattgatgacctgagctcctacgatatcgaccacattctgccgcagtctttcatcctcgataacagcctggacaatagagttcttacctcccaacgcaacaaccgggtctctaaggaagatcagctgcccggcgagctctttgggacaaaaatgcacgccttctggaagagactgaaagctgcccatctgattagcaataagaaatattacaaccttaccctgacgcctaattccatcagcaagtttaacaatcagggccgcttcattaacagacagctcgtggaaacccggcaagtgatcaagctggctgccgagatcctccacaatcgctattctgaggaaaaaggaacaaacattgtcaccatcaaggcgaatctgacacatcacatgagagagaaatttaacttctacaagaatcggaacgtgaatgactaccaccatgcctttgatgcttatcttaccgccttcgttggcaactggctgctccagcagtaccccaaactgaagccttatttcgtgtacggggactttgctaagacggaaattaataacctgaaatccttcaatatgctttataagtttgagcaagcccaccagctgaacgaaaaagatggaaagatcgccaaagacgctgacgcgctcctgggctacatgaagaacgtctatcatttcaagaaaatgctcgtgacaaagaaactggagaccaatcacggggccctttttaagcagacactgtaccccagcccggctcatgatattaaaaagcgccagctcatcaaacctaaggacaacagacccaccgatatctacggaggctatacccacgaggaacggaagtacatgtctctggttaaagtgattgggaagaaagacaatgagtatcgcatggccaacgtccctctgcttaagatcaataaaaacaatgatattaaggaaatcctgaagtcccaattcagcaacaaaaagtttgagattgtgctccccaaagttctgaagaatcaactcttctctgaaaacggcgccctgtttgtgatcggaagcaaaggctacaagtataatgctaaccagcttgtcctgtccgacctggatatgaagctcctgaatgaccttagcaacaataaatctatcgatgaggtgacaattaaccagctgttcaagaacatcgtggactccacgaataaatacatgcctctctatgagattaagaacctgaatgaagtcgttgagaaatttaacaatctcgagttcaacgataagaagaaaaccatcacagacttcctgcttgccacccacgcgaatcccacaatgagcaacctgaagaatattgggctgccgtcctactttggaagattcacctctggcaacgctgggatcaaactcagcgaaaatgccaacgtgatttaccaatcccctacgggactgttttctcggaaggtgaaaatcagcgatttctga

SEQ ID NO: 4104 - RNA, 3999 nt, synthetic construct
  misc_feature 1..3999: note = Cas9 variant
  source 1..3999: mol_type = other RNA
atgaagaacagagagaatatcaaatactatattggcgtggacatcgggaccaacagcgtcggatgggccgttattgatgaaaatggcaacctgctcaagaaagggaagcaccatctgtggggatcccggcttttcgaccaggctcaaacagcccagaatcgcagaaactaccggtctagccgcagacggtataataaacgcagacagcggatcggcctgctccgcctgattatgtccgatatggtgcttgaggtggaccccagctttttcatcagactggaaaagacgacctttctcgataaggaggacaaaaaggcgatcctgaaagataactacaagatgaattataacctgttctgcgacgaagattacaatgacaaaaagtattttaaggattaccctacaatttaccacctccggaaaaagctgtgtgagagcgacgagaaagctgatccgcgccttatctatctggccctccatcacattgtcaagtacagagggaacttcctgtatgaaggacaggagcttcatctggaaccctccaataaagaggaggacctcaagatcctgtttgacattctgggcaaaaacaatgataccgtgtacgacatctctgaagaacaaattcagttcatcctcaagacagttgtggaaaacatcagcaagaccgccaaagtcgatgagtgcatgtcccagctgaagctgaacagcgaagacaaaaagattgtgaaagagtttatgcggggcctggttgggaataagttcaacgtgtctaagctctatatgcacgaggatctgcagtttgacgatgaagaccttaaactgcaattctccgataagagctacgaggaaaagatcacagagtatgaaaatgtcctcgaggagaagatggaatttattgacctgatgcagcgcttctactcttggatcgagctgtccaaaattgtgggaagcgattctcagcacgcttccatcagcggcgccatggtgaacatctacgaatcccatagagaggacctccggaccctgaaggaagtcatgcttaagattgggaaaaaggagtatgacgagatgttcaaacctacgtctaagaatgttgtgaactactataattacgtgaaccccgtcgcttgtagcggagataaaaccgacggcttttataagtacgtgaagaaagccatcgaaaagtccgatgacagcagaaaagatgagattctgcagaagatcgcgaatgaaacatatatgctcaaacaaacctctaagaacaatgcctacattccttaccagatgcagaaagacgagctgatcaagatccttgatcaccaagagaagtattaccccgttctgaaagaaaaccgcgacaagattatctccattctcgagttccggatcccttattactatgggccgctggatggaaataaacagtttggctggctgattaagaaaaagggcaaggaaaacgagagaatcctcccctggaatcatcaggaaattgtggacgtccaggagacagctgcccaattcatcaaaaagctgaccaactactgcacgtatcttcctatcgagaaagtgatgccccagaaaagcctgacatgttctatgtacgaagttctcagcgaggtgaacaaaattcgcatcgatgggaagctgctgcctattgacaccaagaatcggcttatcgaagatctctttttcaaaagaaagacagtcaaagagaaggacctgattaactggctgaaacagaatcagctcaccgtgggagaaatcaccggctaccaaaaggagaaggctttttcctctagcctggccccctggatcgacttcaaagagatttttgatgaaatcaacgactccaattatgatcttattgagaagatcattgaagacatgacaatcttcaacgaggggagcatcctgaaagaacgcctcaagaaagcgtacaatctggatcagaacaaggtcaaaaagattatgaagctgaaatattctggatggtcccggcttagcaagaaactcatcaatggcattagagccgacaacaagtttgggtcttccgtgagcatcctggatgttatgaaagagtcccacatggctctgatggagattatcaatgaccaggatctcggattcaagcagatcattgaaaaggagaactttaaaaatgaaacgggctctttcgagtacgaggacatcgaaaacctggccggcagcccggctcttaagcgcgggatttggcaaacccttcaggtgatcgaggaaattaaaaattatatgggacacgagcctaagaacatctacattgagttcgcccgggaggagcaggaaaaagtcagaacaaccacacgcgtgaagaagctcaaatccatctataacgatatcaagaatcagctggacgttcatggcaaagaggtgtactctaacctgaataagcaagatgaaaaatcttccattgagaagcggctttacctctattacacccagctggggaagtgcatgtatagcggagaatctctggacatcgacaaactctccaactacgagattgatcacatctttcccagaacgctgacaagcgacgattctcttgacaatctggtcctcgtgaagaaaaaggagaaccagcggaaactggatgacctggtgcttcctctcgaaattcgcaataagatggaggttttctggaagaaactgtatgataacggcctgatcacccaaaccaagtactatagactcatgcgggacgaatttagacgcgatcagatcgacaaattcattaatcggcagctggtcgagacaagacagatcattaagcatgtggccaacatcattgaaaatcactacgaggataccaaagtgtttacagtccgcgctaacctttcccatgagttcagagaaaagtacgggatctataaaaatcggaacgtgaatgactttcaccacgcgcatgacgcctacatcgcttgtattatcggccgctatattcaaatcagattccccggactggaggccaagtacgtttatggccagtacatgcagaacgtgaagaaaacgaagaacaatattgataaagaaaaccacgggtttatcattaatagcatgaagtatgagtgcatcgacgaggataccggagaagtcatctggaaccccgagcggattctcgactacatcaaatgtttcaattaccgcgatgtgtatattacaaagaagctggacaccaacaatagagaactgtttaacgttacaatccttcctaatgataaaaactctgagaagggcaaaaccaaggccacgattccggtgaataaactgcggagcaacgtccgcaagtacgggggattctccggcctccagagcgacatcgtggctatcgaagggaagaaaggcaagaaaattgatagacggctgatcaatctccccattctgcttcgctatgtttctatcgaggaccaatgcaagtacattatggagaacaataaatattccgatgtgaagatcatcaagaaaattaagaaaaaccagctgatcgaaattgacggaatctgttactatctcaagagcgccgatgagctggacaccgcgtaccagctgattctttccagagacgataatgaaatgatctaccggattgacagagctatccagaacaacgatttttcttatttcgacaataaaaaggagaacatcgatgaactgtaccgcctcatttgccataaaatgatcgagaattatcctaagtacaagaaaaaggtctatgagttcattaaagaacgggaggaagagtttttcgaactggacaacagccaaaagtgcatcgtgatttttgagatgatcagagtgatgaaacgcggcgagcagtacatcaatattcccttcgaaccttataacctcaagaatgatcggaaggggagactgaactgtcagtccatccttctggacaatacatacttttacgatgtctctattaccggaatctatagcaaaaagtacaaactctga

SEQ ID NO: 4105 - RNA, 3999 nt, synthetic construct
  misc_feature 1..3999: note = Cas9 variant
  source 1..3999: mol_type = other RNA
atgcagaagaactacaccatcggcctggacattgggacaaatagcgtgggatgggccgtcatgaaagatgactatacgctcatcagaaagcggatgaaagttctgggcaacaccgatattaagaaaatcaagaagaatttctggggagtgcgcctttttgacgagggagaaacagctaaagagaccagactgaagcggggcacacgcagacggtaccaacgcagacggaaccgcctcatttatctgcaggatatcttccagcagcccatgcttgccatcgacgaaaatttcttccacagactggatgactcctttttcgtgcctgatgacaaatcttacgatcggcatccgatttttgggagcctcgaggaagaggtcgcgtatcacaacacctaccccacaatctatcatctgcgcaagcacctggctgacaatcctgagaaagccgatctcagactggtgtacaccgcccttgctcatattgttaagtaccggggacacttcctgatcgaaggcgagctcaacacggaaaatacctccatttctgagacatttgagcaattcctggacacctatagcgacatctttaaggaacagcttgtgggcgatatttccaaagtcgaggaaatcctgtctagcaagcagtcccgcagcagaaaacacgagcagatcatggccctcttccccaacgaaaataagctggggaactttggacggttcatgatgctgattgtgggcaatacatctaacttcaaacctgtttttgacctcgatgacgagtacaagctgaaactttccgatgagacctatgaagaggacctggatacgctcctggggatgacagacgatgtgttccttgacgtctttatggctgccaagaatgtgtacgatgcggtggaaatgagcgccatcatttctaccgacacaggaaactccaaggctgtcctgagcaaccaaatgatcaatttctatgacgagcataaagttgatctcgcccagctgaagcagtttttcaaaacccaccttcccgacaagtactatgaatgcttttctgatccttccaaaaacggctacgctgggtacattgacggaaagaccaatcaggaggatttctataagtacatcgagaaagtgatgaagacaatcaaaagcgacaagaaagattattttctcgacaagattgatagagaagtgttcctgcgcaagcaacggtccttttacaactctgtcatcccgcatcagattcaccttcaggagatgcaagccatcctggacagacagagccagtattaccccttcctcgcggaaaatcgcgataaaattgagtccctggtgacgtttcggatcccttattacgttggcccccttaccgtgagcgaccagtctgaatttgcctggatggagagacaatccgatgagcctatccgcccctggaacttcgacgaaattgtcaataaggagcggagcgctgaaaaatttatcgagagaatgacaaacatggacacctacctgctcgaggaaaaggtgctgccgaaacgctctctgctctatcagacattcgaggtttacaatgaactgaccaaggtgcggtatacgaacgagcagggcaagacagaaaaacttaatagacagcaaaaggccgagattatcgagaccctgtttaaacagaagaaccgcgtccgggaaaaagatattgctaattacctcgagcagtatgggtacgtggacggaaccgatatcaagggcgtcgaagacaaattcaacgccagcctgtccacatataatgatctggccaagattgacggggctaaggcgtaccttgatgaccctgagtacgccgatgtgtgggaagacatcatcaaaattctcaccatctttgaggataaggctatgcggaaaaagcagctgcaaacatattctgacacgctgagccccgagattctcaaaaagctggaaagaaagcactacaccggatggggccgcttctccaaaaagctgatcaacgggctgagagatgagggaagcaacaaaacaattctcgactatctgaagtctgacgaaggctccagcggccctaccaatcggaactttatgcagctgatcagagataatacactttctttcaaaaagaagatcgaggacgcccagaccattgaagatacgacccatatctacgacacagttgccgagctccccgggtcccccgctattaaaaagggaatccgccaggccctgaaaattgtggaggaaatcatcgatattatcggctatgagcctgaaaacattgtcgtggagatggcgcgggagagccaaaccacaaagaaagggaaggacctgtccaaggaaagactcgagaaactgaccgaagctatcaaggagtttgatggaccgtctgacgttaaagtgaaggatcttaaaaatgaaaacctgcgcaatgacagactctacctgtattacctgcagaacggccgggatatgtacacgaatgagccccttgacattaacaatctcagcaagtatgacatcgatcacatcattcctcagtccttcacaaccgacaactctatcgataataaagtcctggtgagccgcacaaagaaccaagggaataagtccgacgatgtgcccagcattaacatcgttcataaaatgaagcctttttggagacagctgcacaaagccggcctcatttctgaccggaagttcaaaaacctgaccaaggccgagcatggaggccttaccgaagctgatcgcgcccactttctgaatagacagctcgtcgagacacggcagatcacgaagcacgtggctaacctgctggactcccaatacaataccgccgaagaacagcgcattaacatcgtgcttctcaaaagctctatgacatccagattccggaaggagttcaaactgtataaggtccgcgagatcaatgattaccatcacgggcatgacgcgtatctgaacgccgtggttgctaccacaattatgaaagtgtaccccaatctcaagccgcagtttgtctatggacagtacaagaaaaccagcatgttcaaggaggaaaaagccacggctagaaagcacttttactctaacatcacaaaattctttaagaaggagaaagtggttaatgaagagaccggcgaaattctgtgggataccgagcggcaccttagcacaatcaagagagtgctgtcctggaaacaaatgaacattgtcaagaaagtggagaagcagaaggggcagctctggaaagaaaccatctatcctaagggagacagctctaaactgatccccgttaaggagggcatggatcctcagaaatacgggggcctgtcccaagtgagcgaagccttcgcggtcgtgattacacatgagaaggggaaaaagaagcagcttaaatccgacctgatctctattcccatcgtggaccagaaggcctatgagcaacaccctacggcttacctcgaagaggccggctataataaccccaccgtcctgcatgaactctttaaataccagctgttcgagcttgaagatgggagccgccggatgattgcttccgccaaggagtttcagaaaggaaatcagatggttctgccgctcgagctggtggaactgctttatcacgccaacagatacgacaaggtgaagttccctgattctatcgagtacgtccatgacaatctggctaaatttgatgacctcctggaatatgtgatcgatttcagcaacaagtacattaacgcggacaaaaatgttcaaaagatccagaaaatttataaggagcacggcacagaagatgtggagctcaccgtcgagtccttcgtgaacctgatgacatttaccgccatgggggctcccgccacgttcaagttttacggagaatctatcacccgcagccggtatacatccattaccgagttcagaggcagcacacttatctttcagtctattaccgggctgtacgaaacacgctataaactcgaggacaattga

SEQ ID NO: 4106 - RNA, 3999 nt, synthetic construct
  misc_feature 1..3999: note = Cas9 variant
  source 1..3999: mol_type = other RNA
atgatgaaggagtacagcatcggcctggacattgggtcctctagcgtgggattcgtcgccgttgatgaccagtatagagtggtgcgggctaaaggcaagaacgtcatcgggacccgcctctttgatgaaggaaaaacagccgcggacagacggggcctgcgcacgaccagacggcgcctttccagacggaagtggcgcctgagactcctgcgggggattttcgagccccacatcaatgaaattgatgagtctttcttcatgcgccttaaagaaagcaacatctcccctaaggactctaataagcattttccgggagatatcctgttcaacgacagaagcgatcgggagttttacgagaattatcccacaatttaccacctccgccaagctctgaaaaccgaaaagagacagttcgacatccgggagatttatctggccatgcatcacatcgtgaaatacagaggccattttctcgaaggcgggacagttaccgatttcgaggtgggagagctggaccttgccggcaagttttcccgcctgaacgaactcttcgagagcattaatctggaagtcccttttgtgcttcggctggataacctcgaggacgttaaagctgtgctgatcgactctcagagatccgcccaggatcgccaacggacactgacccccgacatttatgtccctagcacggataagatcaccgaaaagagattcaaagggatcgctacagagctcctgaaggccattgtgggaaataaagcgaagttcgacgtgcttgccggcctggagctcgataaagaagaggctaagctgtgggcccttacctttgactctgaaacattcgatgaggacatcgaacagctggagggggatatgaccgaggctacgcaggacctcattgaaatcctgaaatccctgcgcagcctcattcggctggccgtcaacatgcccgagggagtttctctttccgaaatgatgatccagagatacgaggatcacgcggaccacctgaagctcctgcgcgacatcattcataatacagatgccgaaaaggctgccggccttcaagctgcctacgacggctatatcgatggggtgaaaggaaagaaaacccctgtggacgatttttacaaggccattaaaaagaacctggacgatagcgaggctgcgcaccagatcctcgccctgattgacaagaatgagttcatgccgaaacagcggtccaagtctaacggctggatcccccatcagatccaacagaaagaactggatagaattatcgagaatcagaagcaatattacccttggctcgctgacgtcaaccccaacgaaagccgccggaaagtggccccttataagattgatgagctggttacatttagagtgccctactatgtcgggccgcttgtgacctccgaggaacagaagaaatacggaagcaagttcgcctggatggttcggaaagaggaaaagggcgagatcaccccttggaattttgaccagaaagtggatcgcgctgcctctgcgacagaatttattaacagaatgacgaccatggacacatacctgctcaatgaggacgtcctgcccgctcactccctgatctatcagaagtacgaggtgcttaacgaactcaataaggtcaaaattaacggggatgccatcacccctgagctgaagcaaaagatctatcacgacctgtttgaaaagcagacaaccgtgagcattaaaaatctccagacgtacctggtttctgagagcgaagcctccgaggtgcccgagatcaagggacttgctgatgagaaaaagttcctgtctggcctcacaacctatcatgacctgatgaagatttttgatcggaacgtcgtgaatgaccccgagagagccgaagatttcgagaaaatcattcgctggagcaccgtttttgaagacaagcacatctaccgggagaaactggattcccttagctggctcacaaccgaccagaaggatagactggctgtgaaacgctatagaggctgggggcggctgtctgagaagctcctgatcggacttcgcgacgaaggccatagatccattatggattacctgtgggagacaacgagcaacttcatgcaaatccaggcccagaatgacttctctgaaaagattgcggccgagaacaaagagtttctcgacaatacccagtccgtccaagggatcattaacgaactgtacacaagccctcagaataagaaagctatccggcagaccctgcttgtggtggaggatatcaagaaagccttccacggagaagctccgaagcgcatttttgttgagttcgccagagaaaacgagtccacaccccagcggtctatccaacgccagagacaggtcgagaacgcgtatgaaaaggtgacccaaaatctcctggtggacgataaaattcgggccgagctgaaggacagcatcaacgaaaaacgcctctttcatgatagactgttcctttactttatgcagggcgggattgacatgtattccggcaagaaaatcaatatcgataacctgtctgcttacgacattgatcacatcctccctcagagcttcacggtcgacaattccctggataaccgggtgctgaccaatcagaaggacaacagagagaagggaaatagccttccctctgaactctatcgcggctccatgaaagagacatgggagatgatgcggaaccaagggctgctgagcaagggaaaatttcacagactcatgatgacccctaattctatgacagcctacgaccagcagggcttcattaaccgccagctggttgaaacccggcaagtgatcaaacttgctgtcgagattctggcctccgaatttgatcaggccgacgagaaagtggaaatcgttagcgtgaaggctgggctcacgcatcagatgagacaggatttctctctgattaaaaatcgcgacgtcaacgattatcaccatgcgtttgacgcctacctgacagctttcgtgggaacctaccttctgaagcggtatcccaagctcagaccgtacttcgtttatggcgagtttaaaaagttcagccaaaaacaggccaatctgacaaactttaacttcctctgggccctgaagcacaaagatcaggtggctgtcgaggacaccggggaaaagatctggaataagcctcaagatcttgcctacatccgccacctgtttgcgttcaaaaagattctcatctcccgggaggtgagcgaaagacatggcgctctgtttgaccagaccctgtataaagcctctgatgacaaggcctccggacagggcagcaaaaagctgattcccgctaaggataaccggcctacagagctttacgggggatattccggccagacgtctgccttcatggcgatcgtgaaagtcaccaaggggaaaaagacaaaatacctcgttgtgggagtgcccaccgctgccattagccaactgcagggcatggacgtcaagtcctctcagtacacagagaagatctataatatcctcagccctaaactgctttccaagaacgacgattttgaagtgattgttcccaaagtgcgctacagacagctgatcctcgacaataaccaactgttcaccctggggtctgatacgtataagtacaatgcccggcagcttgtcctgagcaacgaggtgctcgctgttattaatcgcgacaaatcctttatcgataagaagctgagcgaagaggccgaaaaccaggctctcaatgacgccttcgatgagattgtggtcgcgatggacaaacacttcgatctgtatgacaagaacggctttagagagaaagtgaaggccggaaaacagcggttcgaagaacttccggtttctctgttttccgaagataaggagaatgaaggcatcacaaaaagaaccgtgctgaagcgcatcctccaagggctgcatgctaacgccaccacaagcgaccttaaggtcctggatggaaaattctacaattga

SEQ ID NO: 4107 - RNA, 4002 nt, synthetic construct
  misc_feature 1..4002: note = Cas9 variant
  source 1..4002: mol_type = other RNA
atgaagaactacaccatcggcctggacattggggtggccagcgtcggatgggtttgcatcgatgagaattataaaattctcaactacaataacagacacgctttcggcgtgcatgaatttgagtccgccgaatctgcggctgggcggcgcctgaagagaggaatgcggcgcagatataatcggcgcaaaaagagacttcagctgctccaaagcctgttcgactcctacatcacagattctggctttttcagcaaaacggactcccagcacttttggaagaacaataacgagttcgaaaatcggtctcttaccgaggtgctgagctccctccgcattagctctagaaagtatcccacaatctaccatctgcggtccgatctgatcgagagcaacaaaaagatggacctccgcctggtctatcttgccctgcacaatctcgtgaaatacagagggcattttctgcaggaaggaaactggtctgaggccgcttccgccgaaggcatggatgaccagcttctggagctcgttacccggtacgctgagctggaaaatctgagccctctcgatctgtctgagtcccaatggaaggccgcggaaacacttctgctcaaccgcaatctgaccaaaacagaccagagcaaggagcttaccgccatgttcggcaaggaatatgagccgttttgtaaactggtggctgggctcggagtctccctgcaccagctgttcccctctagcgagcaggccctcgcttacaaggaaacgaaaaccaaggtgcaactgtccaacgagaacgttgaagaggtgatggaacttctgctcgaggaggaaagcgccctgcttgaggcggtccagcctttttatcaacaggtggtgctgtacgaactcctgaaaggcgagacatatgtcgccaaggctaaagtttctgccttcaagcaataccagaaggatatggcttccctgaaaaatctcctggacaagacctttggggaaaaagtgtatagaagctacttcatttctgataagaacagccagcgggagtaccaaaaatcccacaaggtggaggtcctttgcaagctggaccagttcaataaagaagccaagtttgccgagacattctataaagacctcaagaaactgctggaagataagtctaagaccagcatcggaacgacagagaaagacgagatgcttagaattatcaaggctattgattccaaccagtttctccagaaacaaaagggcatccagaatgcggccattccccatcagaacagcctgtacgaagctgagaaaatcctgcgcaatcagcaagcccactatcctttcatcaccacagaatggattgagaaggtgaagcagatcctcgcctttcggattccctactatatcgggcctctggttaaagacaccacccagtctccgttctcctgggtggaaagaaagggagatgctcccattacaccttggaactttgacgagcagatcgataaagccgcgagcgctgaggccttcatctctcgcatgcggaagacgtgtacctaccttaaaggccaagaagtcctgcccaagtccagcctcacatatgagagatttgaagtgctgaatgagctgaacggcattcagcttcgcaccacaggggccgaatccgacttccggcatagactctcttacgagatgaaatgctggatcattgataatgtttttaagcagtacaagaccgtgagcacgaaacgcctgctgcaggagctcaagaaatccccttatgctgacgaactgtacgatgagcacacaggagaaatcaaggaggtcttcggcacccaaaaagaaaacgcctttgctacctctcttagcgggtatatttccatgaaaagcatcctgggagccgtggtcgacgacaatcccgcgatgacagaggagctcatctactggattgccgtgttcgaagatcgggagatcctgcacctgaagattcaggaaaaatatccgtctatcaccgacgttcagagacaaaaacttgctctcgtgaaactgcctggctgggggcgcttctcccggctgctcattgatggactgccccttgacgagcagggccagagcgtcctggatcatatggagcagtactcttccgtgtttatggaagttctcaagaacaaaggcttcgggctggagaagaagatccagaaaatgaatcagcaccaggtggacggaacaaagaaaattagatatgaagatatcgaggaactggccggcagccctgctcttaagcgggggatctggcgctctgtcaaaattgtggaggagctcgtgagcatctttggagaacccgccaacattgttctggaggtcgcgagagaagacggcgagaagaagcggacgaaatccagaaaggatcagtgggaggaactgaccaaaacaaccctcaagaacgaccccgatctgaaatctttcatcggggagattaagagccaaggcgaccagcgctttaatgaacagcggttctggctttacgtgacacagcaaggaaaatgtctgtacaccggcaaggccctcgatatccagaacctgtccatgtatgaggtggaccatatcctgcctcagaattttgtcaaggacgatagccttgacaacctggctctcgtgatgccggaagccaatcaaagaaagaaccaggttgggcagaataagatgcccctggagattatcgaagctaaccagcaatacgccatgcgcacgctctgggagagactgcacgagcttaaactgatttcctctggaaagctcggccggctgaaaaagcctagcttcgatgaagtggacaaggataaatttatcgcccgccagctggtcgagaccagacagattatcaagcatgtgcgggaccttctggatgaacgcttctccaaatctgacatccacctcgttaaggctgggattgtgagcaaatttagacggttctccgagatccccaagattcgcgattataataacaagcaccatgcgatggacgccctgtttgctgccgccctcatccagtctattctgggaaaatacggcaagaatttccttgctttcgatctgagcaaaaaggacagacaaaaacagtggcggtccgtcaaggggagcaacaaggagtttttcctctttaaaaatttcggcaacctgcgcctgcagtctcctgtgacaggagaagaggtttccggcgtggaatatatgaagcacgtctactttgagcttccctggcagaccacaaaaatgacccaaacgggggatggaatgttctataaggaaagcatcttttctccgaaagtgaagcaggccaagtacgtgtcccctaaaacagagaagttcgtccatgacgaggttaaaaatcacagcatctgcctggtggaatttaccttcatgaagaaagagaaggaagtgcaggagacaaaatttattgacctcaaggtcatcgaacaccatcagttcctgaaggagcccgagtctcaactcgcgaaattcctggctgaaaaggagaccaactcccctattatccacgccagaattatccggaccattcccaaataccagaagatctggatcgaacattttccttattacttcattagcacaagagagcttcacaacgcccgccagtttgaaatctcctatgagctgatggagaaagtgaagcaactgagcgaacggtctagcgttgaggaactcaagattgtgttcggcctgcttatcgatcagatgaatgacaactaccccatttatacgaaatcctctatccaggatagagtccagaagtttgtggacacccaactgtacgatttcaagagctttgagatcgggttcgaggaactcaagaaagctgttgccgcgaatgctcagcgctccgacacatttggatctcggattagcaagaagccgaaacctgaggaagtggccatcggctatgagtccattaccgggctgaagtacagaaaaccccgctctgtcgtgggcacaaagcggtga

SEQ ID NO: 4108 - RNA, 4002 nt, synthetic construct
  misc_feature 1..4002: note = Cas9 variant
  source 1..4002: mol_type = other RNA
atgagccagaacatcgtggactactgcattggcctggatctcgggaccggatccgtcggctgggccgttgtggacatgaatcacagactgatgaagcggaacgggaaacatctttggggatctcgcctgttcagcaatgctgagacagccgcgaacagacgggcttcccgctctatcagacggcgctataataagagacgggaacgcattagactcctgcgggccatccttcaagatatggtgctggagaacgaccccacgtttttcattcgcctcgaacacaccagctttctggatgaggaagacaaagccaattacctgggcgctgattataaggacaactacaatctcttcatcgatgaggactttaacgattatacatactatcataaataccctaccatctaccacctgagaaaggccctttgtgagtccacagaaaaggctgacccgcggctgatttatctcgccctgcatcacatcgtcaaataccgcgggaatttcctttatgagggacagaagtttaacatggatgcgtctaatattgaagacagactgagcgacgtgttcacccagtttgccgatttcaacaatatcccctacgaggacgatgagaaaaagaacctcgaaattctggagatcctgaaaaagcctctctccaagaaagctaaggttgacgaagtgatggccctgattgctcccgagaaagattttaagagcgcctataaagaacttgtcacaggcatcgcgggcaacaagatgaatgtgaccaaaatgatcctgtgcgagcctattaagcagggggactctgagatcaagctcaaattctccgatagcaactacgacgatcaattttctgaagttgagaatgacctgggagaatatgtggagttcattgattcccttcacaacatctacagctgggtcgaactgcagacgattatgggcgccacccatacatacaatgcttctatctccgaggccatggtgagccggtataacaagcaccatgaggacctccagctgctgaaaaagtgtatcaaagacaatgtgcccaagaagtacttcgatatgtttagaaacgactccgaaaaactcaaggggtattacaattatattaaccacccttctaaagctccggtcgatgagttctacaagtatgttaaaaagtgcatcgaaaaggtggacacccccgaggccaaacagattctgcacgatatcgaacttgagaattttctgctcaagcaaaacagccgcacaaatggatccgtgccttaccagatgcagctggacgagatgattaaaatcatcgataaccaggccaagtactatcccgtccttaaagaaaagcgggagcaactgctcagcattctgaccttcaagatcccttactattttggccccctgaatgaaacgtctgagcatgcttggattaaaagactcgaggggaaggaaaaccagcgcatcctgccgtggaactaccaggacattgtggatgttgacgcgacagccgagggattcatcaaacggatgagatcctattgtacctactttcctgatgaagaggtgcttcccaagaatagcctgattgtctctaaatatgaagtgtacaacgagctcaataagatccgcgttgacgataaactgctggaggtggacatcaagaacgacatttacaatgaacttttcatgaacaataagacagtcaccgagaaaaagctcaaaaactggctggtgaataaccaatgctgtaataagaacgctgaaatcaaaggctttcagaaggagaatcagttcagcacctccctgacaccttggattgattttacgaacatcttcggcgaaattaatcagtctaactttgacctcatcgaggatatcatttatgacctgaccgtcttcgaggataagaaaatcatgaagcggagacttaaaaagaaatacgccctgcccgacgataagattaagcaaatcctcaaactgaagtataaagactggagccgcctgtccaagaaacttctcgatgggattgtggccgacaacaagttcggaagctctgttacagtgctggatgtcctggaaatgtcccggctcaatctgatggagatcatcaacgacagagatcttggctacgctcagatgattgaagccgcggctagctgccccgaggacgggaagtttacctataaagaagtgcagcgcctggccggatctcctgccctcaagcggggcatctggcagtccctgcaaattgttgaggagatcacaaaagtgatgaagtgtagaccgaaatacatttatatcgagttcgagcggagcgaagagaccaaggagcgcacggaatccaaaatcaagaagctggagaatgtctacaaagaccttgatgaacagacaaaggtggagtacaaaaccgtgctcgaagaactgaaggggtttgacaacaccaaaaagatttctagcgattccctgttcctctattttacacagctgggaaagtgcatgtactctggcaaaaagctggacatcgatagccttgacaaatatcagattgatcacatcgttccccaatccctcgtcaaggacgatagcttcgacaatagagtgctggtggtcccttctgagaaccagcggaaactggatgaccttgtggttccctccgacattagagtgaagatgaatagcttttggaagctcctgttcgatcatgaactgatctctcctaaaaagttttactccctcattaaaaccgagtatacagaacgcgacgaggaacggttcatcaacagacagctggtcgagacgcgccagatcaccaagaatgtgacacaaattatcgaggatcactacagcaccacaaaagttgctgccattagagctaacctttctcatgaatttcgggtgaagaatcacatctataagaaccgcgacattaatgattaccaccatgcccacgacgcgtacatcgtcgccctgatcggcgggttcatgagagatcggtatcccaacatgcatgacagcaaagctgtgtactccgagtatatgaagatgtttcgcaaaaataagaacgataaaaagagatggaaggacggattcgttattaacagcatgaattacccgtatgaagtggatggcgagctcatctggaaccctgacattatcaatgaaattcggaaatgtttctactataaggattgctactgcaccacgaaactggaccagaagtctgggcagatgtttaacctgaccgtccttcccaatgacgcccactcccctaaaggaacaaccgaggctgtgatccccgtgaacaagaatcgcaaagatgtcaacaagtacggcgggttcagcggcctgcaatatgttatcgtggccattgagggaaagaaaaagagaggcaaaaagacaaaactcgtgaagaagatctccggggtccctctgcacctcaaagcggcctctctggacgaaaagattaaatacatcgaggaaaaggagaatcttaccgatgtgaaaattatcaaggacagcattcccgttaaccagatgatcgagatggatggaggcgaatatctgctcacgtccccgatcgagtttgtgaatgggcggcagctggtcctgaacgaaaagcagtgtgctcttattgccgacatctacaatgctatttataaacaagattgcgacaacctggatgacgtgctcatgatccagctgtacattgagctcatcaataagatgaaagccctgtatcctgcctaccagtctatcgctgaaaagttcgagagcatgacagaggattacgttgcggtgtccaaagaagagaaggccgacattatcaagcagatgcttattatcatgcatcgcggacccagaaacggcaaaattcaatatgctgattttaatgtcggggaccggatcggcagaaagaacaaaatgtctctggacctcgaacgcgtgaccttcgttagccagtcccccacaggaatctacaccaagaaatataagctgtga

SEQ ID NO: 4109 - RNA, 4002 nt, synthetic construct
  misc_feature 1..4002: note = Cas9 variant
  source 1..4002: mol_type = other RNA
atgggcaaggagtactatctggggctcgacatcggaaccgatagcgtgggctgggccgtctgcgacacaaactacaaaattcccaagttcaaagggaatgctatgtggggaatcagactgtttgaaaagtccaactctgccgaggaacggcgcggcttcagaagctcccggcgcagaacgcagcggaaacgcgagagacttaagctgctcgaaatgctgtttgatgaggagatttctaagatcgaccctgcgttctttattaaacttcgggaaagcaatctgtatctcgaggataagtccaccaaaatcccgtactgtgttttctctgacgaaaactatacagataaggactttcaccgcgattaccccaccatctatcatctgagaaatgagctgattaaaagcaacaagcctcacgacgtgcggctcgtgtacctggcccttcatcacatcattaagaatcgcgggcatttcctgtttgattactcctataaaaacgacaagagcggagatttcatgcccatctacaatgacctcaaaaactatttttacgacaattatgagattgaactggattgctctgacgtcgatgagttcgctaacacacttaaggacaaatccaagggcaaaaccaagaagaatgccgaaatcgctgagctgtttggcgtgagcaaaaagtacgataaagttctctattctgccctgtccctgctcagcgggtcttccgtgaagctgttcgacattttcgatgacgaagctcttaaagatgtcgagaaaaagagcgtgtccttttctagcggattcgacgataacgccaatgactttcaatcctacctgggcgagagattcgaactcctggagaaacttaaggcggtttacgactgggccgtgctggctgatatcctcgacgggaaagaatatatcagcgaggccaaggtcgctatttacgaaaaacacaagcgggatctgaagacactgaaaaagtatatcaaaatttacatgcctgagaagaaagccgagatctttaacatttcttccaaggacaacaattatgtggcgtacagcaagcacatcaaaacctctaacggaacgggcgtgctcatcagcacctgtacacaggaagagttctgcgcctatctgaagaaaacccttgggatttgtaaggatgcttcctacgaagagatgtttaaagaaatcgaaaattctacattcatgcccaagcaggtcaccaaagacaacggagttgtgcctatgcaagtgaatgagaaggaactggtcgccattctcgataacgctaaggagtacctgccgtttcttctgaataaagacaacgatggcaagacggtgtatgacaaaatcaaggccctcttcgaataccgcattccctattacatcggccctctgaatacacatagcaccaaatcctggctggttagaagcaacgagaagatctatccctggaatattgaggatgtggtcgactttgataagtctgccgaaaaattcatcgagaacctcacatccaagtgcacctacctgcctcagtatgacgtgattcccaaacacagccttctgtacaataagttttgtgttctcaacgaactgaataacctgaaaatcgacggggagaagatttctgtgcagcttaagcaggatatctacaacgacctcttcaaaaagtattacaaagtcaccaataagaaactgtgcgattatctgaagtcccggaacattgctttcgacgaaatcagcggaatcgataatgactttaagtcctctctcaaaagctacaaggatctggtggcgtataaccttacagacgagcagaaagaggaaattgtcaaggccatcacgattttcggcgatgacaaaaagctgctcaaaaagagactgaagaatgagtttgggggatgtctgtccgatgacgaaatcaaaaagatttgcaaacttaagtacaccggctggtctaaactcagccgcgagttcctgacagatgtgaccgctgtttataaggaaacaggggagctgatcaacatcatttgtgccctctgggagaccaattacaacctgacgtcccttctgtacagcgacgaattttgctgcgacgataaggagaataaaacattcaacgacaagatcaatgaactcaactcttttggaaatgataaaaccctgaaccaaattgtggaggaactgtatgtctccccgcttgtgaagcggcctatctaccagagcctcctgattaccaaagagctggagaagatcatgaagtgtccccctaaaaagatcttcgttgaagtggccagaggcgctgaggaaaagaagcgcacagtctctcggagaaataaactcctggacctttataagtcctgcaagaacgattaccccctgctctttgacgagctgcagaacaataccacagatgacgagctgaaaagcgataaactttatctctacttcacgcagtttggcaaatgtatgtataccggggaaaacattgagctgggagacctgttcaataagaacctctacgatatcgaccatatttacccccaatctaaaatcaaggacgatagcctggacaatcgcgtgcttgtgaagaaaacaaccaacgccaagaaagataatgaatatcctctgtccagccagattcgggagaagatgacaccgcactggaaagcgctcctggacaagggcctgatcaacaaaaagaagtacgaaagacttgttcgcaattatcccctgtctgatgaggagctctcccagtttatcagccggcaactggtcgaaaccagacagtccacgaaagctgtggccaacattctcgagcagctgtaccctcgccccgacaccgaaatcgtgtatgtcaaggccgctcttgcctctgagttccggcaccagtacgatatgctgaaatgcagagaagtgaatgacctccatcacgctaaggatgcctatctgaacattgttgtggggaatgcgtacaacggaaaattcacacataataaggccaactttatcaagggcctgcaaaacaatgacaaggcttacaccgtcaaacttgatagcatgctgaagcacaacattgacggggcctggatcgctgataataacgagtccctcaatattgtgaagtctacaatgaacaaaaataacatccggtatacccgctacgccttcgagaagaagggcggactgtttaaagttacgatcctcaagaaaggcaatgggcaggcgagcattaagaaaaacgacaagagaaattccatcgaaaagtatggaggctacaaccaggtgtctagcacatatttctcctgtgtcgagcatgggaaagacaataaccggatgattagcatgttttctgtgaatctgtacgataagaacaaatatgaagagaatcctatcgcctaccttattgaaaactacggactgatcaaccccatcattaaggttaaaaaggtgaaaatccagtcctgcattagcttcgacaatatgctctgtcacctgggcgggaaggattctggcggatcccaaatcagctatagaccgggcgtccagctggtgcttgggtacgacaacgagcgctatattcggaatgtgatcagatgcgctggaggcgatctgcacctccagacctctaagaacgagaaagacatcgtcacagccgaaaagaatattgagctgtttaacctcctgatcgagaaaatgaagaataacatttacggggttctttattccaatctgggagataaactgtactgtagcaaggagaagttcgagaaactcgacatcgtggaacagtgcaacgtgattaagaatgtcctgaccatccttaaaaacaatgcttccaagggcgatctgaaaagcattgggatcaaggccaacggcgccatccgcctcaataacaacatttctgagatcaagaaagttaagagcattaaactgatcaatcaatccgtgaccggactctttgaacaggagattgaactgcttaacctgtga

SEQ ID NO: 4110 - RNA, 4002 nt, synthetic construct
  misc_feature 1..4002: note = Cas9 variant
  source 1..4002: mol_type = other RNA
atgagccagaacatcgtggactactgcattggcctggatctcgggacaggatccgtcggctgggccgttgtggacatgaatcacagactgatgaagcggaacgggaaacatctttggggatctcgcctgttcagcaatgctgagacagccgcgacgagacggtcctctcgcagcatcagacggcgctataacaagagacgggaacgcattagactcctgcgggctatccttcaagatatggtgctggagaaagaccccacctttttcattcgcctcgaacacacatcctttctggatgaggaagacaaggccaaatacctgggcaccgattataaggacaattacaacctcttcatcgatgaggactttaatgattatacatactatcataagtaccctaccatctaccacctgagaaaagccctttgtgagtctacagaaaaggctgacccgcggctgatttatctcgccctgcatcacatcgtcaaataccgcgggaacttcctttatgagggacagaagtttaatatggatgctagcaacattgaagacaaactgtccgacgtgttcacccagtttgccgatttcaataacatcccctacgaggacgatgagaagaagaatctcgaaattctggagatcctgaaaaagcctctcagcaaaaaggcgaaagttgacgaagtgatggccctgatttctcccgagaaggaatttaaatccgcttataaggagcttgtcacgggcatcgccggcaacaagatgaatgtgaccaaaatgatcctgtgcgagagcattaagcagggggattctgaaatcaaactcaagttctccgacagcaactacgatgaccaattttctgaggttgaaaacgatctgggagagtatgtggagttcattgactcccttcacaatatctacagctgggtcgaactgcagacaattatgggcgctacccatacagataacgcctccatctctgaggcgatggtgagcagatacaataaacaccatgaagacctccagctgctgaagaagtgtatcaaagacaacgtgcctaagaaatatttcgatatgtttcggaatgactccgagaaggtcaaagggtactataactacattaatagacccaacaaggcccctgttgatgagttctataagtttgtgaaaaagtgcatcgaaaaagtggacaccccggaagctaagcagattctccacgatatcgagctggagaatttccttctgaaacaaaacagccgcacgaatggatctgtcccctaccagatgcagctcgacgaaatgattaagatcatcgataaccaggccaagtattaccctgtgctgaaagagaagcgggaacaacttctgtccattctcacatttagaatcccctactatttcggccctctgaatgagaccagcgagcacgcttggattaaacgcctggaagggaaggagaaccagcggatcctcccctggaattaccaggacacagttgatgtggacgccaccgccgaaggatttattaaaagaatgcgctcttattgtacctacttcccggatgaggaagtcctgcctaagaacagccttatcgtgtccaaatatgaggtttacaacgagctgaataagattcgggtggacgataagctcctggaagtcgacgtgaaaaacgacatctataatgagctgtttatgaagaacaaaacagtcacggaaaagaaacttaagaattggctcgtgaacaatcaatgctgtagaaaggatgctgagatcaaaggcttccagaaggaaaaccagttttctaccagcctgacaccctggattgacttcaccaatatctttggcaaaattgatcagtccaacttcgacctgatcgagaagattatctacgatctcacagttttcgaggacaaaaagatcatgaagcgccggctgaaaaagaaatacgcgcttcctgatgacaagattaaacaaatcctgaagctcaagtataaagattggagcagactgtctaagaaactgcttgacgggattgtggccgataatcgctttggatccagcgtcaccgtgctcgacgttctggaaatgtctcggctgaacctcatggagatcattaatgataaggaactgggctacgctcagatgatcgaggaagcctccagctgccccaaagacgggaagttcacgtatgaggaggtggccaaacttgctggatcccccgccctgaagagaggcatctggcagtctctccagattgtcgaagagatcacaaaggtgatgaaatgtcggcctaagtacatttatatcgaatttgagcgcagcgaggaagcgaaagagagaaccgaatccaagattaaaaagctggagaacgtgtacaaggacctggatgaacaaaccaaaaaggagtataaatctgttcttgaggaactcaaggggttcgacaatacaaagaagatcagctccgatagcctgtttctgtacttcacccagctcggaaagtgcatgtactctggcaaaaagctggacatcgattcccttgacaaatatcagattgatcatatcgtcccgcagagcctggtgaaggacgattcttttgacaaccgggtgctcgtcctgccctccgagaaccaaagaaaactggatgaccttgtggttcctttcgacattcgcgataagatgtaccggttttggaagctcctgttcgaccacgaactgatcagccccaaaaagttttattctctcattaaaacagagtacacggaaagagatgaggagcgcttcatcaatagacagctggtggaaacccggcagattacaaagaacgtcacccagatcatcgaggaccattatagcacaaccaaagtggctgccattcgcgccaatctttcccacgaatttagagttaagaaccatatctacaagaatcgggatattaacgactatcaccacgctcatgatgcctacatcgtggctctgattggcgggttcatgcgcgacagataccctaatatgcacgatagcaaagccgtctattctgagtacatgaagatgttccggaaaaacaagaatgaccagaaaaagtggaaagatggatttgtgatcaactccatgaattatccctacgaagttgacggcaagctcatctggaacccggatctgattaatgagatcaagaaatgtttctattacaaggactgctattgcacgaccaaactggaccaaaagagcgggcagatgtttaaccttacagtgctgcctaatgatgcgcattccgccaaaggaaccacagaggctgtcattcccgtgaacaagaaccgcaaggacgtgaataaatacggcgggttctctggcctccaatacgtcatcgccgctattgaaggaaccaagaaaaagggcaaaaagctggttaaggtgagaaaactcagcgggatccctctgtatcttaagcaggccgatatcaaagagcagattgaatacgtggagaaggaggaaaaactgtccgacgtcaagatcattaagaacaatatccccctcaaccagctgattgagatcgatggacggcaatatctgcttacgtctcctacagaatgtgtgaatgcgatgcagctggttctcaacgaggaacagtgcaaactgattgccgacatctacaatgctatctataagcaggattttgacggcctcgataacatgctgatgattcaactttacctgcagctcatcgacaaactgaagaccctgtatcccatttacatggggatcgtggagaaattcgagaaacttacagaagattttgtcagcatttccaaagaggaaaaggccaatgtgatcaagcagatgctgatcattatgcacaaaggaccgcagaacggcaatatcatttacgacgatttcaacgttgggaagcgcatcggcagactcaatggacggaccttttatctggacaacattgagttcatctctcaaagccctaccggcatctacaccaaaaagtataaactctga

SEQ ID NO: 4111 - RNA, 4002 nt, synthetic construct
  misc_feature 1..4002: note = Cas9 variant
  source 1..4002: mol_type = other RNA
atgtacacctattacttcaaggagagcgaaatggtgtatgacgtcggcctggatatcgggacaggatccgttggctgggtggccctcgacgagaacgggaaactggctagagccaagggaaagaatcttgtgggcgtccggctgtttgatacggcgcagaccgctgccgaccgcagagggttccggacaacccgcagacggctctctcgcagaaagtggcggctgcgccttctggatgaactctttagcgccgagattaacgaaatcgactcctctttctttcaaagactgaaatacagctatgtgcaccccaaggatgaggagaataaggctcattactatggaggctacctgttccctacagaagaggaaaccaaaaagtttcaccggtcctacccgacaatttatcatctccgccaggagctgatggcccagcccaacaaaagattcgacatccgggagatttaccttgctatccaccatctggttaagtatcgcggccactttctctctagccaggaaaagatcaccattgggtccacgtacaatcctgaggatctggccaacgcgatcgaagtgtatgccgacgagaagggacttagctgggaactgaataaccccgagcaactcaccgagattatctctggcgaagctgggtacggactgaataagtccatgaaagccgatgaggctctgaaactcttcgaatttgacaacaatcaggataaagtcgccattaagacactgcttgcgggcctgaccgggaaccagatcgacttcgccaaactctttggaaaggacattagcgataaagacgaggctaagctgtggaaacttaaactggatgacgaagccctcgaggagaagtctcagacaatcctgtcccaactgaccgatgaagagatcgaactcttccacgctgtggttcaggcctatgacggcttcgtgctgattggccttctgaatggggccgatagcgtctctgctgcgatggtgcagctctacgaccagcatagagaggatcggaaactgcttaagtccctggcccaaaaagctggactcaagcacaagagatttagcgaaatctacgagcagctggccctggccacggacgaggctacaattaaaaacggcatctccaccgcccgcgaactcgtggaggaatctaatctgagcaaggaggtcaaagaggatacacttcggagactggacgaaaacgagttcctccctaagcagcgcaccaaagcgaactccgttattccccatcaactgcacctggctgaacttcagaagatcctccagaatcaggggcaatattacccttttctgctggacaccttcgagaaggaagatggacaggacaacaaaatcgaggagctcctgcggtttcgcattccgtattacgtgggcccccttgtgacaaagaaagatgtcgaacacgccgggggagacgccgataatcattgggtggagagaaacgaaggcttcgaaaagagccgggttacgccttggaattttgacaaagtgttcaacagagataaggctgcccgcgactttatcgaacggctgaccggcaatgatacatatctcattggggagaagaccctgccccagaactctctgagataccagcttttcacagtcctcaatgagctgaacaatgtgcgcgttaacggcaaaaagtttgactccaaaaccaaggctgatctgatcaatgacctcttcaaagcccggaagacggtgagcctgtctgcgcttaaagattatctgaaggcccaaggaaagggggacgtcacaattaccggactcgctgacgaaagcaaatttaactcctctctgagctcctacaatgatctgaagaaaaccttcgacgccgagtaccttgaaaacgaggataaccaggaaacactcgagaagatcatcgagattcagaccgtgttcgaagacagcaaaatcgcttctagagagctgtccaagctgcctctcgatgacgatcaggtcaagaaactgagccaaacacactatacgggctgggggcggctttctgaaaagctgctcgactccaaaattatcgatgagcgcggccagaaggtgagcattctggacaaactgaagtccacctctcagaattttatgagcatcattaacaatgataagtacggagttcaggcctggatcacagagcaaaacaccggctcctctaaacttacattcgacgaaaaggtgaatgagctcaccacgagccccgcgaacaaaagagggatcaagcagtcctttgccgtcctgaatgatattaaaaaggctatgaaggaggagccgcggagagtgtatctggagttcgcccgcgaagaccagaccagcgttcggtctgtgcctagatacaaccaactcaaagagaagtatcagtccaaaagcctgtctgaagaggctaaggtccttaaaaagacactggacggaaataaaaacaagatgtccgatgaccgctactttctctatttccagcagcaaggcaaggatatgtacaccgggagacccatcaattttgaacggctgagccaggactacgatattgaccatatcattcctcaggccttcacaaaagatgactctctggataaccgcgtgcttgtgagcagacccgagaatgcccggaagtccgacagctttgcttataccgatgaagttcagaaacaagacggatctctgtggacgtccctcctcaagagcggcttcatcaaccgcaaaaagtacgagagactgacaaaggcggggaaatatctggacggccagaagaccggatttatcgcccggcagcttgtcgagacacgccagattatcaaaaatgtggcttccctgattgaaggcgagtacgaaaactctaaggccgtggccatcagaagcgagattaccgctgatatgcggctcctggtcgggatcaaaaagcaccgcgaaatcaactccttccatcacgcctttgacgcgctgcttattaccgctgccggacaatatatgcagaatagataccccgatcgggactctacaaacgtgtataatgagttcgatagatacacgaacgactacctgaagaatctccgccagctgagctcccgggatgaggttagacgcctcaaatctttcggctttgtggtcgggaccatgcggaagggaaacgaagactggagcgaggaaaatacatcctatctgagaaaagtgatgatgttcaagaacatccttaccaccaaaaagacagagaaggatcgcggccctctgaataaagagacgatttttagcccgaagtctgggaaaaagctcatccccctgaactccaaacggagcgacacagccctgtacggcggatattctaatgtttactccgcttatatgacccttgtgagagccaacggcaagaatctgctcattaagatccctatcagcattgcgaaccaaatcgaagtcgggaatctgaaaattaacgattacatcgtgaacaatcccgctattaagaaattcgagaagatcctcatttctaaactgcctcttggacagctggttaacgaagacggcaatctgatctatctcgcctccaacgagtaccgccacaatgccaagcagctgtggcttagcaccacagatgctgacaaaatcgcctccattagcgaaaactctagcgacgaggagctgctcgaggcttacgatatcctgacctccgaaaatgtgaagaaccggtttcccttctttaagaaagacattgataagctctctcaggtcagagacgagttcctggatagcgacaaacggatcgccgtgattcaaacaatccttcgcgggctgcagatcgatgcggcctatcaggctccggtgaagattatctccaaaaaggtctctgactggcataagctgcagcaaagcggaggcattaaactctccgataattctgaaatgatctaccagagcgccacggggatttttgaaaccagagttaagatctccgacctgctttga

SEQ ID NO: 4112 - RNA, 4005 nt, synthetic construct
  misc_feature 1..4005: note = Cas9 variant
  source 1..4005: mol_type = other RNA
atgaagaacccctacaccatcggcctggacattgggacaaatagcgtgggatgggccgtcctcacgaaccagtatgatctggttaaaagaaagatgaaagtggctggcaattccgacaagaaacaaatcaagaagaacttctggggagtgcggctttttgatgacgggcagaccgccgtcgatcgcagaatgaatcggacagcgcgcagacggattgagcgcagacggaaccgcatctcttacctgcaggaaattttcgctgtggagatggccaatatcgacgccaactttttctgcagactcaatgatagcttttatgttgactccgaaaaacggaactctcgccaccctttctttgctaccatcgaggaagaggtggcctaccataagaattatagaacaatttaccatctgcgggaggaacttgtcaacagctccgagaaagctgatctgcgcctcgtgtatctggccctggcgcacatcattaagtacagaggcaatttcctcatcgaaggggccctggacaccaaaaacacatctgttgatggagtgtacgagcagtttattcaaacctataatcaggtcttcatgagcaacatcgaggaaggcacgcttgctaaggtggaggaaaacattgaggtggccaatatcctggctggcaagtttacccggagagaaaaattcgagcgcatcctccagctgtacccgggggagaagtccacaggaatgtttgcccagttcattagccttatcgtcggctctaaagggaacttccaaaaggtttttgacctgattgaaaagaccgatatcgagtgtgcgaaggactcctatgaagaggacctcgaagccctgctggctattatcggagatgagtacgccgaactcttcgtggctgccaaaaatacatataacgccgtggtcctgagctctatcattaccgtgacggctacagaaaccaatgcgaagctctccgccagcatgatcgagcggtttgacgctcacgaaaaggatctgggcgagctcaaagccttcattaagctgcatcttcccaaacagtaccaggaaatctttaacaatgccgctattgacgggtatgccggatacatcgatggcaagacaaaacaggttgacttctacaagtatctgaagaccatcctcgagaacattgagggcgcggattactttatcgctaaaattgaagaggaaaatttcctgagaaagcaacgcacctttgacaacggggccatccctcaccagctgcacctcgaggagctggaagccattatccatcagcaagctaaatattaccccttccttcgggaggattatgaaaagattaaatctctggtgacatttagaatcccttacttcgtcggacccctcgccaagggccagtccgagtttgcttggctgacgcgcaaggccgacggggaaatccggccttggaatattgaggagaaagtggatttcggaaagagcgcggttgacttcatcgagaaaatgaccaacaaggacacatatcttccgaaagagaatgtgctgcccaagcactccctctgctaccagaagtacatggtctataacgaactgaccaaagtgagatacattgatgaccagggcaagacaaattatttttctgggcaagagaaacagcagatcttcaacgatctgtttaagcagaaacgcaaggtcaaaaagaaggacctcgaactgttccttcggaacattaatcatatcgagagccctaccatcgagggactggaagattcctttaacgccagctacgctacgtatcacgacctcctgaaagtgggcatgaagcaagagattctggataatccccttaacacagaaatgctcgaggacatcgttaaaattctgaccgtgttcgaagataagcctatgatcaaagagcagctgcagcagttttctgacgtcctcgatggcggggtgctgaagaaacttgagagacgccactacaccggatggggccggctgtccgccaaactcctggttgggattagagaaaagcaaagccatctgacaatccttgactatctcatgaatgatgacggactgaaccggaatctgatgcagctcatcaacgactctaatctgagcttcaaatccattatcgagaaggaacaggtgtctaccacagataaagaccttcagagcattgtcgctgatctggccggctcccccgcgatcaagaaggggattctccaaagcctgaaaatcgtggacgagctggtgtctatcatgggctacccgcctcagacgattgttgtcgagatggcccgcgaaaaccagaccacaggaaagggcaaaaataactccaagcccagatacaaaagccttgagaaggctatcaaggaatttgggtctaaaattctcaaggagcaccctaccgataatcaagaactgaaaaacaatcggctgtatctctactatctgcagaacggaaaggacatgtacacaggccaggagcttgatatccataacctgtccaattatgacattgatcacatcgtgccccagagcttcattaccgacaactccatcgataatctcgtgctgacgtctagcgccgggaacagagagaaaggaggcgacgttccccctctggaaatcgtgcgcaagcggaaagtcttttgggagaaactttaccaagggaatctcatgtccaagagaaagttcgattatctgaccaaggctgaacgcggcggactgacagacgccgacaaagccagatttattcatcggcagctcgtggagacccgccagatcacaaagaacgtcgctaatattctgcaccagagattcaacaatgaaaccgataaccacggcaatacgatggagcaagtgcggatcgttacacttaaatctgcgctggtgagccagttccgcaagcagtttcagctctacaaggtcagagaggtgaacgactaccatcacgcccatgatgcttatctgaatggggttgtggccaacaccctgcttaaagtctacccgcaactggaacccgagttcgtgtatggagaataccaccagtttgactggttcaaggccaataaagctacagccaagaaacagttttataccaacattatgcttttctttggccaaaaggagcggatcatcgatgaaaacggggagattctgtgggacaagaaatacctcgagaccatcaagaaagtgctggattatcgccagatgaatattgtcaagaaaacagaaatccagaagggagagttctccaaggcgacgattaaacctaagggcaacagctctaaacttatccccagaaaggaaaattgggaccctatgaaatacgggggcctggattcccccaacatggcttacgccgttatcattgagcacgccaagggaaagaaaaagctcatctttgagaaaaagattatccggattaccatcatggaacgcaaaatgttcgagaaggacgaagaggcttttctggaagagaaaggctatagacatccgaaggtgctgacaaaacttcctaagtacaccctgtatgagtgtgaaaaggggcggagacgcatgctcgccagcgcgaatgaggctcagaaaggaaaccaactggtgctctctaatcacctggtctcccttctgtaccatgccaagaactgcgaagccagcgatggcaaatctctcaagtatattgaggctcaccgggaaacattcagcgagctgctggcccaggtgtccgagttcgctaccagatacacgcttgccgacgcgaatctgagcaagatcaacaatctctttgaacagaacaaagagggggacatccaggccattgctcaatctttcgttgatctgatggcctttaatgctatgggagcccccgcctccttcaagtttttcgaagctacaatcgaccgcaaacggtataccaacctcaaggagctgcttagctccaccattatctaccagtctattacaggcctgtacgaaagcagaaaacgcctggatgactga

SEQ ID NO: 4113 - RNA, 4005 nt, synthetic construct
  misc_feature 1..4005: note = Cas9 variant
  source 1..4005: mol_type = other RNA
atgaagaaaccctacaccatcggcctggacattgggacaaacagcgtgggatgggccgctctcacggatcagtatgacctggtcaagagaaaaatgaaggttgccggcaattccgagaaaaagcaaatcaagaaaaacctttggggagtgcggctggtggatgaagggaagaccgcggctcaccgcagagtcaatcggacaacccgcagacggattgagcgcagacggaaccgcatctcttacctccaggaaattttcacagccgagatgtttgaagtggacgccaatttcttttatagactggaggatagcttctacatcgagtccgaaaaacggcagtctcgccatcctttcttcgctaccatcgaggaagaggttgcctatcacgagaactacagaacaatttatcatcttcgggaaaagctggtgaatagctccgacaaagctgatctccgcctggtctacctggccctcgcgcacatcattaagtacagaggcaactttctgatcgaggggaagctcgacaccaaaaatacgtctgtggatgaagttttcaagcagtttattaaaacctataaccaagtgttcgccagcgacatcgaggaaggatccctgacacggattgaggagaataacgaagtcgctaagatctttagcgagaaactcaccaagagagaaaaactggataagatccttaatctgtacccgaacgagaagtctacagacctcttcgcccagtttatttccctgatcattggcagcaaaggcaatttcaagaaattctttaacctgaccgaaaagacggatatcgagtgcgctaaagactcttatgaggaagacctcgaggtgctgcttgcccgcgtgggggatgaatacgcggagattttcgtcgccgctaagaacgcctataatgctgttgtgctgtccagcatcatcacagtgtctaacaccgaaacaaaggccaaactctccgccagcatgattgagcggtttgacaagcatgataaagacctgaagagaatgaaggctttctttaaggtccgccttcccgagaatttcaacgaagtgtttaatgatgttgagaaggacggatacgcgggctatatcgaagggaaaaccaagcaggaggccttctacaaatacatgaagaaaatgctggagcacgtggaaggagctgattattttattaaccagatcgaggaagagaatttcctccggaagcaaagaacctttgacaacggcgccattcctcaccagctgcatctggaggaactcgaggccatcctgcaccagcaggctaagtactatcccttccttaaagtcgattacgaaaagatcaaatccctggtgacatttcgcattccttatttcgttgggcccctcgccaatggacaatctgagttcagctggctgacgcggaaggcggacggcgaaatcagaccttggaacattgaggaaaaagtggattttggcaagtccgctatcgacttcattgagaaaatgaccaataaggacacataccttccgaaggagaacgtcctgcccaaacatagcatgtgttatcagaagtacatggtgtacaatgaactcaccaaaatccgctatacagatgaccaggggaagacccactacttttctggacaagagaaacagcagattttcaacgatctgtttaagcagaagcggaaagtcaagaaaaaggacctggaactcttcctgtataatatgaaccacgtggagtcccctacggttgaaggcgtggaggatgcctttaacagctctttcacaacctaccatgaccttcaaaaagtcggggtgccccaggagatcctggatgaccctctcaataccgaaatgctggaggaaatcattaagatcctgacagtttttgaggataagagaatgattaacgagcgccttcaggagttcagcaatgtgctcgacgaagccgtcctgaaaaagctggaacggagacactataccggatggggccggctctccgctaaactgcttatcgggattcgcgataaggagtctcatctgacaatcctcgactacctgatgaacgatgacaaacacaatagaaacctgatgcagcttatcaatgacagcaacctctcctttaagagcattatcgaaaaggagcaagtgtctacggccgataaagacattcagtccatcgtggctgatctggccggaagccccgcgattaagaaaggcatcctgcagtctctcaagatcgttgacgagctggtcggcattatggggtatccgcctcagaccatcgtggtggaaatggcccgggagaatcaaacaaccggaaaaggcaagaacaattccaaacccagattcacaagccttgaaaaggctattaaggagctggggtcccagatcctcaaagaacatcctaccgataaccagggactgaagaatgaccgcctgtacctttactatctccagaacggcaaagatatgtacacggggcaagagctggacattcacaatctgtctaactatgatatcgaccacgtcgtgccccagagctttatcaccgataactccattgacaatcgggttctcgcctctagcgctgccaacagagagaagggcgataatgtgccctccctggaagtcgtgcgcaaaagaaaggtttactgggagaaactttatcaggcgaaactgatgagcaagcggaaattcgactacctcacaaaggccgaacgcggaggcctgaccgaggctgacaaagccagattcatccatcggcaactggtggaaacacgccagattaccaagaacgtcgctaatatccttcaccagagatttaactgcaagaaagatgagtctgggaatgtgattgagcaggttcggatcgtgacgctcaaggccgccctggtctcccaattccgcaaacagtttcagctgtataaggtgagagaagtgaacgactaccatcacgctcacgatgcgtacctcaattgtgtcgttgccaacacactgcttaaagtgtatcctcagctggagccggagttcgtgtacggagactatcatcaatttgattggttcaaggctaataaggccaccgccaaaaagcagttttacacaaacattatgcttttctttgctaaaaaggaccggatcatcgatgaaaatggcgagattctgtgggacaaaaagtatctggataccatcaagaaagtccttaactaccgccagatgaatattgtgaagaaaaccgaaatccagaagggggagttcagcaacgccacagcgaaccccaaaggaaattcttccaagctgattcctagaaaagctgactgggatcccatcaagtatggcgggtttgacggcagcaacatggcctacgccatcgttattgaacacgagaagcggaaaaagaaaacggtgatcaagaaagaactcattcaaatcaatattatggagagaaccgctttcgagaaggaccagaaggagttcctggaaggaaaaggctaccgcaaccctaaggtcatcacaaaaatccccaagtataccctctacgaatgcgagaatgggcggagacgcatgctgggatctgccaacgaagcgcagaaaggcaatcaaatggtgcttccgaaccatctgatgacactcctgtatcacgctaagaattgtgaggccagcgatgggaagtccctggcctacattgagagccatcgggaaatgtttgctgagcttctggactctatctccgaatttgccagcagatataccctcgctgatgccaacctggagaaaattaatacgatctttgaacagaacaagtccggagacgttaaagtgattgcgcagtctttcgtcaatctcctggagtttaacgccatgggcgctcctgccagcttcaagtactttgagacaaatatcgaacgcaaacggtataacaatcttaaggagctgctcaacgctaccattatctaccagtccatcaccgggctgtacgaagccagaaagcgcctggatgactga

SEQ ID NO: 4114 - RNA, 4005 nt, synthetic construct
  misc_feature 1..4005: note = Cas9 variant
  source 1..4005: mol_type = other RNA
atgaagaacccctacaccatcggcctggacattgggacaaatagcgtgggatgggccgtcctcacggatcagtatgacctggttaaaagaaagatgaaagtggctggcaactccgataagaaacaaatcaagaagaatttctggggagtgcggctttttgacgatggacagaccgccgtcgaccgcagaatgaaccggacagcgcgcagacggattgagcgcagacggaatcgcatctcttacctgcaggaaattttcgctgtggagatggccaacatcgatgccaactttttctgcagactcaatgacagcttttatgttgattccgaaaaacgcaattctcggcaccctttctttgctaccatcgaggaagaggtggcctaccataagaactatagaacaatttaccatctgcgggaggaacttgtcaatagctccgagaaagctgacctgcgcctcgtgtatctggccctggcgcacatcattaagtacagaggcaacttcctcatcgaaggggccctggataccaaaaatacatctgttgacgaggtgtacaagcagtttattcaaacctataaccaggtcttcatgagcaatatcgaggaaggagctcttgccaaggtggaggaaaacacggaggtggcttccattctggccggcaaatttacccggagagaaaagttcgagcgcatcctccggctgtacccgggcgagaaaagcacagggatgtttgcgcagttcatctctcttattgtcggaaacaagggcaatttccagaaagtttttaacctggtggaaaagaccgatatcgagtgtgccaaagactcctatgaagaggacctcgaagctctgctggccattatcggggatgagtacgctgaactcttcgtggccgccaagaatacatataacgctgtcgtgctgagctctattatcaccgttacggcgacagaaaccaatgccaaactttccgctagcatgatcgagagatttgacgcccacgaaaaagagctgggagaactcaaggccttcattaaactgcatcttcccaagcaataccaggagatctttaacaatgctgagattgatggctatgccgggtacatcgacggaaaaacaaaacaggtggatttctacaagtatctgaagaccaccctcgaaaacgtcgagggcgcggactactttattacaaagatcgaagaggagaatttcctgcgcaaacagcggacgtttgataacggcgtgatccctcaccaactgcacctcgaggagctggaagctattcttcatcagcaggccaagtattaccccttcctgagagaggggtatgacaaaatcaagtctctcgttacctttcgcattccttacttcgtgggacccctggccaatggccaatccgaatttgcttggcttacacggaaggatgacggggagatcagaccttggaacattgaggaaaaagtcgatttcggaaagagcgccgtggacttcatcgagaaaatgaccaataaggacacatatctgccgaaagaaaacgtcctccccaagcactccctgtgctaccagaagtacatggtgtataatgagctgaccaaaattcgctacatcgatgaccagggcaagacgaactatttttctgggcgggaaaaacagcaaatcttcaacgatctctttaagcagaaaagaaaggttaaaaagaaggacctggagcttttcctgcgcaatattaaccatatcgagagccctacaattgaaggactcgaggattcctttaatgctagctacgccacctatcacgacctgctgaaagtgggccttaagcaggaaatcctcgataaccccctgaataccgagattctggaagacatcgtcaaaatcctcacagtgttcgaggataagcggatgattaaagagcagctggaacaattttctgacgttcttgatggcgtggtcctgaagaagctcgagagacggcactacaccgggtggggacgcctgtccgcgaaactgcttgtgggcatcagagacaagcagagccatctcacaattctggattatctgatgaacgacgacgggctcaatcggaacctgatgcagcttatcaatgattctaacctgagcttcaaatccattatcgaaaaggaacaggtgtctacgaccgacaaagatctccaaagcatcgttgccgacctggctggatcccctgccattaagaagggcatcctgcagagccttaaaattgtcgatgagctcgtgtctatcatggggtatcccccgcagacaattgtggtcgaaatggctagagagaatcagaccacaggcaaggggaaaaacaattccaagcctcgctacaaaagcctggaaaaggccatcaaggactttggctctcaaatcctgaaagagcaccccaccgataaccaggaactcaagaataaccggctgtacctttactatctgcagaacgggaaagacatttacacgggacaagagctcgatatccataatctgtccaactatgacattgatcacatcgtgcctcagagcttcattaccgacaattccatcgataacctggttcttacatctagcgcgggcaatagagagaaagggggagacgtgcctcccctcgaaattgtccgcaagagaaaggtgttttgggagaaactgtaccagggcaacctgatgtccaagcggaagttcgactatctcaccaaagccgaacgcgggggcctgacagaggctgataaggccagatttatccatcggcagcttgttgaaacccgccaaatcacgaaaaatgtggctaacattctgcaccagagattcaataaggagacagacaaccacggaaataccatggagcaggtccggatcgtgacactcaaatctgccctggttagccagttccgcaagcaatttcagctgtacaaggtgagagaagtcaacgattaccatcacgcccatgacgcttatcttaatggcgtggtggcgaacaccctgctcaaagtctacccccagctggagccggagttcgtttatggggagtaccaccagtttgattggttcaaggccaataaagctaccgccaagaaacaattttatacaaacattatgctgttctttgcccagaaggaacggatcattgacgagaacggagagatcctctgggataagaaataccttgaaacgatcaagaaagtgctggactatcgccagattaatatcgtgaagaaaaccgagattcaaaagggcgagttctccaaggctacaatcaaacccaaggggaacagctctaaactcattcctagaaaggaaaattgggatcccgtcaaatacggaggcctggactcccctaacatggcctacgcggtgatcatcgagcacgctaaggggaagaaaaagattgttatcgaaaagaagctgattcagatcaatattatggagcggaaaatgtttgaaaaggatgaggaagccttccttgaggagaaaggctatcatcagcccaaggtgctgaccaagctcccgaaatacacactgtatgaatgtgagaagggaagacgccggatgctcagctctgccaacgaagctcagaaaggcaatcaactggtcctttccaaccacctggtgagcctcctgtaccatgccaagaattgcgaggcgtctgacgggaaaagcctgaagtatatcgaagctcacagagagaccttttccgagcttctggcccaggttagcgagttcgccacgaagtacacactcgctgacgccaacctgtctaaaattaataacctcttcgaacagaataaggaaggagatatcaaagctatcgcccagtcctttgtggacctgatggcgttcaacgccatgggcgctcctgccagctttaagttctttgaggctaccattgatcgcaaacggtataccaatcttaaggaactgctgtcctctacaatcatttaccaaagcatcaccgggctctacgagtccagaaagcgcctggacgattga

SEQ ID NO: 4115 - RNA, 4005 nt, synthetic construct
  misc_feature 1..4005: note = Cas9 variant
  source 1..4005: mol_type = other RNA
atgggcagaaagccctacatcctgagcctcgacattgggaccggatccgtgggctatgcctgcatggataaagggttcaacgtcctgaagtaccacgacaaagatgctcttggagtttatctgtttgacggcgccctcacagcgcaggagcggcgccaattcagaacgtctcggcgcagaaagaatcggcgcatcaaaagactggggcttctgcaggaactcctggctcctctggtgcagaacccgaatttttaccagttccaacggcagtttgcctggaagaacgataatatggacttcaagaacaaaagcctctccgaggtgctgtcttttcttggatatgaaagcaagaaataccccaccatttatcatctgcaggaggccctcctgcttaaggatgaaaaattcgaccctgagctgatctacatggctctctaccacctggtcaagtatcgcggccattttctgttcgatcacctcaagattgagaatctgacaaacaatgacaacatgcatgattttgtggaacttatcgagacctacgaaaatctgaacaatatcaaactcaacctggactatgagaagacaaaagttatttacgagatccttaaggataatgaaatgaccaaaaacgacagagccaagcgggtgaaaaacatgcagaagaagctggagcaattctccattatgctcctgggcctgaaatttaatgaagggaagctgttcaaccacgctgacaatgccgaggaactgaaaggagcgaaccagtctcacacattcgccgataattatgaggagaaccttaccccctttctgacggtcgaacagagcgagttcatcgaacgcgctaataagatttacctctccctgacccttcaggacatcctgaaaggcaaaaagagcatggccatgtctaaggtggctgcctatgataagtttagaaacgagctcaaacaagttaaggacattgtgtacaaagcggattccacacggacccagttcaagaagatctttgtcagctctaaaaagtccctgaaacagtacgacgccacacctaatgatcaaaccttcagctctctgtgtctctttgaccagtatctgatccgccccaagaaacagtactcccttctgattaaggaactcaagaaaatcattcctcaggatagcgagctgtatttcgaggctgaaaacgacacgctgcttaaggtgctcaatacaaccgataacgcctccatcccgatgcaaattaatctgtacgaggctgaaacaatcctgagaaaccagcagaaatatcatgccgagatcaccgacgaaatgattgagaaggtgctctctctgatccagtttcggattccctactatgtcgggcctcttgttaatgaccacaccgccagcaaattcggatggatggagagaaagtccaacgaaagcatcaaaccctggaactttgatgaggtggtggaccgctctaagtccgctacacaattcattcggagaatgacgaataagtgcagctacctgatcaacgaagatgtcctccctaaaaattctctgctgtaccaggagatggaggtgcttaacgaactcaatgcgacccagatccgcctgcagacagaccccaagaaccggaaatatagaatgatgccgcaaattaagctgtttgccgttgagcatatcttcaaaaagtacaagaccgtgagccactccaaattcctcgaaattatgctcaattctaaccaccgcgagaattttatgaaccatggcgaaaagctgagcatcttcgggacacaggatgacaaaaagtttgcttccaaactgagctcttatcaggatatgaccaagattttcggagacatcgagggcaagcgggcccagattgaggaaatcatccaatggattacgatctttgaggataaaaagattctcgtccagaaactgaaggaatgttaccctgagctgacatccaaacagatcaatcaacttaagaagctcaactatagcggctgggggagactgtctgaaaaactgctcacccacgcctaccagggacattccattatcgagctgcttcgccacagcgacgagaatttcatggaaatcctgaccaacgatgtgtatggctttcagaatttcattaaggaggaaaaccaggttcaatccaacaaaatccagcatcaggacattgctaatctcacaacctctcccgccctgaagaaagggatctggagcacaattaagctggtgcgggagcttacgtccatctttggagaacctgagaaaatcattatggagttcgcgaccgaagatcagcaaaagggcaaggagcagaaatctagaaagcagctctgggacgacaacatcaaaaagaataaacttaagagcgtcgatgaatacaagtacattatcgacgtggctaacaaactgaataacgagcagctccaacaggagaagctgtggctttatctgtcccagaatgggaaatgcatgtacagcggacaatctattgatctcgacgccctgctgtcccccaacgccacaaagcactatgaagtcgatcacatctttccccgcagcttcatcaaagacgattctattgacaataaggtgcttgttatcaagaaaatgaaccagaccaagggcgatcaggtgcctctgcagtttattcaacagccgtacgagcggatcgcttattggaaatccctcaataaggccggcctgattagcgactctaaactccataagctgatgaagcccgagttcacagctatggataaagaagggttcatccagagacagcttgtcgaaacccggcaaattagcgtgcacgttcgcgactttctgaaggaggagtaccctaacacgaaagtgatccccatgaaggccaaaatggtctccgagttcagaaagaagtttgatatccctaaaattcggcagatgaatgacgcgcatcacgccatcgacgcttatctcaacggagtggtgtaccacggcgcccagctggcttaccccaatgttgatctgttcgactttaacttcaagtgggaaaaagtcagagaaaagtggaaagcccttggggagtttaacaccaagcagaaaagccgcgaactgttctttttcaagaagctcgagaaaatggaggtgtctcaaggagaacggctgatttccaagatcaaactcgatatgaatcattttaagattaactatagcagaaaactggcgaatatcccgcagcagttctacaaccagacagccgtgtcccctaagaccgctgagcttaagtatgaatctaataaaagcaacgaggtcgtgtacaagggcctgacaccctatcaaacctacgttgtggccatcaaatccgtcaataagaaagggaaggaaaagatggagtatcagatgattgaccactacgtgttcgatttttacaaattccagaacggcaatgagaaggaactcgctctgtatctggcccaacgcgagaacaaagacgaagttcttgatgcccagatcgtgtactctctgaataagggagacctcctgtatattaacaatcatccttgttactttgtcagcagaaaagaggtgatcaacgctaagcagttcgagctcacggttgaacagcaactgtccctttataatgtgatgaacaataaggagacaaacgtcgaaaaactgctgattgagtacgattttatcgcggaaaaggtgatcaacgagtatcaccattacctcaattctaaactgaaggagaaacgggtgcgcaccttctttagcgaatccaaccagacacacgaggacttcattaaggcccttgatgaactgtttaaagtcgttaccgctagcgccaccagatctgacaagatcggctcccggaagaatagcatgacacaccgcgccttcctcgggaaaggaaaggacgtgaaaattgcttacacgtctatctccggcctgaagaccacaaaacccaagagcctctttaagctggccgagtctagaaacgaactttga

SEQ ID NO: 4116 - RNA, 4005 nt, synthetic construct
  misc_feature 1..4005: note = Cas9 variant
  source 1..4005: mol_type = other RNA
atgaagaacccctacaccatcggcctggacattgggacaaatagcgtgggatgggccgtcctcacggatcagtatgacctggttaaaagaaagatgaaagtggctggcaactccgataagaaacaaatcaagaagaatttctggggagtgcggctttttgacgagggagaaaccgccgcggatcgcagaatgaaccggacagctcgcagacggattgagcgcagacggaatcgcatctcttacctgcaggaaattttcgccctcgagatggccaacatcgacgctaactttttctgcagactgaatgatagcttttatgtcgactccgaaaaacgcaattctcggcaccctttctttgccaccatcgaggaggaagtggcttaccataagaactatagaacaatttaccaccttcgggaggaactggttaatagctccgagaaagccgatctccgcctggtgtatctggcgctcgcccatatcattaagtacagaggcaacttcctgatcgagggggctcttgacaccaaaaatacatctgtcgatggagtgtacaagcagtttattcagacctataaccaagttttcatcagcaatattgaagagggcacgctggccaagatggaagagaacaccacagtggctgacatcctcgccggcaaatttacccggaaggaaaaactggagagaatccttcagctgtacccgggggagaagtccacaggaatgttcgcgcagtttattagcctcatcgtcggctctaaagggaacttccagaaggtgttcgatctggtggaaaagaccgacattgagtgtgccaaggactcctatgaagaggatctggaagctctcctggccatcattggagacgagtacgctgagctttttgtcgccgccaagaatacgtataacgctgttgtgctgagctctatcatcacagtgaccgatacagaaaccaatgcgaaactctccgccagcatgattgagcgcttcgacgctcacgaaaaggatctgcgggagcttaaagcctttatcaagctgcatctccccaaacaatacgaagagattttctctaacgtcgccatcgacggctatgctgggtacattgatggaaagaccaaacaggtggacttttacaaatatctgaagacactgctcgagaatatcgaaggcgccgattacttcatcgcgaaaattgaggaagagaactttctgagaaagcagcgcacgttcgacaatggcgctatccctcaccagcttcacctggaggaactcgaggccattctgcatcaacaggccaaatattacccctttttcaaggaggcttatgataagatcaaatcccttgttacctttcggattccttacttcgtggggcccctggccaacggacagagcgactttgcttggctcacaagaaaggccgacggcgaaatccgcccttggaatattgaagagaaagtcgatttcgggaagtccgcggtggacttcatcgagaaaatgaccaacaaggatacatatctgccgaaggaaaatgttctgcccaaacactctctctactaccaaaagtatatggtgtacaacgagctgaccaaagtccggtatatcgacgatcagggaaagacgaattactttagcggccaggaaaaacagcaaattttcaacgactattttaagaaaaagagaaaggtgtccaaaaaggatcttgagcagttcctgcgcaatatgagccatatcgaatctcctacaattgaggggctcgaggactcctttaacagctcttacgccacctatcacgatctgctgaaagtcggaatcaagcaggaagtgcttgagaaccccctcaataccgaaatgctggaggacattgttaaaatcctgacagtgttcgaagataagcggatgatcaaggagcagctccaacagtttagcgacgtcctggatggcgctgtgcttaaaaagctggagagacgccactacaccggctgggggcggctctccgccaaactgctggttggaattagagacaagcagtctcatcttacaatcctcgactacctgatgaacgatgacggcctgaatcggaacctcatgcagctgattaatgatagcaacctttccttcaaaagcatcattgaaaaggagcaagtgtctacgaccgacaaggatctgcagtccatcgtcgctgacctcgccgggagccctgcgatcaaaaaggggattctgcagtctctgaaaatcgtggatgaacttgtgtccattatgggctatcccccgcagacaatcgttgtcgagatggcccgcgagaatcaaaccacagtgaaggggaaaaacaatagcagacctcggtacaagtccctcgaaaaggctattaaagagtttggctctcagatcctgaaggaacaccccaccgacaaccaggagctgagaaataaccgcctctatctgtactatcttcaaaatggaaaagatatgtacacgggccaggaactggacatccataacctcagcaattatgatattgaccacatcgtgcctcagtccttcattaccgataactctatcgacaacctggtcctgacaagctccgccgggaatcgggagaagggagacgatgtgcctccccttgagattgttagaaaacgcaaggtgttttgggaaaaactcttccagggcaacctgatgagcaagagaaagtttgactacctgaccaaagctgagcgcgggggactcacagaagccgataaggccaccttcatccatcggcaactggtcgagacgagacagattacaaagaatgtggctaacatccttcaccagcggttcaataacgaaaccgacaatcacggcaacaatatggagcaggttcgcatcgtgatgctgaagtctgcgctcgtctcccaatttagaaaacagttccagctgtacaaggtgcgggaggttaacgattatcatcacgcccatgacgcttacctgaatggggtggtcgccaacacacttctgaaggtgtatccccagctcgaaccggagtttgtgtacggcgaatatcaccaattcgattggtttaaagccaataaggctaccgccaaaaagcagttctacaccaacattatgctgtttttcgcgcagaaagagcgcatcattgacgaaaatggagagatcctctgggataagaagtatctggagacaattaaaaaggtccttgactacagacaaatgaacatcgttaaaaagacggaaatccagaaaggcgagtttagcaaggctaccattaagcccaaagggaactcttccaagctgatccctcggaaagaaaattgggatcccatgaagtacggaggcctcgacagccctaacatggcctatgccgtgattatcgagcacgctaaagggaagaagaaagtggtcttcgagaagaaaattatccgcatcacaattatggaaagaaaggcctttgagaaagacgaaaagtctttcctggagaaacagggataccggcagcccaaggtgctgaccaaacttccgaaatatacactgtacgaatgcgagaatggcagacgccggatgctcgcgagcgctaacgaggcccaaaaggggaatcagcaggttctgaaaggccagctcatcaccctgcttcatcacgccaagaactgtgaggcttccgatggaaaaagcctggactatattgaatctaatagagaaatgttcggcgagctcctggcccatgtgtccgaatttgctaagcgctacacgctggccgatgcgaaccttagcaagatcaatcaactgttcgagcagaacaaagacaatgatattaaggtcatcgcccagtcctttgtgaacctcatggctttcaatgccatgggggctcctgcctcttttaaattctttgaggccacaattgaacggaagagatataccaacctgaaagagctcctgagcgctaccatcatctaccagtccattacaggactttacgaagcgcgcaagcggctggacggctga

SEQ ID NO: 4117 - RNA, 4005 nt, synthetic construct
  misc_feature 1..4005: note = Cas9 variant
  source 1..4005: mol_type = other RNA
atgaagaacccctacaccatcggcctggacattgggacaaatagcgtgggatgggccgtcctcacgaaccagtatgatctggttaaaagaaagatgaaagtggctggcaattccgacaagaaacaaatcaagaagaacttctggggagtgcggctttttgatgacggacagaccgccgtcgatcgcagaatgaatcggacagcgcgcagacggattgagcgcagacggaaccgcatctcttacctgcaggaaattttcgctgtggagatggccaatatcgacgccaactttttctgcagactcaatgatagcttttatgttgactccgaaaaacggaactctcgccaccctttctttgctaccatcgaggaagaggtggcctaccatgataattatagaacaatttaccatctgcgggaggaacttgtcaacagctccgagaaggctgacctgcgcctcgtgtatctggccctggcgcacatcattaaatacagaggcaatttcctcatcgaaggggccctggataccaagaacacatctgttgacgaggtgtacaaacagtttattcaaacctataatcaggtcttcatgagcaacatcgaggaaggagctcttgccaaggtggaggaaaacctggaggtggcttccattctcgccggcaagtttacgcggagagaaaaattcgagcgcatcctgcggctttacccgggcgaaaagagcaccgggatgtttgcgcagttcatctctctgattgtcggaaataaaggcaacttccagaaggtttttaatctcgtggaaaagacagatatcgagtgtgccaaggactcctatgaagaggacctggaagctctgctcgccattatcggggatgagtacgctgagctgttcgtggccgccaaaaacacctataatgctgtcgtgcttagctctattatcacagttaccgcgacggaaacaaacgccaagctgtccgctagcatgatcgagagatttgacgcccacgaaaaggatctcggagagctgaaagccttcattaaacttcatctgcccaaacaataccaggaaatctttaataacgctgccattgacggctatgcggggtacatcgatggaaagaccaaacaggtggacttctacaagtatctcaagacaaccctggagaatgtcgagggcgctgattactttattaccaaaatcgaagaggaaaacttcctgcgcaagcagcggacatttgacaatggcgtgatccctcaccaactccacctggaggagcttgaagccattctgcatcagcaggccaaatattaccccttcctcagagaggattatgaaaagatcaaatctctggttacgtttcgcattccttacttcgtggggccccttgctaagggacaatccgagtttgcctggctgacccggaaggctgacggcgaaatcagaccttggaacattgaggagaaagtcgatttcggaaagagcgccgtggacttcatcgagaaaatgacaaataaggacacctatctcccgaaagagaacgtcctgcccaagcactccctgtgctaccagaagtacatggtgtataatgaactcacaaaagttcgctacattgatgaccaggggaagaccaactatttttctggccaggagaaacaacagatcttcaacgatctgtttaagcagaaacggaaggtgaaaaagaaggaccttgaactgttcctcagaaatatcaaccatattgagagccctacgatcgaggggctggaagattcctttaatgcgagctacgccacatatcacgacctgcttaaagtcggaatgaagcaggagtctctcgatagccccctgaacgctgaaatgctggaggacattgtgaaaatcctcaccgttttcgaagataagcgcatgattaaagagcaactgcagcagttttccgacgtgcttgatggcgtcgtgctgaagaagctcgagcggagacactacaccggctgggggcggctgtctgccaaactgcttgtgggaatccgcgacaagcagagccatctcacaatcctggattatctgatgaatgacgacggcctcaacagaaatctgatgcaacttattaacgattccaatctgtctttcaaaagcatcattgaaaaggagcaggtttccaccacagacaaagatctccagagcatcgtcgctgacctggccgggtctcctgcgattaagaagggaatcctgcagtcccttaaaatcgtggatgaactcgtgagcattatgggctatcccccgcaaacgatcgtcgtggagatggcccgggagaaccagaccacagttaaggggaaaaataactctagacctcgctacaagtccctggaaaaagctattaaggagtttggcagccagatcctgaaggaacaccccaccgacaatcaagagctcaaaaacaatcggctgtacctttactatctgcagaacggaaaggatatttacacaggccaggaactcgacatccataacctgtccaattatgatatcgaccacattgtgcctcagtctttcatcaccgataacagcattgacaatctggtccttacgtcctctgccgggaacagagagaaaggaggcgatgtgcctcccctcgagatcgttcgcaagagaaaagtgttttgggaaaagctgtaccaagggaatctgatgagcaaacggaagttcgactatctcaccaaggctgagcgcggaggcctgacagacgccgataaagccagatttattcatcggcagcttgtcgaaacccgccagatcacaaagaacgtggctaatattctgcaccagagattcaacaatgagaccgacaactacgggaatacgatggaacaagttcggatcgtgacactcaaatccgcgctggtcagccagttccgcaagcagtttcagctgtacaaagtgagagaggtgaacgattatcaccatgcccacgacgcttaccttaatggcgtcgttgccaacaccctgctcaaggtgtatccccaactggagccggagttcgtgtacggagaatatcatcagtttgattggttcaaggccaataaagctacagccaagaaacagttttacaccaacatcatgctgttctttgcgcaaaaggaacggattatcgacgagaacggcgaaattctctgggataaaaagtatcttgagaccatcaagaaagtcctggactaccgccagatgaatattgtgaagaaaacagagatccagaagggggagttctctaaagctacgatcaagcccaagggaaactccagcaaactcattcctagaaaggaaaattgggatcccatgaaatacggcgggctggactctcctaacatggcctatgccgttatcattgaacacgctaaggggaaaaagaagatcgtgattgagaaaaagctgatccagatcaatattatggagcggaaaatgtttgaaaaggatgaggaagccttccttgaggaaaaaggctacagacaccccaaggtcctgaccaaactcccgaagtatacactgtacgagtgtgagaaggggcgccggagaatgctcgcgtccgctaacgaagcccaaaaaggcaatcagctggtgcttagcaaccatctggtttctctcctgtatcacgccaagaattgcgaggctagcgacggaaaatccctgaagtacatcgaagcccatcgcgaggcttttagcgaacttctggcccaggtgtctgagttcgcgacccggtatacactcgccgacgctaacctgtccaaaattaataacctcttcgagcagaataaggaaggcgatatcaaggccattgctcagagctttgtcgacctgatggtgttcaacgccatgggggcccctgcttcctttaaattctttgaggcgaccatcgatagaaagcgctacacgaatcttaaagaactgctgtctagcacaattatctaccaatccatcaccggactctatgagtctcggaagagactggacgattga

SEQ ID NO: 4118 - RNA, 4005 nt, synthetic construct
  misc_feature 1..4005: note = Cas9 variant
  source 1..4005: mol_type = other RNA
atgaagaacccctacaccatcggcctggacattgggacaaatagcgtgggatgggccgtcctcacggatcagtatgacctggttaaaagaaagatgaaagtggctggcaactccgataagaaacaaatcaagaagaatttctggggagtgcggctttttgacgagggagaaaccgccgcggatcgcagaatgaaccggacagctcgcagacggattgagcgcagacggaatcgcatctcttacctgcaggaaattttcgccctcgagatggccaacatcgacgctaactttttctgcagactgaatgatagcttttatgtcgactccgaaaaacgcaattctcggcaccctttctttgccaccatcgaggaggaagtggcttaccataagaactatagaacaatttaccaccttcgggaggaactggttaatagctccgagaaagccgatctccgcctggtgtatctggcgctcgcccatatcattaagtacagaggcaacttcctgatcgagggggctcttgacaccaaaaatacatctgtcgatggagtgtacaagcagtttattcagacctataaccaagttttcatcagcaatattgaagagggcacgctggccaagatggaagagaacaccacagtggctaacatcctcgccggcaaatttacccggaaggaaaaactggagagaatccttcagctgtacccgggggagaagtccacaggaatgttcgcgcagtttattagcctcatcgtcggctctaaagggaatttccagaaggtgttcgacctggtggagaaaaccgatattgagtgtgccaaggactcctatgaagaggacctggaagctctcctggccatcattggagatgagtacgctgagctttttgtcgccgccaagaacacgtataatgctgttgtgctgagctctatcatcacagtgaccgacacagaaaccaacgcgaaactctccgccagcatgattgagcgcttcgatgctcacgaaaaggacctgtctgagcttaaagcctttatcaagctgcatctccccaaacaatacgaagagattttctccaatgtcgccatcgatggctatgctgggtacattgacggaaagaccaaacaggtggatttttacaaatatctgaagacactgctcgagaacatcgaaggcgccgactacttcatcgcgaaaattgaggaagagaattttctgcggaagcagagaacgttcgataacggcgctatccctcaccagcttcacctggaggaactcgaggccattctgcatcaacaggccaaatattacccctttcttaaggaggcttatgacaagatcaaaagcctggttaccttccgcattccttactttgtggggcccctcgccaatggacagtccgatttcgcttggctgacacggaaggccgacggcgaaatcagaccttggaacattgaagagaaagtcgactttgggaagtctgcggtggatttcatcgagaaaatgaccaataaggacacatatctgccgaaggaaaacgttctccccaaacacagcctgtactaccaaaagtatatggtgtacaatgagcttaccaaagtccgctatatcgatgaccagggaaagacgaactacttctccggccaggaaaaacagcaaatttttaatgattatttcaagcagaaacggaaggtgagcaagaaagacctggagcagtttctcagaaacatgtctcatatcgaatcccctacaattgaggggctggaggatagcttcaactctagctacgccacctatcacgacctgcttaaggtcggaatcaaacaggaagtgctcgagaatcccctgaacatggaaatgctggaggatattgttaagatcctcaccgtgtttgaagacaaacgcatgatcaaggagcaactgcagcagttctccggcgtccttgatggcgctgtgctgaagaaactcgagcggagacactacacagggtggggacgcctgtctgccaagctgcttgttggcattcgggacaaacagagccatctcaccatcctggattacctgatgaatgacgacgggctcaacagaaatctgatgcaacttattaacgattccaatctgagctttaagtctatcattgaaaaagaacaggtgtccacaacggacaaggatctccagagcatcgtcgctgacctggccggatctcctgcgatcaagaaaggcattctgcagtcccttaagatcgtggatgaactcgtgagcattatggggtatcccccgcaaaccatcgttgtcgagatggcccgggagaaccagacaaccgtgaaaggcaagaataactcccgccctagatacaaatctctggaaaaggctattaaggagttcggaagccagatcctgaaagaacaccccacagacaatcaagagctccggaacaatagactgtatctttactatctgcagaacggcaaggatatgtacaccgggcaggaactcgacatccataatctgtccaactatgatattgaccacatcgtgcctcagtcttttattacggataacagcatcgacaatctggtccttacctccagcgccggaaaccgcgagaaaggcgatgacgtgcctcccctcgagattgttcggaagagaaaagtgttctgggaaaagctgtttcaagggaatctgatgtctaaacgcaagttcgactacctcacaaaggctgagagaggaggcctgaccgaagccgataaagccacatttatccatcggcagcttgtcgagacccgccagattacgaagaacgtggctaatatcctgcaccagagattcaacaatgaaacagacaaccacgggaataacatggagcaagttcggatcgtgatgctcaaatccgcgctggtcagccagttccgcaagcagtttcagctgtacaaagtgagagaggttaatgattatcatcacgcccatgacgcttaccttaacggcgtggtcgccaataccctgctcaaggtgtatccccaactggaaccggagttcgtgtacggagaatatcaccagtttgattggttcaaggccaacaaagctacagccaagaaacagttttacaccaatattatgctgttctttgcgcaaaaggagcggatcattgacgaaaacggcgagatcctctgggataaaaagtatcttgagaccattaagaaagtcctggactaccgccagatgaacatcgttaagaaaacagaaatccagaagggggagttctctaaagctacgattaagcccaagggaaattccagcaaactcatccctagaaaggaaaactgggatcccatgaaatacggcgggctggactctcctaatatggcctatgccgtgattatcgagcacgctaaggggaaaaagaagattgtgtttgagaaaaagatcatccggattaccatcatggaacgcaaagccttcgagaaggatgaaaagagctttctggagaagcagggctacagacaacccaaagtccttacaaagctgccgaagtataccctctacgaatgcgagaacgggcggagacgcatgctggcgtccgctaatgaggcccagaaaggcaaccaacaggtgctcaagggacagctgattacacttctgcatcacgccaaaaattgtgaagctagcgacggcaagtctctcgactatatcgagtccaaccgggaaatgttcggggagctgctggcccatgttagcgagttcgctaaaagatacacccttgccgatgcgaatctgtccaagattaaccagctctttgaacagaataaggacaacgatatcaaagtgattgcccagtctttcgtcaatctgatggcttttaacgccatgggagctcctgccagcttcaagtttttcgaggccacgatcgaacgcaaacggtatacaaatctcaaggagctgcttagagctaccatcatttaccaatccatcaccggcctgtacgaagcgcgcaaacggctggacgggtga

SEQ ID NO: 4119 - RNA, 4005 nt, synthetic construct
  misc_feature 1..4005: note = Cas9 variant
  source 1..4005: mol_type = other RNA
atgaagaacccctacaccatcggcctggacattgggacaaatagcgtgggatgggccgtcctcacggatcagtatgacctggttaaaagaaagatgaaagtggctggcaactccgataagaaacaaatcaagaagaatttctggggagtgcggctttttgacgagggagaaaccgccgcggatcgcagaatgaaccggacagctcgcagacggattgagcgcagacggaatcgcatctcttacctgcaggaaattttcgccctcgagatggccaacatcgacgctaactttttctgcagactgaatgatagcttttatgtcgactccgaaaaacgcaattctcggcaccctttctttgccaccatcgaggaggaagtggcttaccataagaactatagaacaatttaccaccttcgggaggaactggttaatagctccgagaaagccgatctccgcctggtgtatctggcgctcgcccatatcattaagtacagaggcaacttcctgatcgagggggctcttgacaccaaaaatacatctgtcgatggagtgtacaagcagtttattcagacctataaccaagttttcatcagcaatattgaagagggcacgctggccaagatggaagagaacaccacagtggctgacatcctcgccggcaaatttacccggaaggaaaaactggagagaatccttcagctgtacccgggggagaagtccacaggaatgttcgcgcagtttattagcctcatcgtcggctctaaagggaacttccagaaggtgttcgatctggtggagaaaaccgacattgagtgtgccaaggactcctatgaagaggatctggaagctctcctggccatcattggagacgagtacgctgagctttttgtcgccgccaagaatacgtataacgctgttgtgctgagctctatcatcacagtgaccgatacagaaaccaatgcgaaactctccgccagcatgattgagcgcttcgacgctcacgaaaaggatctgtctgagcttaaagcctttatcaagctgcatctccccaaacaatacgaagagattttctccaacgtcgccatcgacggctatgctgggtacattgatggaaagaccaaacaggtggacttttacaaatatctgaagacactgctcgagaatatcgaaggcgccgattacttcatcgcgaaaattgaggaagagaactttctgcggaagcagagaacgttcgacaatggcgctatccctcaccagcttcacctggaggaactcgaggccattctgcatcaacaggccaaatattacccctttcttaaggaggcttatgataagatcaaaagcctggttaccttccgcattccttactttgtggggcccctcgccaacggacagtccgacttcgcttggctgacacggaaggccgacggcgaaatcagaccttggaatattgaagagaaagtcgattttgggaagtctgcggtggacttcatcgagaaaatgaccaacaaggatacatatctgccgaaggaaaatgttctccccaaacacagcctgtactaccaaaagtatatggtgtacaacgagcttaccaaagtccgctatatcgacgatcagggaaagacgaattacttctccggccaggaaaaacagcaaatttttaacgactatttcaagcagaaacggaaggtgagcaagaaagatctggagcagtttctcagaaatatgtctcatatcgaatcccctacaattgaggggctggaggacagcttcaactctagctacgccacctatcacgatctgcttaaggtcggaatcaaacaggaagtgctcgagaaccccctgaataccgaaatgctggaggacattgttaagatcctcacagtgtttgaagataaacgcatgatcaaggagcaactgcagcagttctccgacgtccttgatggcgctgtgctgaagaaactcgagcggagacactacaccggctgggggcgcctgtctgccaagctgcttgttgggattcgggacaaacagagccatctcacaatcctggactacctgatgaacgatgacggcctcaatagaaacctgatgcaacttattaatgattccaacctgagctttaagtctatcattgaaaaagaacaggtgtccacgaccgacaaggatctccagagcatcgtcgctgacctggccgggtctcctgcgatcaagaaaggcattctgcagtcccttaagatcgtggatgaactcgtgagcattatgggatatcccccgcaaacaatcgttgtcgagatggcccgggagaatcagaccacagtgaaagggaagaacaattcccgccctagatacaaatctctggaaaaggctattaaggagttcggcagccagatcctgaaagaacaccccaccgacaaccaagagctccggaataacagactgtatctttactatctgcagaatggaaaggatatgtacacgggccaggaactcgacatccataacctgtccaattatgatattgaccacatcgtgcctcagtcttttattaccgataacagcatcgacaacctggtccttacatccagcgccgggaatcgcgagaaaggagacgatgtgcctcccctcgagattgttcggaagagaaaagtgttctgggaaaagctgtttcaaggcaacctgatgtctaaacgcaagttcgactacctcaccaaggctgagagagggggactgacagaagccgataaagccacctttatccatcggcagcttgtcgagacgcgccagattacaaagaatgtggctaacatcctgcaccagagattcaataacgaaaccgacaatcacggcaacaatatggagcaagttcggatcgtgatgctcaaatccgcgctggtcagccagttccgcaagcagtttcagctgtacaaagtgagagaggttaacgattatcatcacgcccatgacgcttaccttaatggggtggtcgccaacacactgctcaaggtgtatccccaactggaaccggagttcgtgtacggcgaatatcaccagtttgattggttcaaggccaataaagctaccgccaagaaacagttttacaccaacattatgctgttctttgcgcaaaaggagcggatcattgacgaaaatggagagatcctctgggataaaaagtatcttgagacaattaagaaagtcctggactaccgccagatgaacatcgttaagaaaacggaaatccagaagggcgagttctctaaagctaccattaagcccaaggggaactccagcaaactcatccctagaaaggaaaattgggatcccatgaaatacggaggcctggactctcctaacatggcctatgccgtgattatcgagcacgctaaggggaaaaagaaggtggtctttgagaaaaagattatccggatcacaattatggaacgcaaagccttcgagaaggacgaaaagagctttctggagaagcagggatacagacaacccaaagtgcttaccaagctgccgaagtatacactctacgaatgcgagaatggccggagacgcatgctggcgtccgctaacgaggcccagaaagggaatcagcaggttctcaagggccaactgatcacccttctgcatcacgccaaaaactgtgaagctagcgatggaaagtctctcgactatattgagtccaatcgggaaatgttcggcgagctgctggcccatgtgagcgagttcgctaaaagatacacgcttgccgatgcgaacctgtccaagatcaatcagctctttgaacagaacaaggacaatgatattaaagtcatcgcccagtctttcgtgaacctgatggcttttaatgccatgggggctcctgccagcttcaagtttttcgaggccacaattgaacgcaaacggtataccaacctcaaggagctgctttccgctaccatcatctaccaatctattacaggactgtacgaagcgagaaaacgcctggacggctga

SEQ ID NO: 4120 - RNA, 4005 nt, synthetic construct
  misc_feature 1..4005: note = Cas9 variant
  source 1..4005: mol_type = other RNA
atgaagaacccctacaccatcggcctggacattgggacaaatagcgtgggatgggccgtcctcacgaaccagtatgatctggttaaaagaaagatgaaagtggctggcaattccgacaagaaacaaatcaagaagaacttctggggagtgcggctttttgatgacggacagaccgccgtcgatcgcagaatgaatcggacagcgcgcagacggattgagcgcagacggaaccgcatctcttacctgcaggaaattttcgctgtggagatggccaatatcgacgccaactttttctgcagactcaatgatagcttttatgttgactccgaaaaacggaactctcgccaccctttctttgctaccatcgaggaagaggtggcctaccatgataattatagaacaatttaccatctgcgggaggaacttgtcaacagctccgagaaggctgacctgcgcctcgtgtatctggccctggcgcacatcattaaatacagaggcaatttcctcatcgaaggggccctggataccaagaacacatctgttgacgaggtgtacaaacagtttattcaaacctataatcaggtcttcatgagcaacatcgaggaaggagctcttgccaaggtggaggaaaacctggaggtggcttccattctcgccggcaagtttacgcggagagaaaaattcgagcgcatcctgcggctttacccgggcgaaaagagcaccgggatgtttgcgcagttcatctctctgattgtcggaaataaaggcaacttccagaaggtttttaatctcgtggaaaagacagatatcgagtgtgccaaggactcctatgaagaggacctggaagctctgctcgccattatcggggatgagtacgctgagctgttcgtggccgccaaaaacacctataatgctgtcgtgcttagctctattatcacagttaccgcgacggaaacaaacgccaagctgtccgctagcatgatcgagagatttgacgcccacgaaaaggatctcggagagctgaaagccttcattaaacttcatctgcccaaacaataccaggaaatctttaataacgctgccattgacggctatgcggggtacatcgatggaaagaccaaacaggtggacttctacaagtatctcaagacaaccctggagaatgtcgagggcgctgattactttattaccaaaatcgaagaggaaaacttcctgcgcaagcagcggacatttgacaatggcgtgatccctcaccaactccacctggaggagcttgaagccattctgcatcagcaggccaaatattaccccttcctcagagaggattatgaaaagatcaaatctctggttacgtttcgcattccttacttcgtggggccccttgctaagggacaatccgagtttgcctggctgacccggaaggctgacggcgaaatcagaccttggaacattgaggagaaagtcgatttcggaaagagcgccgtggacttcatcgagaaaatgacaaataaggacacctatctcccgaaagagaacgtcctgcccaagcactccctgtgctaccagaagtacatggtgtataatgaactcacaaaagttcgctacattgatgaccaggggaagaccaactatttttctggccaggagaaacaacagatcttcaacgatctgtttaagcagaaacggaaggtgaaaaagaaggaccttgaactgttcctcagaaatatcaaccatattgagagccctacgatcgaggggctggaagattcctttaatgcgagctacgccacatatcacgacctgcttaaagtcggaatgaagcaggagtctctcgatagccccctgaacgctgaaatgctggaggacattgtgaaaatcctcaccgttttcgaagataagcgcatgattaaagagcaactgcagcagttttccgacgtgcttgatggcgtcgtgctgaagaagctcgagcggagacactacaccggctgggggcggctgtctgccaaactgcttgtgggaatccgcgacaagcagagccatctcacaatcctggattatctgatgaatgacgacggcctcaacagaaatctgatgcaacttattaacgattccaatctgtctttcaaaagcatcattgaaaaggagcaggtttccaccacagacaaagatctccagagcatcgtcgctgacctggccgggtctcctgcgattaagaagggaatcctgcagtcccttaaaatcgtggatgaactcgtgagcattatgggctatcccccgcaaacgatcgtcgtggagatggcccgggagaaccagaccacagttaaggggaaaaataactctagacctcgctacaagtccctggaaaaagctattaaggagtttggcagccagatcctgaaggaacaccccaccgacaatcaagagctcaaaaacaatcggctgtacctttactatctgcagaacggaaaggatatttacacaggccaggaactcgacatccataacctgtccaattatgatatcgaccacattgtgcctcagtctttcatcaccgataacagcattgacaatctggtccttacgtcctctgccgggaacagagagaaaggaggcgatgtgcctcccctcgagatcgttcgcaagagaaaagtgttttgggaaaagctgtaccaagggaatctgatgagcaaacggaagttcgactatctcaccaaggctgagcgcggaggcctgacagacgccgataaagccagatttattcatcggcagcttgtcgaaacccgccagatcacaaagaacgtgaccaatattctgcaccagagattcaacaatgagacggacaactacgggaatacaatggaacaagttcggatcgtgaccctcaaatccgctctggtcagccagttccgcaagcagtttcagctgtacaaagtgagagaggtgaacgattatcaccatgcgcacgacgcctaccttaatggcgtcgttgctaacacactgctcaaggtgtatccccaactggagccggagttcgtgtacggagaatatcatcagtttgattggttcaaggccaataaagccaccgctaagaaacagttttacaccaacatcatgctgttctttgcccaaaaggaacggattatcgacgagaacggcgaaattctctgggataaaaagtatcttgagacaatcaagaaagtcctggactaccgccagatgaatattgtgaagaaaacggagatccagaagggggagttctctaaagcgaccatcaagcccaagggaaactccagcaaactcattcctagaaaggaaaattgggatcccatgaaatacggcgggctggactctcctaacatggcttatgccgttatcattgaacacgccaaggggaaaaagaagatcgtgattgagaaaaagctgatccagatcaatattatggagcggaaaatgtttgaaaaggatgaggaggctttccttgaagaaaaaggctacagacaccccaaggtcctgacaaaactcccgaagtataccctgtacgagtgtgagaaggggcgccggagaatgctcgcctccgcgaacgaagctcaaaaaggcaatcagctggtgcttagcaaccatctggtttctctcctgtatcacgccaagaattgcgaggccagcgacggaaaatccctgaagtacatcgaagctcatcgcgaggcctttagcgaacttctggctcaggtgtctgagttcgccacacggtataccctcgcggacgccaacctgtccaaaattaataacctcttcgagcagaataaggaaggcgatatcaaggctattgcccagagctttgtcgacctgatggtgttcaacgctatgggggcccctgcctcctttaaattctttgaggctacgatcgatagaaagcgctacacaaatcttaaagaactgctgtctagcaccattatctaccaatccatcaccggactctatgagtctcggaagagactggacgattga

SEQ ID NO: 4121 - RNA, 4005 nt, synthetic construct
  misc_feature 1..4005: note = Cas9 variant
  source 1..4005: mol_type = other RNA
atgaagaaagagtacaccatcggcctggacattgggacaaacagcgtgggatgggccgtcctcacggaaaattatgatctggttaagaaaaagatgaaagtgtacggcaacaccgagacaaagtatcttaagaaaaatctgtggggagtgagactcttcgacgaaggggagaccgctgccgatcggcgcctgaagagaacaacccggcgcagatactcccggcgcagaaaccggatctgccgccttcaggacctgtttacagaagagatgaatcaagtcgatgcgaacttctttcacagactccaggagtctttcctggtgcccgacgaaaaagagtttgaacggcatgctattttcggcaagatggaggaggaagttagctattaccgcgagtttcctaccatctatcacctgagaaaacatctcgccgatacgtccgaacaggccgacctgcggcttgtgtacctggctctcgcccacattgtcaagtaccgcgggcatttcctgatcgagggagaacttaataccgagaactctagcgtgtccgagacatttagaaccttcatccaggtttataatcaaatttttcgggaaaacgaggtgccgctggctgtccccgataatatcgaagaactcttctctgaaaaggtgagcagagcccgcaaagtggaggcgattctgtccgtctacagcgaggaaaagtctacaggcaccctggcccagtttctcaaactgatggttggcaaccaggggcggttcaagaaaacgttcgaccttgaggaagatggaatcattcagatccctaaggaggaatatgaggaggaactggagacactcctggctattatcggcgacgaatacgccgagatcttttccgctaccaaaagcgtgtatgatgccgtggcgctttctgggattctgtccgtcacagacggagacaccaaggccaagctcagcgcttctatggtggagagatacgaagcccaccaaaaagatctggttcagttcaagcagtttatccgcaaagagctgcccgaaatgtatgctcctattttccgggacaattccgtgagcggctacgccgggtacgtcgagaactccaaggtggttacccaggccgaattttataaatacatcaagaaggctattgagaaagtgcccggagcggagtatttcctcgaaaagatcgagcaagaaacatttctggataaacagagaacgttcaataacggcgtcatccctcaccagattcatcttgaggaactggaggccatcattcaaaagcaggctacctactatccgtttctcgccgacaacaaagaggaaatgaagcagctggtgacattccgcatcccctactatgtcggccctcttgccgatggaaattctccctttgcttggctggagcggattagctccgaacctatcagacccgggaacctcgccgaggtggttgacatcaagaaaagcgcgaccaagttcattgaacgcatgacaaattttgatacctacctgccgacggagaaagtgctgcctaagcactctatgatctacgagaaatatatggtctacaacgaactcacaaaggtgtcctatgttgacgagcggggcatgaatcagagattcagcggggaagagaagaaacaaattgtggaggaactgttcaagcagtctcgcaaagtcaccaagaaacttctggagaagtttctcagcaacgagttcggactggtggatgtggctatcaaaggcattgagacctcctttaatgccgggtacggaacatatcatgacttcctgaagatcggcattacccgggaacagcttgataaggaggagaactctgaaacactcgaggaaatcgttaaaatcctgacggtctttgaggacagaaagatgattcgggaacagctgaaaaagtacacctatctcttcgacgaggaggtgctgaaaaagctggaacgcagacactacacaggctgggggcggcttagcgccaagctcctgatcggaattaaagagaagagaacccacaaaacaatcctggattaccttattgaagacgatggcgggaagcaacccatcaatcgcaacctcatgcagctgatcaatgactccgatctgagctttaaatctgagattgctgaagcccagtccgacatgaacaccgaggatctccatgaggtggtccagaatctggctggaagccctgccatcaagaagggcattcttcaatctctgaaaatcgtggacgaactcgttgatattatggggtccctgcccaagaacatcgtggtcgagatggcgcgggaaaatcagacgaccagcagaggccgcacaaactccaaccccagaatgaaagccctggaggaggctatgcggaatcttcgctctaacctcctgaaggaatatcctaccgacaatcaggccctgcagaacgatagactctacctgtattaccttcaaaatggaaaagacatgtatacaggcctggatctcagcctgcacaacctgtcctcttacgacatcgaccatattgtgccgcagagcttcaccacggataattcccttgacaaccgggttctcgtgagctctaaggagaatcgcgggaagaaagatgacgtcccctccaaggaagtggttcagaaaaacatcacactgtgggagaccctgaagaatagcaacctcatttctcaaaagaagtatgataatctgacaaaaggacttagaggcgggctgaccgaagacgatcgggctcactttatcaagcgccagctcgtggagaccagacagattacaaagcatgtcgcccggatcctggaccagcgcttcaactcccaaaaagatgaggaaggaaagacgatcagagcggtgcgggtggtcaccctgaaaagctctcttacaagccagtttagaaagcagttcgccattcacaaagttcgcgagatcaatgactaccaccatggccacgatgcttacctgaacggggtggtggccaactccctcctgcgggtctatcctcagctccaacccgaatttgtgtacggcgactatcctaagttcaatgcttacaaggccaacaaagccaccgctaagaaacagctgtatacaaatattatgaagttctttgcggaggatgccgttatcattgacgaaaacggagagatcctttgggacaaaaagaatattgctaccgtgaagaaagtcatgagctacccccagatgaacatcgtgaagaaaccggagatccagacgggctctttctccaaggaaacaattaaacctaagggggatagcgacaagctgatctccagaaaaaccaattggtctcccaagctctatggaggctttgatagccctcaagttgcctactccgtgattatcacctacgagaaagggaagaaaaaggtccgcgccaaggctattgtgggaatcacaatcatggaacagtctctgttcaaaaaggaccccgttagcctgcttgaggaaaaaggctatgccaaccctgaggtgctgattcatctccccaagtacaccctgtatgagctcgaaaatgggcggagacgcctgcttgcgtccgctaacgaggcccagaaaggcaatcaactggtcctcccggcctctctggtgacactgctttaccacgctaaacaggtggatgaagacagcggaaaatccgaggagtatgtccgggaacacagagccgagtttgcggaaatcctgaactacgttcaggctttcagcgagacgaagattctcgccaataagaacctgcagaccatcctcaaactgtatgaagagaataaggaggccgatattaaagaaatcgctgagtcttttgtgaaccttatgaagttctccgcctacggcgctcctatggactttaaattctttgggaagacaatcccccgcagccggtacacctctgtgggagaactgctgtccgccacaattatcaaccaaagcattaccggcctctatgagacgagacggaagctggtcgattga

SEQ ID NO: 4122 - RNA, 4005 nt, synthetic construct
  misc_feature 1..4005: note = Cas9 variant
  source 1..4005: mol_type = other RNA
atgagaaagccctacaccatcggcctggacattgggacaaacagcgtgggatgggccgtcctcacggatcagtataatctggttaaacggaagatgaaagtggctggctccgccgagaagaaacaaatcaagaagaacttctggggagtgcgcctttttgacgaaggagaggtcgcggctggcagacggatgaatcgcaccacaagacggcgcattgaaagacggcgcaacagaatcgcctacctgcaggagattttcgccgctgaaatggccgaggtggatgctaatttcttctatcggctcgaggactctttttacatcgaaagcgagaaacgccactccagacatcctttctttgccaccatcgaagaggaggttgcgtatcacgaagagtacaagacaatttatcatctgcgggaaaaacttgtgaactctagcgataaggccgacctgcgcctcgtctacctggctctggcccacatcattaaatacagagggaatttcctcatcgagggaatgctggataccaagaacacatccgtggacgaagtttttaagcagttcattcagacctataatcaaatctttgcttctgatattgaggagggcagccttacgcggctggaagagaacaaagaagtggccgagatcctctccgaaaagctgaccagacgcgagaaacttgacaagatcctgaaactctacacaggcgaaaagagcaccgggatgttcgcgcggtttattaatctgatcattggatctaaaggcgatttcaagaaggtcttcgacctggatgaaaaagccgagatcgaatgcgctaaggacacatatgaggaagacctcgaggccctgcttgctaaaattggggatgagtacgccgaaatctttgtggccgctaagtccacctataacgcggtggtcctgagcaatatcattacggttacagacaccgagacaaaagccaagctctctgcttccatgatcgaaagattcgataagcatgccaaagacctgaagcgccttaaagcctttttcaagatgcagctgccggagaaatttaacgaggtgttcaatgatattgaaaaggacggatacgctggctatatcgatgggaagaccacccaggagaaattttacaagtacatgaaaaagatgctcgccaacattgacggagcggattatttcatcgaccagatcgaagaggaaaactttctgcggaaacaaagaacattcgataatggcacgattccccaccagctgcacctcgaggagctggaagctatccttcatcagcaggccaagtactatccttttctgcgcaaggactacgagaaaattcggagcctcgtgaccttcagaatcccctattttattggccctctggccaacgggcaatctgacttcgcttggcttacacgcaaggccgatggagaaatccggccctggaatattgaggaaaaagtcgacttcggcaagtccgctatcgattttatcgagaaaatgaccaacaaggacacatacctgcctaaagagaatgtgctcccgaagcacagcctgtgttatcagaagtacatggtttacaacgaactgaccaaaattagatatatcgatgaccaggggaagacgcatcacttctccggacaagagaaacagcagatttttaatggcctcttcaagcagcaacgcaaagtgaagaagaaagatctggaacggtttctttacacaatcaaccacattgagtctcccaccatcgaaggggtcgaggacgccttcaatagctcctttgcgacctatcatgatctgcagaagggaggcgtgacacaggagatcctcgacaaccctctgaatgccgatatgctggaagagattgttaaaatccttaccgtgttcgaagacaagagaatgattaaagagcagctccagagcttttctgatgtcctggacggcacaatcctgaagaagctcgagcggcgccactacacggggtggggaagactgtccgctaaacttctgaccggcattcgggacaagcatagccacctcacaatcctggattatctgatgaacgacgatgggcttaatagaaacctcatgcaactgatcaatgactctaacctgagcttcaaatccattatcgaaaaggaacaggtgtctaccgccgataaagggattcagagcatcgtcgctgaactcgccggctcccccgcgattaagaaggggatcctgcaaagccttaaaatcgtggacgagctggttggcattatgggataccctccccagacaatcgtggtcgaaatggcccgcgagaaccagaccacgggcaaggggaaaaataactctaagccgcggtttatttccctcgagaaagctatcaaggaatttggaagccagattctgaaagagcatcctaccgataatcaatgcctgaagaacgacagactttatctctactacctgcagaatggcaaggatatgtatacagggaaagaactggacatccacaacctctctaattacgatattgaccacatcatcccccagtcctttattaccgataacagcatcgacaatcgcgtgctggtttcctctacagccaacagagagaagggagacaatgtgcctcttctggaagtcgtgcggaaacgcaaggctttctgggagaaactctatcaagccaagctgatgagcaagagaaaattcgattacctgaccaaggccgagcggggcgggcttacggaagctgacaaagcgaactttattcagcgccagctcgtggagacaagacagatcaccaagaatgttgccaacattctgtatcaacggttcaattgtaaacaggatgaaaacggcaacgaggtcgaacaggtgcgcatcgtgacactgaagtccaccctcgtctctcagtttagaaagcaattccagctgtacaaagtgcgggaggttaatgactatcatcacgctcatgatgcctaccttaacggagtggtcgccaataccctgctcaaggtgtacccccagctggagcccgaatttgtttatggcgactaccaccagttcgattggtttaaagctaacaaggccacagcgaaaaagcaattctatacgaatatcatgcgctttttcgctaaggagaaccagattatcgacaaaaatggggaaattctgtgggataacagataccttgacaccatcaagaaagtgctgagctatcggcagatgaatattgtcaagaaaacagagatccaaaagggagagttttccaacgccaccgtgaatcctaagggcaacagctctaaactcatctccagaaaggccgattggaatccgattaaatacgggggattcgacggcagcaacatggcttattctatcgttattgaatacgagaagcgcaaaaagaaaacagtgatcaagaaggaactgattcagatcaatattatggagcgggtcgccttcgaaaaagaccagaaggcgtttctcgaggagaaagggtactattcccccaaggtgctgaccaaaatccctaagtacacgctttatgaatgcgagaacggcagacgccggatgctgggaagcgctaacgaagcccagaagggcaatcaaatggtgctccccaaccacctgatgacactgctttaccatgccaaaaattgtgaggctaacgatggggaatctctggcctatatcgagatgcacagagagatgttcgctgaactcctggcctacattagcgagtttgcgaagcgctataccctcgccaatgaccggctggagaaaatcaacatgttctttgagcagaataagaaaggagatattaaggtcatcgctaagtccttcgacaaacttaaggtttttaacgccttcggcgctcctagagattttgagttctttgagaccacaattaaacgcaagcggtactacaatatcaaagagctgctcaacgccaccatcatttatcagagcatcacagggctgtacgaagccagaaagcggctggaggactga

SEQ ID NO: 4123 - RNA, 4008 nt, synthetic construct
  misc_feature 1..4008: note = Cas9 variant
  source 1..4008: mol_type = other RNA
atgaagaactacaccatcggcctggacattgggacaaatagcgtgggatgggccgtcatcaaagatgacctcacgctggttagaaagaaaattaagatctccggcaacaccgataaaaaggaggtgaagaaaaatctttgggggtctttcctgtttgaacagggagacacagctcaagatacccgggtgaagcgcattgccagacggcgctatgagagacggcgcttcagaatccgggaactccagaaaatctttgacaagagcatgggcgaggtcgattccaacttctttcaccgcctggacgaatctttccttgtggaggaggataaagaatacagcaagtatcccatttttagcaatgagaaggaagacaaaaactactatgataagtaccctacaatctatcatctgagaaaagacctcgcggattctaatcagaaggctgacctgcggctgatttacctcgccctggcccacatgatcaaataccgcgggcatttccttattgagggagacctgaagatggatggcatcagcatttccgagagctttcaggagttcatcgactcttataacgaagtttgcgctctcgaagatgagaatctggaaatcatttacaacgacgagcttctgacccaaatcgagaatatttttaaacaggatatctccagaagcaagaagctcgaccaggccattgctctgttccagggcgtgaaacggcaatctctgtttgggatcttcctcacactgatcgtcggaaacaaggccaatttccagaaaatttttaaccttgaagatgacatcaagctggatctcaaagaggaagactatgatgagaatctggaggaacttctgtccaacattgacgagggctaccgcgacgtgttcctccaggcgaagaacgtttataatgccatcgaactgagcaagattctgaaaaccgatgggaaggagacgaaagctccgctctctgcccagatggtggaactgtacaaccaacacagagaggaccttaagaaatataaggattacatcaaggcttacctgcccgaaaaatatggagagacctttaaggacgccaccaaaaatggctacgcggggtatatcgatggaaagacatcccaggaggacttctacaaatttgtcaaggcccagctcaagggcgaagagaacggcgaatatttcctggaggctattgagaatgaaaactttcttcggaaacaaagatccttctacaatggggtgatcccttatcagattcatctgcaggagctcacagccgtgctggatcagcaagaaaagcactactcctttctgaaagagaaccgcgacaagatcatttctctcctgaccttccggatcccctactatgtcggacctcttgctaaaggcgaaagcagatttgcctggctggagcgctccaatagcgaggaaaagattaaaccctggaacttcgataagatcgttgacatcgataagtctgccgagctctttattgaaaatctgacgtcccgggacacatacctgcctgatgagccggtgcttcccaaaagaagcctcatctatcagaagttcaccattttcaacgaactgacaaaaatctcttacattgacgagcgcgggatcctgcagaattttagctcccgggagaagatcgctattttcaacgacctctttaaaaataagtctaaggtgaccaaaaaccagctggtcaagtatatcgaaaacaaagagcaaattatcgcgcctgaaattaagggaatcgaggatagcttcaattccaactacagcacctatatcgacctttctaaaattcccgatatgaagaagctgctcgaaaaagacgaggatgagatcctggaagagattatcaagattctgacaatctttgaagacagaaaaatgcgcaagcggcagcttatgaaattcaaggataagctctccgagaaagccatcaatcagctgagcaagaaacactacacgggctgggggcagctgtctgagaagctcattaacggaatcagagacgaacaatccaataaaaccattctggattaccttatcgaggacaacggctgtcctaagaatatgaaccgcaattttatgcagctgattaacgatgacacactcagcttcaaagaaaagatccggaaggctcaggatattaatcaggtgaacgacatcaaagagatcgttaaggacctgcccggctccccggccattaaaaaggggatctatcaatctattagaatcgtggatgaaattatccggaaaatgaaggaccgccctaagaatatcgtcattgagatggccagagagaaccagaccacacaggaaggcaaaaataagagcaaagctcggctgaagaaaatccaagagggacttgaaaacctcgattccgtgcatgttgagaagcaggccctggacgaagagatgctgaagtctcccaaatactatctctactgcctgcagaacgggaaggatatttataccggaaaagaccttgatatcggccagctgcaaacgtacgacattgatcacatcatccctcgcagctttattacagacaattccttcgataacctcgtgctgaccagctctaccgtcaatagagggaagctggacaacgtgccctcccccgacatcgtccggcagcagaaaggcttttggaagcagcttctcagagcgggactgatgagccaacgcaagttcaataacctgacaaaaggcaagctcaccgatagagaccggcagcagtttattaatcgccagctggtggagacaagacaaatcacgaaacatgttgctaaccttctgtctcaccacctcaatgaaaagaaagaggtgggggaaattaacatcgtcctgctgaagtccgcccttaccagccagttccggaagaaattcgatttttataaggtgcgcgaggttaatgactaccatcacgcccatgatgcttacctgaacggagtgattgccctcaaactgctcgaactgtatccttacatggctaaggaccttatctatggcaaatactcttatcacagaaagatcgagggggataaagccacacaggcgaagtacaagatgagcaatattatcgagcggttctcccaagacctgctcgccaacccggatggagaaattgcttgggagaaagacaaggatctgaataccatccgcaaagtcctgagctctaagcagattaacatcatcaaaaaggccgaagagggcaaggggagactttttaaagagacaattaactcccggcccagcaagaaaaccgaaaagcgcatccctattaaaaataacctggaccccaatatctatggcggatacattgaggaaaagatggcttactatatcgccatcaactacctcgagaatggcaagacgaaaaaggcgattgtggggatctccattaaagataagaaagacttcgaaggacagaccacagagtatctgggcaagatcgggtttaacaaggcctctattatcaatagcttcaaaaactacaccctctttgagctggaaaatggatccagacggatgattgtgggcgcttctaaggagaacgacagcaaaggggaacttcagaagggcaatcaaatgtatctgcctcagaacctcctggagttcgtttaccatctgaaacactataatgaagatgagacatcccacaagtttatcgtcgagcataaagcctacttcgacgaacttctgaactacatcgtggagtttgctaataagtatctcgaactggagaactctattgaaaagatcaaagatctctaccacggaaagggccccgacgtggaggagaaagaactggtcgagagcttcattaatcttctggccatcaccaagtgtgggccggccgctgatattacgttcctgggagagaaaatctccagaaagcgctatcggagcacaaactgcctctggggctctgaagtgatctttcagtcccctaccgggctgtacgagacaagacttcgcctggaatga

SEQ ID NO: 4124 - RNA, 4011 nt, synthetic construct
  misc_feature 1..4011: note = Cas9 variant
  source 1..4011: mol_type = other RNA
atggacgataactaccagctgatgcacgccaagggcaaatatgggtacggaaccagaatctatagcgagggccaaacagctgccgaccggcgcgggttcagaacgacccggcgcagactcaatcggcgcaagtggagactgcggcttctgcaggactttttcgaaccctacattctccctcaggatgaggcgtttttcatccgccagaaacaatccaacctggtgccgcaggatacaaagaaacagtatcccgaatctgtcctttttgacgataccagcgacaaggatttctacacagagtatcctaccatttaccatctgagacaggctctcatgacagaaaatcggcaatttgacatccgcgaggtttacctggccattcaccatatcgtgaagtatagaggacacttcctgaacaatgcccccgtgaaaacctttaagtccggcaacctcgatctggctatcaaattcaatgagcttaacgaagagtttaagtctgtctaccctgacctggaactccagttcaatctggatcagattgacgagatcaaaaagattcttctggacagcacgaagtcccggtttgatcgccagggggaggccgtgaaactcatctataccgtttctgaagtgaagacaattgagaaactgcaaaacaagatcgtcaaacagttcctgagcggcattctcggactgaataccagattcgacgtgcttacaaacaccgaatccgatgacagcatgtggaagttttctctggattccgagagctctgacgatgctctcgacgaaatcatcgcccagctggatgaccccgcgattcatgttgtggagcttgtcaatgagatccactccagcattacgctggccggcatcgtgcctgaagggcaaggactctctgagtccatggtggaaaaatacgaggctcacaaggcccatctgcagctgctcaaggctgtcgaaaaactggttgataagaaagccgcggacaaacttgaggtggcctatgaccagtacattaacggcaaagatagcaagcagttcatcaaggaggacttttataaagctgtgcaatccgaaatcaagggggtcgccggagatgaggtggctgaaattaatcagctgatcgagctcgaccagttcatgccgaaacagcggacaaaggaaaacggcgccattccccaccaactgcatcagcacgagcttgatgttatcattgagaaccagtctaaatactacgactggctgggggaaaaggtgggaaatgagtataagctcgataaactggtcagctttagagtgccttactatgttggccccctggtggacaccgcctccaaggaaaagaaggatgagacacgcttcgcttggatggtccggaaaaaccctgagagcaccgaagcgatcaccccctggaattttgaggacatcgtggataagaacgcctctgctgaaaatttcattaagagaatgacaacgaaagacaagtacctcctgaacgaggatgtccttccgaaatgctccctgctcacccaggactttgaagtgtataatgagctgaacaatatccgcgttaacggcgagaagttcacagccgaacaaaaacagctgattcacgacgagctttttaccaagcatgccagcgtgtctatcaaacagctcaaggatttcctggtcagcgaactgatgtacgtgcgggacaatctcaaggttgaggggctggctgatgaaaagaaacttatgtcctctctgagcacacagtttgactatcaaaagattatccctgatcagattaacgacgtgaagtacagagaggatatcgagcagatcattgaatggtccaccatcttcgaggacgccgcgattttcaaaacgaagctcaaggaaatcgattggctgacagacgagcaacgcaataaactggctaacaagcggtacagaggatggggcagcctttctaaacgcctcctggcctgtctggtcgatgaaaatgggcagcggattatcgacatcctcagagattccagcgacaactttatgatgattgtgaaccgccccgagttcaagcaggccatctttgacgagaatgctaacctgaccgaaaccaattctaaaaaggatatgttcgagatgattgacaacttttatacatcccctcagaataagaaagccatccggcaagtgcttctggttgtccaggatattcagaacgctatgggaggcgtggcgccccagaagatcttcatcgaatttgccagagaggacgaggtgaatgggcggcgcaccaacagcagatactcccaaattcgggaaatgtattctaaagtcacagatgacgtgatcaataagacggttagaggagagctcgaagccaacaaaggcagcctgaataaggagaagctgttcctttactttctccagggcgggattgatctgtattccggaaaaaccatcaacattgacaatatctctagctacgatgtggaccacgtcctgccccagtccttcatcaaggatgacagcattaacaataaagtgctcgttaacgctaagggcaaccgcgtgaaaaatgacaacgtccctatggaactgtttggggccaagatgtatccgacatggaaacggatggtggataccggaatcatgtctaaggctaagttcaaaaatcttacactgaaccccgacaatgttgataagtttaaagccgagggcttcattaacagacagctcgtggagacccgccaaatcattaagctggtcgcgcagatcctgaatgacaaacttggggatgacacgaagattgtgtccgtgaaggccaacctcacccatgatatgagagtcttctttgacttccctaaaaatcggaacgttaataactaccaccatgcttttgatgcctacctgagcgctttcgtgggcacatatctgtacaagcgctatcccaaactccagccttactttgtgtatggagagttcaagaaaatggacaagctgaagaatatgacctcttttgatttccttagagacctgaaacacacagataaggtcgtggacaaagacaccggcgaaatcatcgccgataagctcgccgttattacgaacatgaataaaatctacgactttaagaaggtgctggtcacacacgaagtgcatgagaactccggggctatgtatgatcaaaccctgtaccccgcgaaacttgacaagagcctgggacggaaaggcgccaagcagctcattccgaaaaaggatgacatgcctacagctctgtacgggggatataccggctctaaggatgccttcatgagcatcgttcgcctcaaaaagaaagacgaagtgtactataaggtcattgggatccccgtgagaatcgccgattccgttcagcacggcaaagaggtggacgtcgaggctctgacccagtttattgaaacaaagttcacgaaagagaaccttaataagaagaccggagaaatcacacggaaagtggagtggttcgaactggtgctccctaaggtcctgtttggccaagccgttttcgatgggggacagccctttatgctgggcagctctacctaccctcataaccttcgcgagctggtgctcacaaaagactccgtgaagaaaattgcggggaaggagagcaataagtcctatctggatgcttacgacgaaatcatggaggccatgaacaaatatttccccctctacgacaccaataagtttagagaaaaagtcattgagggacggtctaagttcatcgatctgccggacaaagatgagtacgaaaacaataaacttgtgcaggttggcaagagcacgatcattgaccgcatgtttatcgggctgcacgccaacgctgccagaacagatctcaaaaatattggcatcaccacccctttcggatttatgcagcaagcgtccggcattaagctgacaaaagacaccgtggtcctgttccagtctagcacagggctttttgagcggaaggtggctctgaaagatctctga

SEQ ID NO: 4125 - RNA, 4011 nt, synthetic construct
  misc_feature 1..4011: note = Cas9 variant
  source 1..4011: mol_type = other RNA
atgaccaaggactacacaatcggcctggatattgggacgaacagcgtgggatgggccgtcctcaccgacgattatcagctgatgaaaagaaagatgtccgttcacggcaatacagagaaaaagaaaatcaagaagaacttctggggagctcggctttttgacgaagggcaaaccgccgagttccgcagaacaaaacggaccaatcgcagacggctggcgcgcagaaagtaccggctctctaaactgcaggatctttttgctgaggaactgtgcaagcaggacgattgtttctttgtgcgcctcgaagagagcttcctggtgcccgaggaaaaacagtataagcctgcctccatttttccgacactggaggaagagaaggagtactatcaaaaataccccaccatctatcatctcagacagaagctggtcgactctacggaaaaagaggatcttcggctggtgtacctcgccctggctcaccttctgaagtaccgcggccatttcctctttgaagggtatctggacaccgagaacacaagcattgaagagtccttcagagtttttctggagcagtacggaaaacagtctgatcaacctctcatcgtgcaccagcccgtcctgaccatccttacagacaagctgagcaaaaccaagaaggtggaagagattctcaaatattaccctacggaaaagatcaattccttctttgcccagtgcctgaaacttattgttggcaaccaggctaatttcaagcggatcttcgatctggaggccgaagtgaaactccaatttagcaaggagacatatgaggaagacctggagtctctgctcgaaaagattggcgacgagtacctggatatcttccttcaggcgaaaaaggtccatgacgccattctgctctccgaaatcatcagctctaccgtgaaacacacacaggctaagctgtccagcgggatggtggagcgctatgagagacacaaagccgatcttgctaagtttaagcaattcgtcaaagaaaacgttccccagaaggccaccgtgtttttcaaagacaccacaaagaatggatacgcgggctacattaaagggaagacgacccaggaggaattttataagttcgtgaaaaaggagctgtctggagtcgtgggctccgagccttttctcgaaaagatcgatcaggagacattcctgctgaagcaacggacctacacaaacggggttattccgcatcaggtgcacctcatcgaactgaaagccattatcgaccagcagaagcaacattatccctttcttgaggaagctggacctaaaatcattgccctgttcaagtttagaatcccctactatgtcggccctctcgctaaggagcaggaggccagctccttcgcctggattgaacgcaaaaccgctgagaagatccacccctggaatttctctgaagtggttgatattgagaaaagcgcgatgcggtttatccagagaatgacgaagcaggacacatacctgccgaccgaaaaagtgctgcctaagaactcccttctctatcaaaagtacatgatcttcaatgagctgaccaaagtcagctacaaggatgagcgcggcgtgaaacagtatttttctggggacgaaaagcagcagattttcaaacaactgtttcagaaggagcggggaaagatcacagtcaaaaagctccagaacttcctgtacacccactatcatattgaaaatgcccacatctttggcattgagaaggctttcaacgcctcctacagcacatatcatgattttatgaaacttgccaaaacgaaccaaaagtctatgcaggaatggctggagcagcccgagatggaacctatcttcgaggacattgtgaagatcctcaccatctttgaagacagacagatgattaaacaccaactgagcaagtaccaggaggttttcggggagaaactgcttaaggaatttgctcgcaaacattatacaggatggggccggttctccgccaagctcatccacgggattagagatcgcaaaaccaataagacaatcctggactacctgattaacgatgacgatgtgcccgcgaatcggaacagaaatctcatgcagctgatcaacgacgagcacctttctttcaaggaagagatcgctaaagccaccgtctttagcaagcataaatccctggtggatgttattcaggacctccccggaagccctgccatcaagaaaggcatttggcaatctctgaagatcgtggaggaactgattgctatcatcggctacaagccgaaaaatattgtcatcgagatggcccgcgaaaaccagaagacgcaccggaccaaacccagacttaaggctctcgagaatgggctgaaacagattggatccacactgctcaaggaacagcctaccgataacaaggccctgcaaaaagagcggctttatctgtactatctccagaatggccgcgacatctacacaggggaacccctggatattgagaacctgcatcagtatgaggtggaccacatcatccctcggagcttcattgtggataattctatcgacaacaaggttcttgtcgcgtccaaacaaaatcagaagaaaagagacgatgtgcccaacaagcagattgtgaacgaacagagaatcttttggaatcaactcaaggaggccaaactgattagcccgaagaaatacgcttatctgaccaagatcgaactcacgcctgaggacaaagcccgcttcattcagcggcagctggtcgaaacaagacagatcaccaagcacgtggctaacatccttcatcaatcctttcaccaggaggaggaaggaacagattgtgacggcgttcagattatcaccctgaaggccaccctcacatctcagttccgccaaacgtttgggctgtacaaagtgagagagattaatccccatcaccatgcgcacgatgcctacctgaacggcttcatcgctaatgtccttctgaagcggtatcctaaactcgcccccgaatttgtgtacggaaagtatgttaaatacagcctggctcgcgagaacaaggccaccgccaaaaaggagttctattccaatattctcaagtttctggaatctgacgagcctttctgcgatgaaaacggcgagatctactgggagaaaagctatcaccttcccagaatcaagaaagtgctgtccagccatcaggtcaatgtggttaagaaagtggaacagcagaaagggggattctacaaggagacagtcaactctaaagaaaagccggacaaactcattgagcggaagaataactgggatgtgaccaaatacggcgggtttggatcccctgtgatcgcttatgcgattgccttcgtctacgctaagggcaagacacagaaaaagacccgcgccatcgaagggattacgatcatggagcaagccgcttttgaaaaagaccccacaaccttcctgaaggataaaggctttccccaggttaccgagttcatcaagctgcctaagtatacactttttgagttcgacaatggaagacggcgctttctggccagccacaaagaatctcaaaagggcaacccgttcattctctccgatcagctggtgaccctcctgtaccatgcgcagcactatgacaaaatcacataccaggagagctttgactatgtgaatacgcatctttctgatttcagcgctattctgaccgaagtcctcgcctttgccgagaagtacacactggctgacaaaaacatcgaacggattcaagagctgtacgaggaaaacaagtatggggagatctccatgattgcccagagcttccttcagctgctccagttcaatgcgatcggagctcccgccgattttaaattctttggcgtgaccatccctagaaagcgctacacatctctgaccgaaatttgggacgccacgatcatttatcaatccgttaccgggctctacgagacaagaatccggatgggagatctgtgggctggcgagcagtga

SEQ ID NO: 4126 - RNA, 4011 nt, synthetic construct
  misc_feature 1..4011: note = Cas9 variant
  source 1..4011: mol_type = other RNA
atgaccaaggactacacaatcggcctggatattgggacgaacagcgtgggatgggccgtcctcaccgacgattatcagctgatgaaaagaaagatgtccgttcacggcaatacagagaaaaagaaaatcaagaagaacttctggggagctcggctttttgacgaagggcaaaccgccgagttccgcagaacaaaacggaccaatcgcagacggctggcgcgcagaaagtaccggctctctaaactgcaggatctttttgctgaagaactgtgcaagcaggacgattgtttctttgtgcgcctcgaagagagcttcctggtgcccgaggaaaaacagtataagcctgcctccatttttccgacactggaggaagagaaggagtactatcaaaaataccccaccatctatcatctcagacagaagctggtcgactctacggaaaaagaggatcttcggctggtgtacctcgccctggctcaccttctgaagtaccgcggccatttcctctttgaaggggacctggataccgagaacacaagcattgaagagtccttcagagtttttctggagcagtattctaaacagagcgaccaacctctcatcgtgcaccagcccgtcctgaccatccttacagataagctgtccaaaaccaagaaggtggaagagattctcaaatactatcctacggaaaagatcaatagcttctttgcccagtgcctgaaacttattgttggaaaccaggctaatttcaagcggatcttcgacctggaggccgaagtgaaactccaattttctaaggagacatacgaggaagacctggagtccctgctcgaaaagattggcgatgagtatctggacatcttccttcaggcgaaaaaggtccatgatgccattctgctcagcgaaatcatctcttccaccgtgaaacacacaaaggctaaactgagctctggcatggtggagcgctacgagagacacaaggccgaccttgctaagtttaaacagttcgtcaaggaaaacgttccccaaaaagccaccgtgtttttcaaggataccacgaaaaatgggtatgcgggatacattaagggcaagacaacccaggaggaattttacaaattcgtgaagaaagagctgtccggggtcgtgggaagcgagccttttctcgaaaagatcgaccaggagacattcctgctgaaacagcggacctatacaaacggcgttattccgcatcaagtgcacctcatcgaactgaaggccattatcgatcagcagaaacagcattacccctttcttgaggaagctgggcctaagatcattgccctgttcaagtttagaatcccctattacgtcggacctctcgctaaagagcaagaggcctcctctttcgcctggattgaacgcaagaccgctgagaaaatcaatccctggaacttcagcgaagtggttgacattgagaagtccgcgatgcggtttatccagagaatgacgaaacaggatacatatctgccgaccgaaaaggtgctgcctaagaatagccttctctaccagaaatatatgatcttcaacgagctgaccaaggtctcttacaaagacgagcgcggcgtgaagcaatacttttccggcgatgaaaaacagcagattttcaagcagctgtttcaaaaggagcgggggaaaatcacagtcaagaaactccagaatttcctgtatacccactaccacattgaaaacgcccagatctttggaattgagaaggctttcaacgccagctattctacataccatgactttatgaaacttgccaagacgaatcaaaaggctatgcaggaatggctggagcagcccgagatggaacctatcttcgaggacattgtgaaaatcctcaccatctttgaagatagacagatgattaagcaccaactgagcaaatatcaggaggttttcggcgagaagctgcttaaagaatttgcccgcaagcattacacagggtggggacggttctccgcgaaactcatccacggcattagagaccgcaagaccaacaagacaatcctggattatctgattaatgacgatgacgtgcccgctaaccggaatagaaacctcatgcagctgatcaatgatgagcatctttctttcaaagaagagatcgccaaggccaccgtctttagcaaacacaagtccctggtggacgttattcaggatctccccgggagccctgctatcaaaaagggaatttggcaatctctgaagatcgtggaggagctgattgccatcatcggctacaaaccgaagaacattgtcatcgagatggctcgcgaaaatcagaaaacgcaccggacctcccccagacttaaggccctcgagaacggcctgaaacagattgggagcacactgctcaaggaacagcctaccgacaataaggcgctgcaaaaagagcggctttacctgtattacctccagaacggacgcgatatgtatacaggcgaacccctggagatcgagaatctgcatcagtacgaagtggaccacattatccctagatctttcatcgtggataactccattgacaataaggttcttgtcgccagcaaacaaaaccagaagaaacgggacgatgtgcccaagaagcagatcgtgaacgagcagagaattttctggaatcaactcaaagaagctaagctgatctccccgaaaaagtatgcctacctgaccaaaattgagctcacgcctgaagacaaggctcgcttcatccagcggcagctggtcgagacaagacagattaccaagcatgtggccaacatccttcaccaatcttttaatcaggaggaagaggggacagattgtgacggagttcagatcattaccctgaaagcgaccctcacaagccagttccgccaaacgtttggcctgtataaggtgagagaaatcaacccccaccatcacgcccatgatgcttacctgaatgggttcattgccaacgtccttctgaaacggtaccctaagctcgctcccgagtttgtgtatggcaaatacgttaagtattccctggcccgcgagaataaagccaccgctaagaaggagttctactctaacatcctcaaatttctggaaagcgacgaacctttctgcgatgagaatggagaaatttattgggagaagtcccaccatcttcccagaatcaaaaaggtgctgagctctcaccaggtcaacgtggttaaaaaggtggagcagcagaagggcgggttctacaaagaaacagtcaattccaaggagaaaccggacaagctcatcgaacggaaaaacaattgggatgtgaccaagtatggaggctttgggagccctgtgattgcgtacgccatcgctttcgtctacgccaagggaaaaacacaaaagaaaacccgcgccattgagggcatcacgattatggaacaggctgcctttgagaaggaccccacaaccttcctgaaagagaaggggtttccccaggttaccgaatttatcaagctgcctaaatatacactttttgagttcgataacggcagacggcgctttctggcgtctcacaaggaatcccaaaaaggaaatccgttcatcctcagcgaccagctggtgaccctcctgtaccatgctcagcactatgataagattacataccaggagtcttttgactatgtgaacacgcatcttagcgacttctccgccatcctgaccgaagtcctcgcctttgctgagaaatacacactggccgataagaacattgagagaatccaagaactgtatgaggaaaataaatacggcgagaccagcatgattgcgcagtctttccttcagctgctccagttcaacgctatcggggcccccgccgactttaagttctttggagtgacaattcctcggaagcgctacacctccctgacggagatctgggatgctaccatcatttatcaaagcgttacaggcctctacgaaaccagaatccggatgggggacctgtgggccggagagcagtga

SEQ ID NO: 4127 - RNA, 4014 nt, synthetic construct
  misc_feature 1..4014: note = Cas9 variant
  source 1..4014: mol_type = other RNA
atgaagaacatgaaaaagccctacaccatcggcctggacattgggacaaatagcgtgggatgggccgtcctcacggatcagtatgacctggttaaaagaaagatgaaaatcgctggcgattccgagaagaagcaaattaaaaagaacttctggggagtgcggctttttgacgaagggcagaccgccgcggatcgcagaatggctcggacagcccgcagacggatcgagcgcagacggaatcgcatttcttacctgcagggcatcttcgccgaagagatgagcaaaaccgacgctaactttttctgcagactctccgattctttttatgtggacaatgaaaagcggaacagccgccaccctttctttgccacaatcgaggaggaagtcgagtaccataaaaattatccgaccatttaccacctgagagaggaacttgtgaactcctctgagaaggctgatctgcggctcgtttatctggccctggcgcatatcattaagtaccgcgggaatttcctcatcgaaggagccctggacacacagaacaccagcgtggatggcatttacaaacaatttatccagacgtataatcaggtcttcgcttccggcattgaggacgggagccttaagaaactggaagataacaaggacgtggccaaaatcctcgttgagaaggtgaccagaaaagaaaagctggagcggatccttaagctgtaccccggagagaaatctgctggcatgtttgcccagttcatttccctcatcgtcgggagcaagggaaattttcaaaaacctttcgacctgattgaaaagtctgatatcgagtgtgcgaaagactcctatgaagaggatctggaaagcctcctggcccttattggcgacgagtacgctgagctgttcgtggccgctaagaacgcctattctgccgtggtcctctccagcatcatcacagttgctgaaaccgagacaaatgcgaagctgtccgcctctatgattgaaagatttgatacccacgaggaagaccttggggagctgaaggctttcatcaaactccatctgcccaaacactacgaggaaatttttagcaacacggagaagcacggatatgccggctacatcgatggcaaaacaaagcaggccgacttctacaagtatatgaaaatgaccctggaaaacattgagggggctgattactttatcgccaagatcgagaaagaaaatttcctccgcaagcagcggacatttgacaacggagcgattcctcatcagctgcaccttgaggaactggaggctatcctccatcaacaggccaaatattaccccttcctgaaggaaaattatgataagattaaatcccttgtgacctttagaatcccttacttcgtgggcccgctggccaacgggcagagcgagtttgcttggctcacccgcaaggccgacggagagattcggccctggaatatcgaagagaaagtcgacttcggcaagtctgctgtggattttattgagaaaatgacaaacaaggacacgtatctgcctaaagaaaatgttctgcccaagcactccctctgctaccaaaagtacctggtgtataacgaacttaccaaagtcagatacatcaatgatcaggggaagacaagctatttctctggacaggagaaagagcagatcttcaacgacctgtttaagcaaaaacgcaaggtgaagaaaaaggatctcgaactgttcctgcggaatatgagccacgttgagtcccctaccattgaaggccttgaggactcttttaacagctcctacagcacatatcatgatctcctgaaagtgggcatcaagcaggaaattctggacaatcccgtcaacaccgagatgctcgagaatatcgtgaaaattctgacggtcttcgaagataagagaatgatcaaggagcagcttcagcaattttctgacgtgctggatggggttgtgctcaaaaagctggaacgccggcactacacaggatggggcagactgtccgccaaacttctcatggggatccgcgacaagcagagccatctgaccattctggattatctcatgaacgacgacggactgaaccggaatcttatgcagctgatcaacgattctaatctctccttcaaaagcattatcgagaaggagcaggtcaccacagcggacaaggatattcaatccatcgtggccgacctggctggctctccggccatcaaaaaggggattctgcagagccttaaaatcgttgatgaactcgtgtccgtcatgggctaccctccccagaccattgtggtggagatggctagagaaaaccagacaacgggaaagggcaaaaataactctcggcctcgctacaagagcctggagaaagccatcaaggaatttgggtcccaaattctgaaggagcaccccaccgacaatcaggagctcagaaacaatcggctgtatctttactatctgcagaacggaaaagatatgtacacaggccaagacctcgatatccataatctgagcaactatgacatcgatcacattgttccccagtctttcatcaccgacaattccattgataacctggtccttacaagctctgcggggaatagagaaaagggagacgacgtgcctccgctcgagatcgtgcgcaaacggaaggtcttttgggaaaaactgtaccagggcaacctgatgtccaagagaaagttcgattatctcaccaaagccgagcgcgggggcctgacggaagctgacaaggccagatttattcaccggcagcttgtggagacccgccaaatcaccaaaaacgttgctaatattctgcatcagagattcaactacgagaaggatgaccacggaaatacaatgaaacaggtgcggatcgtcacactcaagagcgccctggtgtctcagtttcgcaagcaattccagctgtacaaagttagagatgtgaacgactatcatcacgcccacgatgcttaccttaatggcgtcgtggcgaacaccctgctcaaggtttatccccagctggaacctgagttcgtgtacggggactatcatcagtttgattggttcaaagccaataaggctacggccaaaaagcaattttacacaaacatcatgctgttctttgcccagaaggaccggattatcgatgaaaatggagagattctctgggacaaaaagtatcttgacaccgtcaaaaaggtgatgagctaccgccagatgaacatcgtgaaaaagacagaaattcaaaagggcgagttctccaaagctaccatcaagcccaaagggaatagctctaagctgatctccagaaaaaccaactgggatcctatgaagtacggaggcctcgacagccccaatatggcctatgcggtcgttattgagtacgctaaagggaagaacaagctggtgtttgagaaaaagatcattcgggtgacaatcatggaacgcaaagccttcgaaaaggatgagaaagcctttctggaggaacagggctatagacagccgaaggtccttgctaagctgcctaaatacacgctctatgagtgtgaagagggacggagacgcatgctggcctccgcgaatgaagctcagaagggcaaccaacaggtgctccccaaccacctggttacccttctgcatcacgtggccaattgcgaggtctctgacgggaaaagcctcgattacattgagtccaaccgggaaatgttcgccgagctgctggctcatgtgtctgaatttgccaagagatatacacttgctgaggccaatctgaacaaaatcaatcaactcttcgaacagaacaaggagggagacatcaaggcgattgcccagagcttcgttgatctgatggcttttaatgccatgggcgctcctgcctccttcaaatttttcgagaccacaatcgaacgcaagcggtacaacaatctcaaagagctgcttaactctaccattatctaccagagcattacggggctgtatgaatccagaaagcgcctggacgattga

SEQ ID NO: 4128 - RNA, 4014 nt, synthetic construct
  misc_feature 1..4014: note = Cas9 variant
  source 1..4014: mol_type = other RNA
atgaagaaattcgagaactactatctgggcctcgacatcgggaccagctccattggatgggccgtgacaaattctcagtacgatatcctgaagtttaacggcaaatatatgtgggggacgagacttttccccgaagctaataccgcccaagagcggcgcattcacagaagctcccggcgcagactgaagcggcgcaaagaaagaatccagattctccagatgctgtttgacaaggagatcgcgaagatcgattctggattctttcagcggcttaaagacagcaagtactataaagaagataagacagagaaacaaaccaactccattttccatgacaaggattactctgacaaggagtatcaccaggattttcctacaatctaccatctgcgcaaattcctcctggaaggcaataagccgaaagacattagatttgtctacctggctctccaccatatcctgacccaccgggggcacttcctttttcccgatatggaggttagcaacgtgacagagttctccaatatttttagcgaactgaagcagtatctctacgacgagatggatctggacttcgaatggaaaaacggaaaacttaatgaggtggaaaacatcctgaaagaccgcaatctcgccaagtctgagaaggaaaagaagctgtgcggcattatcgagctggagggcaaaatcgataaccagagaaaggccatgattgggatgatgtgtggatgcaaaaagaagttctccgacctctttcaaaatgaaaactatcgggagctggaaatcagctctttctcctttgctgatagctcttacgaggaaaaacgcgacgagcttgagggcattctggccgaaaatatcctctgtctggattatcttaagaccatttacgactgggggaaactgtccgatatcctccagggagaggaaagcatctccgtcgctaaggtgaaatcttatgaggaacatcagctggacctgaagtacctcaagaacattctgaaactttacagccacaaggagaaagagaacgttttcagaaagaaagaaggcaagtatcctaagtacatctccgggaaactgagccaggaggaatttaataagtctattaaaaagatcctcgaggagattaaatccgtgaagcaagaagatcggaaagtcttcgacacgctgcttaagagagccagcaacaatctgctctgccccaaacaggtgatcaaagagaacggagttatcccttatcagattcataagtttgaactggagaaaatcctgcgcaatatggcggatttctttcccatgctcaaggaaaagaaggacggcaagaccctgtctgagaaaattatcagcgtgttcacatttcggattccttactatgtcggcccgcttaaccaaaattccgacagagcctggctggtgaagaacaaagatgagaagatctacccctggaatttcgaagagattgtgaacctcgaagagtctgctgaaaaatttatccagaatctgaccaacaagtgtacatatctggtccttgaggacgttctccctaagagctccatcctgtacagcaaattcatggtgctgaatgagctcaacaatctgaagattgatggggaagccatctctgtggaccttaaacagaagatttacctgaacctcttccagaaatataagaaggtcaccctgaaaaagctgaaaggataccttaagtccgagaacatcctcattgatacgagcacacaaatcaccggcatcgacggggattttaaatcttccctgggaagctatctggacttctacaatattctcggcgataaggtgaaaacagactttgggaagaagctgatcgaaaactgcattctttggatcaccctgtataccggagagaaaaagctcctgaaaaataagattatcgctaactacaaaggcgaactgtccgaggaggaaatcaagaagattgttaatcttaaatataaggattggggccgcctctcttacgccttcctggaggaaatccagagcgcgtccctggagacaggggagctccggaacattatccagatgatgtgggaaacgaataacaatctgatggagcttctgtctagcaactaccagtttctctccgaaattgagaaaagaaatagcgtggtcgccatcggaaaggagttcaactatgaaaccatcctgggcgactcttacgcttcccccagcgtgaaacgcatgatttggcaatctctgtccgttgtggatgagatcaagaagattatgaaaaaggcccctaaaaagatctttattgaaatggctcggcaggaggacatgaaaaaggaaagaaaggagagccgcaaatctacattccttaccctctataagagcatcaaagaagaggggcgggactggattaaggagatcgaaaattggtccgatagcgagtttagatctaaaaagctgtacctgtattacacacagatgggaaagtgtatgtataccggcgaaaagatctccctcgaccagctgttcaacaagaatatttacgatatcgaccacatttacccccgcagcaaaacgaaggatgactccatcgagaacattgtccttgtgaaacggaacatcaatgccaagaaaacagatgaatatccgctggagagaaacatccaacagaagcagcacgacttttggaagatgctccattctaaaaagctgattggggataaaaagtacgagcggctgacccgcaccacagagttcaccgacgaagaacttagcgattttatcgccagacagctggtcgagacacggcaatccacgaaaattgtggctgacatcctcaagaatctgttccctgagaccaagattgtttatgtgaaagcgaacctcacatctgatttcagaaagaattttaaaatccttaagagccgcgacatcaacgactaccaccatgcccacgatgcttatctgaatattgtcaccggcaacgtgtacaatatcaaattcacagacaacccccggaattttattaaggataagaaactggaaggaaagaaatataacctcaaggttgagaaaatcttcgaatacagaaaggagaatgaatccttttggaaccctaagaccatggtgacgaaaattgagaattacatcttcaagaaacgcccccagtttaccagatattctttcgagcagcatggcgggtttttcgaccaaaacattgtcgataaggaaagctgcaaaaagggaacaggctacatccccatcaaatccagcaacgccattctgtataatacctctaagtacgggggatatggctccgtgacagggacctactttttcctggtggagcacacgatgaagggcaaacggatccgcacaattgaaatgatgcctctttatctgagcaagaaaatccactctaaggaggaactcgagaaatactgtaaggagaagctggaactccagaaaccgtccgttagactggcccggattaagtacaacagccttctgaaaatcaatggattcccctatcatatcaccggcaagacaaacgactcttactggattatgtccgctatccagctcctgctgagcaaaaattattacgagtatcttcgcaagctgtacatcttttgcaaggaagagagactcgaagaggagattgtcggggagaaaaacattaagctgtatacctgtatcctcgaaaaactggaaaagtccatctacagccacaaacttctgaatattaactacaatggaaagtctaagaacctgaaagatatcctcgagagcgagaaggaaaatttcctgcttctgtccgagaaaaagcaggcccaaattctcatcgaaatttttaccctgctcgagtctaacaatttcggcgcgaacctggagagctttgggtgcgggaaaaagtgcggcatcacaaaaattaataagaacatcgacaaacttgaagaggtgctgctgatcaatcagtcccctacgggactcttcgaaaactctattgatctgaaaaaggtgtga

SEQ ID NO: 4129 - RNA, 4014 nt, synthetic construct
  misc_feature 1..4014: note = Cas9 variant
  source 1..4014: mol_type = other RNA
atgaagaaagactacgtgatcggcctggatattgggaccaacagcgtcggatgggccgttatgacagaggactatcagctcgtgaagaaaaagatgcccatctacggcaatacggagaaaaagaagattaaaaagaacttctggggagtgagactgtttgaggaagggcacaccgctgaggatcggcgccttaaaagaacagcccggcgcagaatctcccggcgcagaaatcggctgcgctatctccaagcgttctttgaagaggctatgaccgacctggatgagaacttctttgccagacttcaggaatctttcctggtccctgaggacaagaaatggcatcggcacccgatttttgccaagctcgaagatgaggtggcttaccatgagacatatcccaccatctaccatctgcgcaagaaactggccgacagctccgaacaggctgatctcagactgatctatcttgccctggcgcacattgttaagtaccggggccacttcctcatcgaggggaaactgtctacagaaaatattagcgtgaaggagcagtttcaacagttcatgatcatttacaaccagacctttgtcaatggagaatcccgccttgtgtctgcccctctgcccgagagcgttctcatcgaggaagaactgacggaaaaagcctccagaaccaagaaaagcgagaaggtgctgcagcaattccctcaggaaaaggctaacggcctctttggccagttcctgaaacttatggtcgggaataaggctgacttcaaaaaggtgtttggactggaggaggaagccaaaattacatatgcgtctgagtcctacgaagaggatctcgaaggcatcctggccaaggtgggggacgagtatagcgatgtcttccttgctgccaagaacgtttacgacgctgtggagctgtctaccatcctcgccgactccgataaaaagagccacgccaaactgtcttccagcatgattgtgcggtttacagaacatcaggaggacctgaagaaattcaagagatttatccgcgaaaattgccccgatgagtatgacaacctcttcaagaatgagcaaaaagatggatacgctggctatattgcgcacgccgggaaggtctcccagctgaaattttaccagtacgtgaagaaaatcattcaagacatcgctggagccgaatatttccttgagaagatcgcccaggaaaactttctgcggaagcagagaaccttcgataatggcgttattcctcatcagatccacctcgctgagctgcaagccattatccaccgccaggcggcttactatccgtttcttaaagaaaaccaggagaagattgagcagctggtgacgttccggatcccctactatgtcggccctctctctaaaggggacgccagcacatttgcctggctgaagagacaatccgaggaacccatccgcccttggaacctgcaggaaaccgtggatctcgaccagagcgctacagccttcattgagcggatgaccaatttcgatacctacctgccctctgaaaaagttcttccgaagcattccctgctctatgagaaatttatggtgttcaacgagctgacaaagatcagctacacggacgacagaggaattaaggctaatttttctggcaaagaaaaggagaaaatcttcgattacctgtttaagacccgccggaaagtcaagaagaaagacattatccagttctatagaaacgaatacaatacagagattgtgacccttagcgggctcgaagaggatcaatttaacgcctccttctctacatatcaggacctgctgaagtgtggactcacccgcgcggagctggatcaccctgacaatgccgaaaaacttgaggatatcatcaagattctgacgatctttgaagaccggcagcggattagaacacagctcagcaccttcaaaggccaattttccgctgaggtcctgaagaagctggagcgcaaacattacaccgggtggggaagacttagcaagaaactcatcaacggcatttatgataaggaatctggcaaaacaatcctggggtacctgatcaaggacgatggagtgtccaagcactataatcggaacttcatgcagctcattaatgacagccagctgtcttttaaaaacgccatccaaaaggctcagtccagcgagcatgaagagaccctttccgaaacagttaatgagctggccggctctcccgcgattaaaaaggggatctaccagagcctcaaaattgtggatgagctggtcgccatcatgggatacgctcctaagagaatcgtggttgaaatggcccgcgagaaccagacgacctccacaggcaaacggagatctattcaacgcctgaagatcgtggaaaaggctatggccgagattgggagcaatcttctcaaagaacagcccaccacaaacgagcagctgagagacacccggctgttcctctattacatgcagaacggcaaggacatgtatacgggagatgagctgtcccttcaccgcctgagccactacgacatcgatcatattatcccccaatctttcatgaaagacgattccctcgacaatctggtcctggtgggcagcaccgaaaacagagggaagtctgatgacgtgccttccaaagaggttgtcaaggatatgaaggcctattgggaaaaactttacgctgcgggactcatcagccagcggaagtttcagcgcctgacaaaaggcgagcaagggggactgaccctcgaagacaaggcccacttcattcagagacagctggtggagacacggcagatcaccaaaaatgtggctggcattcttgatcaacgctataacgccaattctaaggagaagaaagtccagatcattacgctgaaggccagcctcacatcccagtttagaagcatcttcgggctgtacaaagtgcgggaagttaacgactaccatcacggccaggatgcttatctgaattgcgtggtcgccaccacacttctgaaggtgtacccgaacctcgcgcccgagtttgtttatggagaataccctaaattccaaacctttaaggagaataaggctaccgccaaagccattatctatacaaacctgctccgcttctttacggaggacgaacccagattcaccaaggacggcgagatcctgtggtctaattcctaccttaaaacaattaagaaagaactgaactatcaccagatgaatatcgtgaagaaggtcgaggtgcagaaagggggatttagcaaggaatccattaaacctaagggcccctctaacaaactcatcccggttaagaatgggctggatcctcagaaatacggaggcttcgacagccccattgtggcttacaccgtcctgttcacacatgagaaggggaagaaacctcttatcaagcaagagatcctgggcattaccatcatggagaaaacgcggtttgaacagaaccccattctcttcctggaagagaagggatttctcagacctcgcgtgctgatgaaacttcccaagtatacactgtacgagttcccggaaggccggagacgcctcctggcctccgcgaaggaggctcagaaagggaaccagatggtgctgcctgaacaccttctgaccctcctgtatcatgccaagcaatgtctcctgcccaatcagtctgagagccttacctacgtcgaacagcaccagcccgagtttcaagaaatcctggagcgggttgtggatttcgccgaggtgcatacactggctaaatccaaggtccagcagattgtgaaactctttgaagccaaccaaaccgctgacgttaaggagatcgccgcgtctttcatccagctgatgcagtttaatgccatgggagctcctagcacattcaagtttttccagaaagatattgaaagagcccgctatacgtccatcaaggagatttttgacgctaccatcatttaccaaagcacaaccggcctttatgagacacggagaaaagtggtcgattga

SEQ ID NO: 4130 - RNA, 4014 nt, synthetic construct
  misc_feature 1..4014: note = Cas9 variant
  source 1..4014: mol_type = other RNA
atgaagaaagactacgtgatcggcctggatattgggaccaacagcgtcggatgggccgttatgacagaggactatcagctcgtgaagaaaaagatgcccatctacggcaatacggaaaagaagaagattaaaaagaacttctggggagtgagactgtttgaggaaggacacaccgctgaggatcggcgccttaaaagaacagcccggcgcagaatctcccggcgcagaaatcggctgcgctatctccaagcgttctttgaagaggctatgaccgacctggatgagaacttctttgccagacttcaggaatctttcctggtccctgaggacaagaaatggcatcggcacccgatttttgccaagctcgaagatgaggtggcttaccatgagacatatcccaccatctaccatctgcgcaagaaactggccgacagctccgaacaggctgatctcagactgatctatcttgccctggcgcacattgttaagtaccggggccacttcctcatcgaggggaaactgtctacagaaaataccagcgtgaaggaccagtttcaacagttcatggtcatttacaaccagacgtttgtgaatggagagtcccgccttgtttctgcccctctgcccgaaagcgtgctcatcgaggaggaactgaccgagaaagctagcagaacaaagaaaagcgaaaaggtcctgcagcaattccctcaggagaaggccaacggcctctttggccagttcctgaaacttatggtggggaataaggctgatttcaaaaaggtgtttggactggaagaggaggccaaaattacctatgcgtctgaatcctacgaggaagacctcgagggcatcctggccaaggtcggggatgaatatagcgacgttttccttgctgccaagaacgtgtacgacgctgtggagctgtctacaattctcgccgattccgacaaaaagagccacgccaaactgtcttccagcatgatcgtccggtttaccgagcatcaggaagatctgaagaaattcaagagatttatccgcgagaattgccccgacgaatatgataacctcttcaagaatgagcaaaaagacggatacgctggctatattgcgcacgccgggaaggtgtcccagctgaaattttaccagtacgttaagaaaatcattcaagatatcgctggagccgagtatttccttgaaaagattgcccaggagaactttctgcggaagcagagaacgttcgacaatggcgtgatccctcatcagatccacctcgctgaactgcaagccattatccaccgccaggcggcttactatccgtttcttaaagagaaccaggaaaagattgagcagctggtcacattccggatcccctactatgtgggccctctctctaaaggggatgccagcacctttgcctggctgaagagacaatccgaggaacccattcgcccttggaacctgcaggagacagttgacctcgatcagagcgctaccgccttcatcgaacggatgaccaatttcgacacatacctgccctctgagaaagtgcttccgaagcattccctgctctatgaaaaatttatggtcttcaacgagctgacgaagatcagctacaccgacgatagaggaattaaggctaatttttctggcaaagagaaggagaaaatcttcgactacctgtttaagacacgccggaaagtgaagaagaaagatattatccagttctatagaaacgaatacaataccgaaattgtcacacttagcgggctcgaggaagaccaatttaacgcctccttctctacctatcaggatctgctgaagtgtggactcacgcgcgcggagctggaccaccctgataatgccgagaaacttgaagacatcattaagatcctgacaatctttgaggatcggcagcggattagaacccagctcagcaccttcaaaggccaattttccgctgaagtgctgaagaagctggagcgcaaacattacacagggtggggaagacttagcaagaaactcatcaacggcatttatgacaaggagtctggcaaaaccatcctggattacctgattaaggacgatggggtttccaagcactataatcggaacttcatgcagctcatcaatgacagccagctgtcttttaaaaacgccatccaaaaggctcagtcctgcgaacatgaggaaacacttagcgagacggtgaatgaactggccggatcccccgcgattaaaaagggcatctaccagtctctcaaaattgtcgacgagctggtggccatcatggggtacgctcctaagagaattgttgtggagatggcccgcgaaaaccagaccacaagcaccggaaaacggagatccatccaacgcctgaagatcgtcgagaaggctatggccgaaattggctctaatcttctcaaagagcagcccacaaccaacgaacagctgagagatacgcggctgttcctctattacatgcagaacgggaaggacatgtataccggcgatgagctgagccttcaccgcctgtcccactacgacatcgatcatattatcccccaatccttcatgaaagacgattctctcgacaatctggtgctggtgggatccacagagaacagaggcaagagcgatgacgttccttctaaaaaggtcgtgaaggatatgaaagcctattgggaaaaactttacgctgcggggctcatttcccagcggaaatttcagcgcctgaccaagggagagcagggcgggctgacactcgaagacaaagcccacttcatccaaagacagctggtggagacccggcagatcacgaagaatgtcgctgggattcttgatcaacgctataacgccaagagcaaagaaaagaaagtgcagatcattacactgaaggcctctctcaccagccagtttagatccatcttcggcctgtacaaagttcgggaggtgaatgactaccatcacgggcaggacgcttatctgaactgtgtcgtggccacaacccttctgaaggtttacccgaatctcgcgcccgagtttgtgtatggcgaataccctaagttccaggcttttaaagagaacaaggccaccgccaaaacaattatctatacgaatctgatgcgcttctttaccgaagatgagcccagattcacaaaggacagcgagattctctggtctaactcctacctgaaaaccatcaagaaggaacttaattatcaccaaatgaacatcgtcaaaaaggtggaggttcagaaaggaggctttagcaaggaatccattaaacctaaggggccctctaataaactgatcccggtgaagaacggactcgatcctcagaagtacggcgggttcgacagccccgtcgtggcttacacagtgctgttcacccatgagaaaggaaagaaacctctgattaagcaagaaatccttggcattacgatcatggagaaaacacggtttgagcagaatcccatcctgttcctcgaagagaaggggtttctgagacctcgcgtcctcatgaagctgcccaaatataccctttacgagttcccggaaggccggagacgcctgctcgcctccgcgaaggaagctcagaaaggaaaccagatggttctgcctgagcatctgcttaccctgctctatcacgccaagcaatgcctgctccccaaccagtctgagagcctggcctacgtggaacagcaccagcccgagtttcaagaaattcttgagcgggtggtcgatttcgctgaagtgcatacactggccaaatccaaggttcagcagatcgtgaagctgtttgaggctaatcaaaccgccgacgtcaaagagattgcggcctctttcatccagctcatgcagtttaacgctatgggcgcccctagcacattcaagtttttccagaaagatattgaaagagctcgctatacgtccatcaaggagatctttgacgccaccattatctaccaaagcacaaccgggctgtatgaaacacggagaaaagtggttgattga

SEQ ID NO: 4131 - RNA, 4014 nt, synthetic construct
  misc_feature 1..4014: note = Cas9 variant
  source 1..4014: mol_type = other RNA
atgaagaaagactacgtgatcggcctggatattgggaccaacagcgtcggatgggccgttatgacagaggactatcagctcgtgaagaaaaagatgcccatctacggcaatacggaaaagaagaagattaaaaagaacttctggggagtgagactgtttgaggaaggacacaccgctgaggatcggcgccttaaaagaacagcccggcgcagaatctcccggcgcagaaatcggctgcgctatctccaagcgttctttgaagaggctatgaccgccctggacgagaacttctttgccagacttcaggaatctttcctggtccctgaggataagaaatggcatcggcacccgatttttgctaagctcgaagacgaggtggcctaccatgagacatatcccaccatctaccatctgcgcaagaaactggctgatagctccgaacaggccgacctcagactgatctatcttgcgctggcccacattgttaagtaccggggccacttcctcatcgaggggaaactgtctacagaaaatattagcgtgaaggagcagtttcaacagttcatgatcatttacaaccagacctttgtcaatggagaatcccgccttgtgtctgctcctctgcccgagagcgttctcatcgaggaggaactgacggaaaaagcctccagaaccaagaaaagcgagaaggtgctgcagcaattccctcaggaaaaggctaacggcctctttggccagttcctgaaacttatggtcgggaataaggccgatttcaaaaaggtgtttggactggaggaggaagcgaaaattacatatgcctctgagtcctacgaagaggacctcgaaggcatcctggctaaggtgggggatgagtatagcgacgtcttccttgccgctaagaacgtttacgatgccgtggagctgtctaccatcctcgccgactccgacaaaaagagccacgctaaactgtcttccagcatgattgtgcggtttacagaacatcaggaggatctgaagaatttcaaaagatttatccgcgaaaactgccccgacgagtatgataatctcttcaagaacgagcaaaaggacggatacgcgggctatattacccacgccgggaaagtctcccagctgaagttttaccagtacgtgaaaaagatcattcaagatatcgctggagccgaatatttccttgagaaaatcgcccaggaaaattttctgcggaagcagagaacgttcgacaacggcgttattcctcatcagatccacctcgctgagctgcaagccattatccaccgccaggcggcttactatccgtttcttaaggaaaaccaggagaaaattgagcagctggtgacattccggatcccctactatgtcggccctctctctaagggggatgccaatacctttgcctggctgaaaagacaaagcgaggaacccatccgcccttggaacctgcaggaaacagtggacctcgatcagtccgctaccgccttcattgagcggatgaccaatttcgacacatacctgcccagcgaaaaggttcttccgaaacattctctgctctatgagaagtttatggtgttcaacgagctgacgaaaatctcctacaccgatgacagaggaattaaggctaattttagcggcaaggaaaaagagaagatcttcgactacctgtttaaaacacgccggaaggtcaaaaagaaggatattatccagttctatagaaacgaatacaataccgagattgtgacactttctgggctcgaagaggaccaatttaacgccagcttctccacctatcaggatctgctgaaatgtggactcacgcgcgcggagctggaccaccctgataatgccgaaaaacttgaggacatcatcaaaattctgacaatctttgaagatcggcagcggattagaacccagctctctaccttcaagggccaatttagcgctgaggtcctgaaaaagctggagcgcaagcattacacagggtggggaagactttccaaaaagctcatcaacggcatttatgacaaagaaagcggcaagaccatcctggattacctgatcaaagacgatggggtgtctaagcactataatcggaacttcatgcagctcattaatgactcccagctgagctttaagaacgccatccaaaaagctcagtcttccgagcatgaagagacacttagcgaaacggttaatgagctggccggatcccccgcgattaagaaaggcatctaccagtctctcaagattgtggatgagctggtcgccatcatggggtacgctcctaaaagaatcgtggttgaaatggcccgcgagaaccagaccacaagcaccggaaagcggagatccattcaacgcctgaaaatcgtggaaaaggctatggccgagattggctctaaccttctcaaggaacagcccacaaccaatgagcagctgagagacacgcggctgttcctctattacatgcagaacgggaaagacatgtataccggcgatgagctgagccttcaccgcctgtcccactacgacatcgatcatattatcccccagagcttcatgaaggacgattctctcgacaatctggtcctggtgggatccacagaaaacagaggcaaaagcgatgacgtgccttctaaggaggttgtcaaagatatgaaggcctattgggaaaaactttacgctgcggggctcatctcccaacggaaatttcagcgcctgaccaagggagagcagggcgggctgacactcgaagacaaagcccacttcattcaaagacagctggtggagacccggcagatcacgaagaatgtggctgggattcttgatcaacgctataacgccaaaagcaaggagaagaaagtccagatcattacactgaaggcctctctcaccagccagtttagatccatcttcggcctgtacaaagtgcgggaagttaatgactaccatcacgggcaggatgcttatctgaactgcgtggtcgccacaacccttctgaaggtgtacccgaatctcgcgcccgagtttgtttatggcgaataccctaaattccaaacctttaaggagaacaaggctacagccaaagccattatctatacgaatctgctccgcttctttaccgaggacgaacccagattcacaaaggacggagagatcctgtggagcaactcttaccttaaaaccattaagaaagaactgaattatcaccagatgaacatcgtgaagaaggtcgaggtgcagaaaggcgggttttccaaggaaagcattaaacctaagggaccctccaataaactcatcccggttaagaacggcctggatcctcagaaatacgggggattcgactctcccattgtggcttacacagtcctgttcacccatgagaagggcaagaaacctcttatcaagcaagagatcctggggattacgatcatggaaaagacacggtttgagcagaaccccattctcttcctggaagagaagggctttctcagacctcgcgtgctgatgaaacttcccaagtataccctgtaccagttcccggaaggacggagacgcctcctggccagcgcgaaggaggctcagaaaggcaatcaaatggtgctgcctgagcaccttctgaccctcctgtatcatgccaagcagtgtctcctgcccaaccagtccgaatctcttgcctacgtcgagcagcaccaacccgaatttcaggagatcctggaacgggttgtggatttcgctgaggtgcatacactggccaaaagcaaggtccagcaaattgtgaaactctttgaggctaatcagaccgccgacgttaaggaaatcgcggcctccttcatccagctgatgcagtttaacgctatgggggccccttctacattcaagtttttccaaaaagatattgagagagctcgctatacgagcatcaaggaaatttttgacgccaccatcatttaccagtccacaaccggactttatgagacacggagaaaagtggtcgattga

SEQ ID NO: 4132 - RNA, 4014 nt, synthetic construct
  misc_feature 1..4014: note = Cas9 variant
  source 1..4014: mol_type = other RNA
atgaagaaagactacgtgatcggcctggatattgggaccaacagcgtcggatgggccgttatgacagaggactatcagctcgtgaagaaaaagatgcccatctacggcaatacggagaaaaagaagattaaaaagaacttctggggagtgagactgtttgaggaagggcacaccgctgaggatcggcgccttaaaagaacagcccggcgcagaatctcccggcgcagaaatcggctgcgctatctccaagcgttctttgaagaggctatgaccgacctggatgagaacttctttgccagacttcaggaatctttcctggtccctgaggacaagaaatggcatcggcacccgatttttgccaagctcgaagatgaggtggcttaccatgagacatatcccaccatctaccatctgcgcaagaaactggccgacagctccgaacaggctgatctcagactgatctatcttgccctggcgcacattgttaagtaccggggccacttcctcatcgaggggaaactgtctacagaaaatattagcgtgaaggagcagtttcaacagttcatgatcatttacaaccagacctttgtcaatggagaatcccgccttgtgtctgcccctctgcccgagagcgttctcatcgaggaagaactgacggaaaaagcctccagaaccaagaaaagcgagaaggtgctgcagcaattccctcaggaaaaggctaacggcctctttggccagttcctgaaacttatggtcgggaataaggctgacttcaaaaaggtgtttggactggaggaggaagccaaaattacatatgcgtctgagtcctacgaagaggatctcgaaggcatcctggccaaggtgggggacgagtatagcgatgtcttccttgctgccaagaacgtttacgacgctgtggagctgtctaccatcctcgccgactccgataaaaagagccacgccaaactgtcttccagcatgattgtgcggtttacagaacatcaggaggacctgaagaaattcaagagatttatccgcgaaaattgccccgatgagtatgacaacctcttcaagaatgagcaaaaagatggatacgctggctatattgcgcacgccgggaaggtctcccagctgaaattttaccagtacgtgaagaaaatcattcaagacatcgctggagccgaatatttccttgagaagatcgcccaggaaaactttctgcggaagcagagaaccttcgataatggcgttattcctcatcagatccacctcgctgagctgcaagccattatccaccgccaggcggcttactatccgtttcttaaagaaaaccaggagaagattgagcagctggtgacgttccggatcccctactatgtcggccctctctctaaaggggacgccagcacatttgcctggctgaagagacaatccgaggaacccatccgcccttggaacctgcaggaaaccgtggatctcgaccagagcgctacagccttcattgagcggatgaccaatttcgatacctacctgccctctgaaaaagttcttccgaagcattccctgctctatgagaaatttatggtgttcaacgagctgacaaagatcagctacacggacgacagaggaattaaggctaatttttctggcaaagaaaaggagaaaatcttcgattacctgtttaagacccgccggaaagtcaagaagaaagacattatccagttctatagaaacgaatacaatacagagattgtgacccttagcgggctcgaagaggatcaatttaacgcctccttctctacatatcaggacctgctgaagtgtggactcacccgcgcggagctggatcaccctgacaatgccgaaaaacttgaggatatcatcaagattctgacgatctttgaagaccggcagcggattagaacacagctcagcaccttcaaaggccaattttccgctgaggtcctgaagaagctggagcgcaaacattacaccgggtggggaagacttagcaagaaactcatcaacggcatttatgataaggaatctggcaaaacaatcctggggtacctgatcaaggacgatggagtgtccaagcactataatcggaacttcatgcagctcattaatgacagccagctgtcttttaaaaacgccatccaaaaggctcagtccagcgagcatgaagagaccctttccgaaacagttaatgagctggccggctctcccgcgattaaaaaggggatctaccagagcctcaaaattgtggatgagctggtcgccatcatgggatacgctcctaagagaatcgtggttgaaatggcccgcgagaaccagacgacctccacaggcaaacggagatctattcaacgcctgaagatcgtggaaaaggctatggccgagattgggagcaatcttctcaaagaacagcccaccacaaacgagcagctgagagacacccggctgttcctctattacatgcagaacggcaaggacatgtatacgggagatgagctgtcccttcaccgcctgagccactacgacatcgatcatattatcccccaatctttcatgaaagacgattccctcgacaatctggtcctggtgggcagcaccgaaaacagagggaagtctgatgacgtgccttccaaagaggttgtcaaggatatgaaggcctattgggaaaaactttacgctgcgggactcatcagccagcggaagtttcagcgcctgacaaaaggcgagcaagggggactgaccctcgaagacaaggcccacttcattcagagacagctggtggagacacggcagatcaccaaaaatgtggctggcattcttgatcaacgctataacgccaattctaaggagaagaaagtccagatcattacgctgaaggccagcctcacatcccagtttagaagcatcttcgggctgtacaaagtgcgggaagttaacgactaccatcacggccaggatgcttatctgaattgcgtggtcgccaccacacttctgaaggtgtacccgaacctcgcgcccgagtttgtttatggagaataccctaaattccaaacctttaaggagaataaggctaccgccaaagccattatctatacaaacctgctccgcttctttacggaggacgaacccagattcaccaaggacggcgagatcctgtggtctaattcctaccttaaaacaattaagaaagaactgaactatcaccagatgaatatcgtgaagaaggtcgaggtgcagaaagggggatttagcaaggaatccattaaacctaagggcccctctaacaaactcatcccggttaagaatgggctggatcctcagaaatacggaggcttcgacagccccattgtggcttacaccgtcctgttcacacatgagaaggggaagaaacctcttatcaagcaagagatcctgggcattaccatcatggagaaaacgcggtttgaacagaaccccattctcttcctggaagagaagggatttctcagacctcgcgtgctgatgaaacttcccaagtatacactgtacgagttcccggaaggccggagacgcctcctggcctccgcgaaggaggctcagaaagggaaccagatggtgctgcctgaacaccttctgaccctcctgtatcatgccaagcaatgtctcctgcccaatcagtctgagagccttgcctacgtcgaacagcaccagcccgagtttcaagaaatcctggagcgggttgtggatttcgctgaggtgcataccctggccaaatccaaggtccagcagattgtgaaactctttgaagctaaccaaacagccgacgttaaggagatcgcggcctctttcatccagctgatgcagtttaatgctatgggagcccctagcaccttcaagtttttccagaaagatattgaaagagctcgctatacatccatcaaggagatttttgacgccacgatcatttaccaaagcaccacaggcctttatgagacccggagaaaagtggtcgattga

SEQ ID NO: 4133 - RNA, 4017 nt, synthetic construct
  misc_feature 1..4017: note = Cas9 variant
  source 1..4017: mol_type = other RNA
atgcaggactactatctgggcctcgatatcgggaccaacagcgtgggatgggccgtcacagacgagaattacaacctgcttagaaagaaaggcaaggatctgtggggagttagactcttcaaagaagctcaacccgccacggagcgcagagggcaccggtcctctcgcagacggaccattcgcaagagcctgagaaaacagcttctgcgggaactctttgaggaagagatcaatgcgattgacaaggatttctttctgcgcctggacgagtccaagtattggctcgaagataaaaagatcgagggcaaatactctctgttcaacgacgaaaattttacagataaggactattacgagaaattccctaccatttttcatcttagaaaggctctgatcgagagcgatgacaaggaagatatccggctctatttcctggccattaaccagatgatgaaacgcagagggcactttcttatcgacggaaagctgtccaatgtggaggacattacaccgttcaaagaatgcatccagaacctcattaatgaggaactggataccgagatcgagacagaattttacgacaaggccattaaaatcgtgtctgattacagcctgaagaaaaccgagaagaagaacctcatcaaagacctggtcaaggaaacggattccattgaggacagcaaaaagatcattaatatcttcaaccttctgatttctggcaaatccaaggtgaatggcatctttgatgacgaagagatcctcgagaagattaaagaagataacaaggaggacttctatctgaccagcgaaaaatacgaggaaaatcttgagtatttctctcaactgctcgattaccggtttgagctgatctccagcctgaagtctatttatgactacatcattctccaggaagttctgaaagggaagaagtatctttcctacgctcaggtggagcgctacaaaaaccataaggaagacctgagaaaactcaagcagctgatcaaaaagtatgataagaacggaaaaatctactatcaaattttccgggacgagaattttaagaaaggctacgtcgcctatcttgggtactataagaaaaacaagaaaaatgtgcccgttaagaagtgtgattacgacacattcagcaaaaacatcaagtccaccctggataaaatttgcgacaaggaggatcctctctacatcgaactgattgacaaaatcgagaagggaggctttctgctcaagcagattgtgtctacaaatagcgtcatcccccaccaggtgcatgaactggagcttgataaaatcctggaaaacctcgagaagaattatccttccttcaaagagattagcgacggggtgtctaagatcgataaaattaagatgatctttaacttccggattccctactatgtcggacctctgaatgactaccacaaggataaagttaactccaatacctggatcgtgaagaacgaaggctttgagaatgaaaacatccgcccgtggaatttcagcaaaattgtggacgagcacgcttgtgaagaggagtttatcaagcggatgattaacgaatgctcttatatccccggcgagaaagtcctgcctaagagctcccttctctactctgaatatatggtgctgaacgagctgaataacctcagagttaatggggacaagctgaaccccaaaattaagaaagaaatcgtggagaatatctacaagaaagagcgcaaggtcacgcttaaaaagattcggaacttcctgatcattaataactacgtggatagcaaggttgaattttccggactcagcgacggcatcaaagccaatatgtcttcctatattgatttcgcggagatcctggacgataacttcgacaataacatggtggaagatctgatcgagcagattacaatccatgtcgggaatgtgaaacttctcaccgagaaaattagcaacaagtaccctaatctggaaaagaagcaaatcaacaagattgtcaacctgaaatttaaggactgggccagattctctcgcaaactcctggtgggaatcgagggcacagaaaaggagaccggggaaattaataccatcatcggatttcttcgggagacaaacgagaatttcatggaactgatgtccaacagatatacgtttagcgaggaaatttccgagatcaaaaagaagtacattcccaataaactctctaagcagatcgttgatgacctgtatgtgagcccggctgtcaaaaagatgatttggcaagtgctgaacatcaatgatgaacttatcaaagttctcggcaagcagcctaagaaaattttcatcgagatggcccgcggcaaggaggaaaaacccgaggtgaaggactcccggaaaaacaagctgattgaactgtacaagaatctcgggaaagagggaaaggaatggctgaacagaatcgaggataaaaccgaggctgactttcgcaatcgggccctttatctgtactacacacagatgggcagatgtatgtataccggggaaattatcgacatcgagcggctctacgataaggaactgtatgacctggatcacattatccctcgcaaaatgaagaaagacgattctattcataagaaccttgtcctcgtgacaagaaatagcaaccagtacgagaagaaagacaattatcccgtgcccgaggttatcaagtcccgggaaaacgtcagacacctgtggtacgcgctgaaaaagaaaggactcattaccgaggaaaagtataaccgcctgacgcggatcaatcctcttagcgataaggagctgtctgagttcattgaaagacagctcgtggagacacgccaaaccaccaaagtggtcaaggacctgtttgaaaactactacacagattccaaaatcgtgaccgttaaggccggcctggtgagcgagcttagacgggacttcgaagtcctgaaatgccgcgagatcaatgatctcaaccacgctcatgacgcctttctgaatattatcgtgggggacgtttggtctaagaagttcacatccaacccgtataattttgtgaaaaagaacagagaaaaatacacgctcaataacattttcaccaagaatcagaaagatctgcggggcaacgagatctggaattgtgctgagggaaagaagcgcattatcaaaacacttaacaagcccagcgtcctgttctctgtggaaaattttgagcagaccggccaactcttcgaccagaacatcattgggaaacaggattataaggaaaagacaagctacgttcctatcaagggagacgagagactgcaggatatttccaaatatggcgggtaccggggaatcagcggcgcctactttttcattgtggaacacaccgagaagaataagcgcgtcaaaacgatcgagtctctgcccatctatatgaagtcctacgtggaagagaacgggcttctggacttttgcaccaacgaaatgaaactcgtggatcctaagattatcgtcaaaaagctgaattataagagcgagattatcgttgacggcttcaaatacctcatttccggaaagacagagaacagactgtctcttgaaaccaatgagtatctgtactggaaccatacacagaccacggatatcaaaaagattctcaatatcaacgagaaaatcgaactggaaaagtataatggcgacattgagagcgagcgggaaaacatcattaagtacatccaaattatcctggagaaatttaaacttaaacccttcatcaagcgcagaaatctgccgaacattgaaatcaattttgccgattatgagacagaaaaactcctgcagctcctggtgaaccttattcctctgaccacaaagtacgtgtcccccgtcgacctgaccgtgatctctgggagcaagtacgctggaaaagttctcattcctaagaaaatctccaatctgaacgaggtgatcttcatttctaagagcatcaccggcatttatgagtcccggagacgcatcatttga

SEQ ID NO: 4134 - RNA, 4017 nt, synthetic construct
  misc_feature 1..4017: note = Cas9 variant
  source 1..4017: mol_type = other RNA
atgaagcaggagtacttcctgggcctcgacatggggaccggaagcctgggctgggccgtgacagattccacgtatcaagtcatgagaaaacacgggaaggctctttggggaacccggctgtttgaatctgccagcacagcggaggaacgcagaatgttccggaccgctcgcagacggctcgaccgcagaaactggcggatccaggttctgcaggagattttctccgaagagatctctaaagtggatcccggcttctttcttcgcatgaaggagagcaaatactatcctgaagacaagagagatgccgaggggaattgcccggaactgccctacgccctcttcgtggacgataactatacagacaagaattaccataaagattatcctaccatttaccatctgcggaagatgctgatggagacaaccgagatccccgacattcgcctcgtctacctggtgcttcaccacatgatgaaacatagaggacactttctgctctccggcgatatctctcagatcaaggaatttaaaagcacgtttgagcaactgattcagaacatccaggacgaagaacttgaatggcacatttccctggatgacgctgccatccagttcgttgagcatgtgctcaaggaccggaatctgacccgcagcacaaagaaatctagactgattaagcaactcaacgctaaatccgcctgtgagaaggcgatcctgaatcttctgagcggcgggaccgtcaaactctctgatatttttaacaataaggaactggacgagtccgaacggcctaaagtgagcttcgccgattctggatatgacgattacatcggcatcgttgaggctgaacttgccgagcagtattacattatcgcttccgccaaggcggtgtatgactggagcgtcctggtggagattctcgggaactccgtgtctatcagcgaagccaagattaaagtctaccagaagcaccaggctgatctgaaaacactgaagaaaatcgttagacaatatatgaccaaggaggactacaagcgcgtgtttgtggatacggaagagaaactcaataactactccgcctatatcggaatgacaaagaaaaatggcaagaaagtcgaccttaagagcaagcagtgcacccaggctgatttctacgacttcctgaaaaagaacgtgattaaagttatcgaccataaggaaattacacaagagatcgagtctgaaattgagaaagaaaattttctgcccaaacaggtgaccaaggataacggggtcatcccttatcaggtgcacgactacgagctcaaaaagatcctggataaccttggaacccggatgccgttcattaaagagaatgccgaaaagatccagcaactgtttgagttccgcattccctattacgttggccctctcaacagagtggacgatggcaaagacgggaagtttacatggtccgtccggaaaagcgatgccagaatctatccctggaatttcacggaagtgattgacgtcgaggcttctgcggaaaagtttatccgccggatgaccaacaagtgtacatacctggtgggagaggatgttctgcctaaagacagcctcgtgtactccaagttcatggtcctgaatgagcttaacaatctgagactcaacggcgaaaagatttctgtggagctgaagcagcgcatctatgaggagctgttttgcaaataccggaaggttaccagaaagaaacttgaacgctatctcgtgatcgaggggattgccaagaaaggagtcgagatcacaggcattgatggggacttcaaggctagcctgaccgcctaccacgattttaaagaacggctgacggacgtgcagctctcccagagagccaaggaggctatcgtgctgaatgttgtccttttcggagacgataagaaactgctcaagcaacggctgagcaaaatgtatcccaacctgacaaccggccagcttaagggcatttgttctctctcctaccaggggtggggacgcctgagcaaaacctttctggaagagatcacagtgccggcccctggcaccggggaagtgtggaatatcatgacagcgctctggcagacgaacgacaatctgatgcaacttctgtctagaaactatggattcaccaatgaggtcgaggagttcaacacactcaagaaggaaaccgatctgtcctacaaaacagtggacgaactgtacgttagccccgctgtgaagcggcagatttggcagacccttaaagtcgtgaaggagatccagaaagttatgggcaacgcccctaagagagtgtttgtcgagatggcccgcgaaaaacaagaggggaagcggtccgattctagaaagaaacagctcgtggaactgtatcgcgcttgcaagaatgaggaaagagactggattacggagctgaacgcccagagcgatcaacagctccggtccgacaaactgttcctttactatatccagaagggccgctgtatgtactctggagagaccattcagctggatgaactctgggacaatacaaaatatgatatcgaccatatctacccccaaagcaagaccatggatgactccctgaacaatagagttctggtgaagaaaaactataatgctattaagagcgacacataccccctttctctcgatatccagaaaaagatgatgtccttttggaaaatgctgcagcagcaaggcttcattaccaaggagaagtacgtccggctggtgcgcagcgacgaactctctgccgatgagctggcggggtttatcgaaagacagattgtggagacgcggcagtccacaaaagccgtcgctaccatccttaaggaggccctgcctgacacagaaatcgtttatgtgaaagctggaaacgtgagcaatttccgccagacctacgagctcctgaaggtcagagaaatgaacgatctgcaccatgccaaagacgcgtatcttaatattgtggttggcaacgcctactttgtgaagttcaccaagaatgctgcctggtttatccggaacaatccggggcgctcttataacctgaaaagaatgttcgagtttgatattgaacggagcggagagatcgcttggaaggccggcaacaaagggtccattgtcacagtgaagaaagttatgcaaaagaataacatcctcgtgacgagaaaggcctacgaggtcaaaggcggactgttcgaccagcagattatgaagaaaggcaaggggcaagtgcccatcaaaggaaatgatgaacgcctcgctgacatcgagaagtatggcgggtacaacaaagcggccggaacctactttatgctggttaagagccttgataagaaaggcaaggaaattcggacaatcgagttcgtgcctctgtatctcaaaaatcagattgagatcaaccacgaatctgctattcagtacctggcccaggagagagggcttaattcccccgaaatcctgctgagcaagatcaaaattgacaccctcttcaaggtcgacggctttaagatgtggctgtccggacgcacaggcaaccaactcatcttcaaaggggccaatcagctgattctttctcatcaggaggctgccatcctgaagggagtggtgaaatatgtcaaccggaagaatgaaaacaaagatgcgaagctcagcgagagagacggcatgaccgaggaaaagctgctgcagctttacgatacgtttctggacaaactctccaatacagtttattctattcgcctgagcgctcaaatcaagaccctcaccgagaaacgggccaagttcatcgggctgtccaacgaagatcagtgcattgtgcttaatgagatcctgcacatgtttcagtgtcagtctggaagcgccaacctgaaactcattggcgggcctggctccgctggaatcctggtgatgaacaataacattacagcctgcaagcaaatcagcgtcattaatcagtctcccaccggcatctacgaaaaggagatcgaccttattaaactgtga

SEQ ID NO: 4135 - RNA, 4017 nt, synthetic construct
  misc_feature 1..4017: note = Cas9 variant
  source 1..4017: mol_type = other RNA
atgaccaagccctacagcatcggcctggacattgggacaaactccgtgggatgggccgtcgttacggatggctataaagtgcctgctaagaaaatgaaggtgctcgggaataccgacaaatctcacatcaagaagaacctgcttggagcccttctcttcgatagcggcaatacagcgaaagacagacggctgaagcgcaccgctagacggcgctacacaagacggcgcaaccggattctttatctgcaggagatctttgccgaagagatggccaaagctgatgaatccttctttcaaagactcaatgagtctttcctgaccaacgacgataaggaatttgacagccatccgattttcgggaataaagccgaggaggaagctcaccatcacaagtttcccacaatcttccatctgcgcaagcacctcgccgattccaccgagaaatctgacctgagacttatctacctggcgctcgcccacatgattaagtttcggggacatttcctgatcgaaggccagcttaaagctgagaacacgaatgtccagaccctgtttgatgacttcgtggaggtttatgataagacagtggaagagagccacctctccgaaattagcgtctcttccatcctgaccgagaaaattagcaagtctcgcagactggaaaacctcatcaaatactatcctacagagaagaagaataccctgtttggcaaccttattgccctgtccctcgggctgcagcccaatttcaaaacgaacttcaagctgagcgaggacgctaaactgcaattttctaaggacacatacgaagaggatctcggagaactgctgggcaaaatcggggacaattacgccgatctcttcatctccgcgaagaacctgtatgacgccattcttctgagcggaatcctcaccattgatgacaacacaaccaaggctcctctgtccgcctctatgatcaaacggtacgaggaacatcaggaggatcttgctcagctgaagaaatttattcgccagaatctccccgaccaatatagcgaggtgttctccgataagaccaaagacggctacgccgggtatatcgatggaaagacaaaccaggaagccttttacaagtatatcaaaaatatgctgagcaagacggagggcgctgactacttcctggacaaaattgatagagaagactttctccggaagcagagaaccttcgataacggctctgttcctcaccagatccatctgcaagagatgcacgcgattcttcgccggcagggggaatactatccgtttctgaaagagaatcaggacaagatcgagaagattctcacattcagaatcccctactatgtgggacctctggcccgcaaaggctcccggtttgcttgggccgaatacaaggccgataaaaaggtcaccccctggaacttcgacgatatcctggacaaagaaaagagcgctgaggagtttattacaagaatgacccttaatgatctctatctgcctgaggaaaaagtgctgcccaagcactctctcgtgtacgagacgttcaacgtctataatgaactgacaaaggttaaatacgtgaacgagcaagggaaggccatcttctttgacgcgaatatgaaacaggaaattttcgatcatgtgtttaaggagaaccgcaaagtcaccaaggacaaacttctgaattacctcaacaaagagttcgaagagtttcggatcgtgaatctgaccggactggataaggaaaacaaggctttcaacagctcccttggcacatatcacgacctcagaaagattctggacaaatcttttctggatgacaaggttaatgagaagatcattgaagatatcatccagaccctcacactgttcgaggaccgcgagatgattcggcagagacttcaaaaatacagcgatatctttacgacccagcagctgaagaaactcgaacgccggcattatacagggtggggaagactgtccgccaagctgattaacggcatccgggacaaacagagcaataagaccattcttggctacctcatcgatgacgggtattctaaccgcaatttcatgcaactgatcaacgatgactccctgccgtttaaggaggaaattgccagagctcaggtgatcggagagacagatgacctcaatcagctggtcagcgatattgccggctctcctgctatcaaaaaggggattcttcagtccctgaaaatcgtggacgaactcgttaaggtgatgggacacaaccccgccaatatcgtcattgagatggcgcgggagaaccaaaccacggccaaaggcagacgcagctcccagcagcggtacaagagactggaagaggctatcaaaaatctggaccacgatcttaaccataagattctcaaggaacaccctaccgacaatcaggccctgcaaaacgatcgcctgttcctctattacctgcagaatgggagagacatgtacacagaggatccccttgacatcaaccggctgtctgattatgacattgatcatatcatcccccagagctttattaaagacgattccatcgacaacaaggtgctcgtctctagcgctaaaaatcgcggcaagtccgacaacgtgcctagcgaggatgttgtgaatagaatgcggccgttctggaacaaactgctgtcttgcggacttatttcccaacgcaagtacagcaatctgaccaagaaagaactcaagcccgacgataaagccggcttcatcaagagacagctggtcgagacacggcagattaccaaacacgtggcgcagatcctcgacgcccgctttaacacgaagagagatgaaaataagaaagttattcgggacgtgaagatcatcacactgaaatctaaccttgtctcccaattccgcaaggattttaaattctataaggtgagagagattaatgactaccaccatgctcacgatgcctatctgaacgctgtgatcgggaaggccctcctggacgtttaccctcagctggaacccgagtttgtctatggagagtaccctcatttccacggctacaaagaaaataaggccaccgctaaaaagtttttctatagcaacattatgaactttttcaaaaaggatgacatccggacagatgagaatggggaaattgtgtggaagaaagacgagcatatctctaatatcaagagagtgcttagctacccccaggtcaacattgtgaaaaaggttgaaatccagaccgtgggacaaaacggcgggctgtttgacgataatccgaaatcccctctcgaggtcacccccagcaagctggtgcctctcaaaaaggagctgaaccccaagaaatatggcggataccagaagcctacaacggcgtatcccgttcttctgattaccgacacaaaacagctcatcccgatttctgtgatgaataagaaacagttcgaacaaaaccctgtcaagttcctgcgcgatcggggctaccaacaggtggggaagaatgactttatcaaactgcccaagtatacccttgttgatatcggagacggcattaaaagactgtgggcctccagcaaggagatccacaaagggaaccagctcgtggtctccaagaagtctcagattctgctctaccacgctcatcacctggatagcgacctttccaatgattacctgcagaaccataatcagcaattcgacgtgctgtttaacgaaatcatttctttcagcaaaaagtgtaaactcggaaaggagcacatccagaaaattgaaaatgtgtattccaacaagaaaaattctgccagcatcgaggagctggccgaatcctttatcaaacttctgggcttcacacagctcggggctaccagcccctttaacttcctgggcgtcaagctcaatcagaaacaatacaagggaaagaaggattatattctgccttgcacggagggcacacttatccgccagtctattaccgggctgtacgaaacccgggttgacctgtccaaaatcggagaggattga

SEQ ID NO: 4136 - RNA, 4017 nt, synthetic construct
  misc_feature 1..4017: note = Cas9 variant
  source 1..4017: mol_type = other RNA
atgagagactactatatcggcctggatctcgggaccggaagcctgggctgggccgtgacagaccgggagtacgaaattatgcgcgctcacgggaaggccctttggggagtcagactgttcgattccgcgaacacggctgaggaacggcgcggctttagaaccgcccggcgcagactcgaccggcgcaattggagaatcgagctgcttcaggaactgttcggggaggatattggaaaagttgactctggctttttcctccggatgaaggagagcaaatatatgcccgaagataagcgcgacgtgaacggcaattgccctaaactgccgtacgccctgtttgtggaggatgggtatacagacaaggattaccatagacaattccccaccatctatcacctccggaagtggctgatggaaacagaggagacccctgacattcgccttgtctacctggctctccatcacatgatgaaacatagaggacactttctgttctccggcaacatcgaaaagatcaaagagtttcaggaaacattccggcagtacattgggaagatcagagaggaagaacttgattttcacctgtgtattgagggagaagaactccgcgaaaccgagaatatcctgaaagacaagaacctgacgcggtctgccaagaaaaccagactcattaagctgcttggcgctcatacagcctgcgaaaaagcggccctgaatctcgtggctgggggaaccgttaagctgagcgacatcttcggcaactccgagcttgatgcctgtgagaaacccaagctgtcttttgctgacgccggctatgatgactacgcggggatgattgaagatgagctcggagaacagcacgtgatcatcgagacagccaaagctgtctatgactggagcgtgctggccgatattctgggcgactaccgctgcatctccgaagctaaggccgccgtttatgagaagcatcaaaaagatctccggcacctgaaggagcttgtgaaagaaaatctggggagagacgtctacaaggaggtgttcgtgaaaaccaacgaaaagctccctaattatagcgcttacattggaatgacgaagaaaaacggcgtcaagtctgagatggaggggaaacgctgtgatcggaaggcgttctacgactatctgaaaaagacagttgtgaatgccatccccgacgaatccaagaccgagtaccttagaaaagaaatggagacagaaacctttctgcctcgccaggtgaccaaggataacggagtcattccgcaccaggtgcatctccaggagctggacgctatcctggagaatctcagcggccggatccccgccctgaaagaaaacggctctaagattagagatatcttcacatttcgcattccttattacgttgggccccttaacggaatcgtgaaaggcggggagcggacgaattgggtcagacggaagaaggccggacgcatttgcccttggaacttcgacgaaatggtggataccggcgcttccgccgaggaatttatcagacggatgacaagcaaatgtacctatctgatccacgaggacgttctccccaaaaattctatgctgtactccaaattcatggtgctgaacgagcttaataacgtcagactcaatggggaaccgattagcgtggagctgaagcaaaagacatatgaagatctgtttcagcgccatcggaaggtcaccagacgcagactcacggactacatccggcgcgagggcattgcgggaagagatgctgacatcacaggcattgatggggacttcaaaggatccctgaccgcctaccacgattttaaggaaaaacttaccggctgcgagctgtctcaggccgacaaagagaacatcattctcaatatcacactgttcggggaagacaaggctctgcttaaaaagcggctcggagccctgtatcctgctctgaccgagccccagaaaaaggccatctgtgcgctcagctacaagggctgggggcgcctgtcccaaagacttctggaaggcattacagcccctgctcccgagacgggagagatctggaccgtgattcgggccatgtgggaaacaaacgataatctcatgcaggttctgagcgagaaatattgctttgctgccgcgatcgacgaagagaacgccggcgaggagctgaaggagattacctacaaaacagtggaacagatgaatgtctctcccgctgtgcgcagacaaatctggcagtcccttcaggttatcaaggagatttgtaaagtgatgggagggcctccgaagcgggtcttcgtggaaatggcccgcgagaagatggaaagcaaaagaaccgagtctcggaagaaaagactcatcgatctgtataagaaatgccgcgaggaggagcgggactggattgaggaactgggcaacacggaagagaccagactccgcagcgataagctgtacctttattacacacagaaggggcggtgcatgtactccggagaggtgatcgaactggaggaactctgggacaatagaaaatatgatattgaccatatctacccccaatctaaggttatggatgacagcctggataaccgcgtcctggtgaaaaaggagtataacgctgacaaaaccgatgagtaccctatccgggccgacattagaggcaagatgcgcgccttttggcggatccttagagaagaggggttcatttccaaagaaaagtataatcggctcacacgcggcaccggattcgagcccagcgaactggctggctttatcgcgagacagctggtggagacgcggcaggggacaaaggccgtcgcttctgtgctcaaacaggttttccctgagaccgacattgtgtacgccaaggcccgcgtcgcttcccaatttagacaggagttcgatctgatcaaagtgcgggaaatgaacgaccttcaccacgccaaggatgcgtatgttaatatcgtggtcggaaacgtgtactacacaaaatttaccagcaatgctgcctggtatgttaaggaacatcccggcagatcttacaacctgaagaaaatgttcacctccgagcgcgacgtggcccggaatggggaaacagcttggagagccggaaacagcggcacgattgcgaccgtcaagcgcgtgatggggaaaaataacatcctcgtgacacggagatcctatgaggtcaagggcggactgtttgatcagcagctgatgaaaaagggcaaggggcaagttccgattaaaggacgcgacgagcggcttgctgatatcgacaagtacggcgggtataataaagccgccggaacctacttcatgctggctgaatctgaggataagaaaggcgccaagattagaagcgtggaatatgtgcctctctacctgtgtaactgcatcgagaaggacgaagaggctgccaaaaagtacctccagaaagagcgcggcctgaagaatcccagagtccttattgcgaaaatcaagatcgatacactgtttaaggtggacgggttctatatgtggctctccggacggaccggcaaccagctgatttttaaaggggccaatcagctgatcctttctgaacctgacatgcgcattctgaagaaagttctcaagtacgtgaacagaaagaaggagaacaaaaatgctgtcctgggagaacacgatcaactccccgagacggacctgatccggctttatgatgtgttcctggacaagattgagaacacagtttaccatgtgcgcctcagcgcccagcagggcaccctgaccaagaataaagatacattttgtgaactgtccaacgaggacaagtgcatcgtccttagcgaaatcctgcacatgttccaatgtcagtctgggtccgctaatctcaaactgattaagggacctggcagcgccggcatcctcgtgctgaacaatattatctctaaatgcaaccaggtttccattatccaccagagccccaccgggatctatgagcaagaaattgatcttaagaagatctga

SEQ ID NO: 4137 - RNA, 4020 nt, synthetic construct
  misc_feature 1..4020: note = Cas9 variant
  source 1..4020: mol_type = other RNA
atgaacaaggcctacaccctgggcctcgacatcgggacaaatagcgtgggatgggctgtcgttacggatgactatagactgatggccaaaaagatgcccgtgcactccaaaatggagaagaaaaagattaagaaaaacttctggggcgcgcggctttttgatgaagggcagaccgctgaggaacgcagaaataagcgggccacacgcagacggctgcgcagacggaaataccgcatcctcgagctgcaaaagattttctctgaagagatccttaaaaaggacagccactttttcgccagactggatgagtcctttctcattcctgaagacaagcagtatgctcggttcccgatctttcccaccctgctggaggaaaaagcctactatcagaactaccctacaatctatcacctccgccagaagctggctgattctaccgagaaagccgacattagacttgtgtacctggcgctcgcccatatgatcaagtaccggggacacttcctgtttgagggcgaacttgatacagagaataccagcgtcgaagagacgttcaaagaatttattgacatctataacgagcaattcgaggaagggattatcttttacaaggatattcccctgatcctcaccgacaaactgtccaagtctaagaaagtggagaagatcctgcagtattaccctaaagaaaagacaaccggatgcctcgctcagttcctgaaacttattgttggcaatcagggcaacttcaagcaagcctttcatctggatgaggaagtgaagatccagattagcaaagagacatatgaggaagacctcgagaagctgcttcgcaaatccaatgaagagatgatcgacgtcttcctccaggtgaagaaagtttacgatgctattctgctgagcgacatcctgtctaccaagatgaaggatacgaaagccaagctctccgcggggatgatcgaaagatatcagaaccacaaaaaggacctggaggagcttaaacaatttgtgcgggcccatctgcatgaaaaggtcacagtgttctttaaggatagctctaaagacggatacgctggctacattgatgggaagaccacacaggccgacttctataaatttctcaagaaagagctgaccggagtgcccggctccgaacctatgcttgctaagatcgatcaggagaatttcctgctcaaacaaagaaccccgacaaacggggtcattccccaccaggttcatctgacggagtttaaggccatcattgaccagcagaagcaatactatcctttcctggaaaagagcaaggagaaaatgatccagctcctgacctttcgcatcccctactatgtgggacctcttgcccaggataaggaaacatcttccttcgcttggctggagcggaaaaccacagaaaagattaagccctggaatgcgaaagacgtgatcgactacggcgccagcgctaccaagtttattcagagaatgatcaactatgatacgtacctcccgacagagaaagtcctgcctaagtactccatgctgtatcaaaaatacaccattttcaatgagcttaccaaggtggcctataaggacgatcgcggcatcaaacaccagttctctagcgaagagaagctccggatttttcaggaactgttcaaaaagcagagacgcgttacaaagaagaagctgcaacactttctctccgccaactacaacatcgaggacgctgaaatcctgggggtggataaagtcttcaatagctcttatgccacctaccatgactttcttgagctggcgaagccctatacagagaaaattatcgaactcctggagcagcctgaaatggaggaaatgttcgaggatattgtgaagatcattacgatctttgaggaccgggaaatggttagaacccagctgaaaaagtaccagcgcatccttggagaggaaattttcaaaaagctcgtgaagaaaaagtacacaggctgggggcggctgtccaaaagactgatcaacggcattcgcgatcaaaagaccaataaaacaatcctcgactatctgattaacgatgacgattttccctacaatcggaacagaaatttcatgcagcttatcaacgacgaccacctgagctttaaggaggagatcgctaaggaactcaccctgtctgataaacagagcctgcttgaggtcgtggaagccattcccggatcccctgccatcaagaaagggatttggcaaacgctcaagatcgtcgaggaactgattgctatcatcggatataaaccgaagaatattgtgatcgagatggcccgggagaaccagaccacaaccggcggcaagaatcgctctaaacccagactcaagagcctggaagaggctctgaaaaacttcgactcccagcttctgaaggaacggcctgttgataatcagagcctccaaaaagacagactgtacctgtattaccttcagaacgggaaggatatgtatacaggagagtctctcgacattgatcgcctgtccgaatacgacatcgatcatattatcccccggagctttattgtggaccactctctggataataaggtcctcgtgtccagcaaagagaacagactgaagaaagacgatgttcctgactccaaggtggtcaaacgcatgaaggcctactgggagaaacttctgagagcgaacctcatctctgaacggaaattcagctatctgaccaagctggagcttacggacgatgacaaagcccgcttcatccagagacagctggtggaaacacggcaaattaccaagcatgtggctgccatcctccaccagtactttaatcagacacaggagctggaaaaagagaaggatattcgcatcattaccctcaaatcctctctggttagccaattcagacaggtctttggcatccacaaggtgcgggagatcaaccatcaccatcacgctcacgacgcctatcttaatgcggtggtcgccctggctctcctgaagaaatacccccgcctggccccggagttcgtgtatgggtcctttgctaagttccatcttgttaaagaaaacaaggccaccgccaaaaaggaattttacagcaatattctgaagttctttgagaaagaggaacagttctgtgatgagaacggagaaatcttttgggacaagagaaaacacattcaacagatcaagaaagtgatttcttcccatcaggtcaatatcgtgaagaaggttgaggtgcagacaggcagcttctataaagaaacggtcaacaccaaggagaaacctgataagctcatcaaacggaagaataactgggacgtgacaaagtacgggggcttcggatctcccgttgtggcttacgcggtcgtgtttacctatgagaaaggcaagaatcacaaaaaggccaaagctattgaagggatcacaattatggagcaagccctgttcgaaaaggatcctatctcctttctcattgagaaaggatacagcaacgtgaatcagttcatcaagctgcccaagtataccctttttgaactggccaacggccagcgcagaatgctcgcttctcatcaggagctgcaaaaagccaatagcttcattctgcctgagaaacttgtcacgctgctctaccacgcgaaccactatgacgaaatcgcttacaaagattcctatgactacgttaacgagcattttagcaatttccaggacatcctggataaggtgattatctttgccgaaaaatacacatctgctccccagaagctcaaccagattatcgccacctatgagaagaatcaagaagccgaccggaaaattatggcgcactccttcgtgaacctgatgcagtttaatgctcttggggccccggccgatttcaagtttttcgacaccacaatcaccagaaaacgctacacaagcctgacggagatctggcagtccaccattatctatcagtctgtcacaggactgtacgagacccggagacgcatggctgatctctgggacggcgtgcaatga

SEQ ID NO: 4138 - RNA, 4020 nt, synthetic construct
  misc_feature 1..4020: note = Cas9 variant
  source 1..4020: mol_type = other RNA
atggagagataccacatcggcctggacattgggaccagctccatcggatgggccgtgattggcgatgacttcaagatcaaaaagaaaaaggggaaaaacctcattggaacacggctgtttaatgaaggcgctacggccgcggagcgcagagggttccggacccagcgcagacggcttaaccgcagaaagtggcggctgaagctcctggaagagatctttgatccctatatggctgaagtcgacgagtacttctttgcccgccttaaatctagcaatctgtcccctaaggattctaacaaaaagtatctcggaagcctgctgttcccggacaaatccgattctaatttttacgacaagtatcccacaatctaccatctcagacgggatctgatggagaaggacgaaaaattcgatcttcgcgagatttatctggccatccaccatattgttaagtacagaggcaactttctcgaaaaagtgcctgctaagaattacaaaaacagcggcgcctccatcgggttcctgcttgaggaggtgaatagcctgtataaggacattatcggagatgaatctattgctatcctcaactccgagaaatttgaagacgtcgagaagatcattctggacgaagagacccggaatctggataagcaaaagagcgtgggcaagctcctggttgaggacaaaaagaaaaagaacatcgtgacagccttctctaaggcgatttttgggtacaaattcaatatcgaagatcttctgctcattgagaacgacgaaaagaataaactgaccttcaacgatgagaacatcgacgatatctttaatgaactttcccacagcctggacgataagcagatggacctcctgacaaaaacccgcgagatttatttcaagtttaagctgaacatgatcgtccccacgggatacaccctctctgagtccatgattgaaaaatatgagatgcataaggcccacctgaaaatgtacaaggagttcatcaatacacttaacaccaaagatagaaagattctgaagaatgcttatagcgactacatcaacacagagaaagccaaggctgccaatgcgcaggaaaacttttacaaaaccgtgaagaaaatcattaaggacaataactccgatacggccaaaaagatcattgttctcatcgacgagggcaatttcatgcctaagcagcggacaggggagaacggagtgattccccaccaactgcatcagatcgaacttgatagaattatcgagaatcaggctaaatattacccttggctggccgaagctaacccggtcgagaagaatcgcaaatttgccaagtataaactcgacgagctggtgaccttccgggtgccctactatgtcggccctctgatcgataagacagaatctaacaagaacgagaaagaaaccaagtttgcctggatggttagaaaagctaagggcaccattacaccctggaatttcgagaacctcgtggaccgcacggaaagcgcgaatcggtttatcaaaagaatgacctccaaggatacatacattatcggggaggacgtgctgcctgccagctctcttctgtatgagaagttcaaagtcctcaacgaactgaataacattaaggtgaatgagaaaaagctggatatcgaacagaaacaagacatctaccttaacctctttaccacagctaagaatgttaccaagaaatccctggccacgtacctgaactgcagcgccgattctattagcggactctccgacggcgagaagttcaattctagcctgtccagctatatcgatcttaaagctattctggggaacatcgtggacgactgtaataagaacgaagatctcgagaaaattatcgagtactctacagtcttcgaagacggaaatatctataaggagaaactgtccgaaattagctggctgaccgatgagcagatcgaaaaactttctaacattcactttaagggctgggggcgcctctccaaaaagctgctgacccagatcacaaacgagaatggagagcggattatcgacgccctctggaacaccagcaataacttcatgcagatcattaatgatgaatccatccaagcgaaactggctgagattaacggcaagtacgccggcaaatctgaccttgaagatatcctgagcgaggcctatacatctccccagaataagaaggctattagacaggtgatgaaagttgtggaggacatcgaaaaggccatgcaatgcgagccgacgtccattagcatcgaatttacccgcaaaaagcagaaatcccggctcacaaacaccagatacaagaagatcagcgatgtctatgagaaaattgctgacgaagtgatctctgagtacgagctgcgcaagctgcagtccgaacttgatagcaatgccaacaatatgcgggacagatactatctctacttcatgcagctggggcgggatatgtatacaggagagaaaattaacatcgacgaactgcatcaacgctacgacattgatcacatcctccctcagtcttttatcaaggacgattccattaataacagagtcctgacccggaaagacgtgaataacaaggaaaagagcgataaaacggcggccgacctttatgctgttgaaatgtctgatttctggagaaagctgcgcaaacagggcctcatcaccgagcagaagtacaaaaacctgctgacaaagagcgactccattgataagtatgccaaaaaggggtttatcaaacggcaacttgtggagaccagccaggtcgtgaagctcgttgctaatattctgcaggacaaatactctgatacaaagatcatcgaagtgagagccaaactgaactccaatctccgcgaggaatacaagctgattaagaacagagcggtcaatgactatcaccatgccatcgacggataccttaccacgttcattggccagtatctgtacaaaacatatcccaagctccggagctactttgtgtataacgatttcaaaaagctggactccaattacctgaaacacatgaagaagtttaacttcctttggcaactgcaggatgacaaaaccatcgatatttacgacaatgtgaacaataagtttgttctcaacgtccctgagatgaaaaagtatatccagaaaatttacaattataagtacatgctggtgtctaaggaagtgacaaccaaaaacggggctttctatgatcagaccaagtacaatgccaaaacagtcaacctcatccccatcaagaaaaataagcccacgaacatttatggcggatacaagggcaaagtgagctcctacatgatgctggttaagatccgcaaaaagaaagaggtgatttataagttcgtcggggtgcctagactttggaccgacgagctggatcggctcaaagacacaaccgaacgcaagatcctgctgaacgagattgctaaaaattctcttagcaagacagaacaagattttgaggttatcctggacaaggtgtactatggacagctcatcattgatggcaaccagaaatacaccctggggtcctctgagtataagtacaatgccatgcaactccatctgagcaaacacgcccttgaagtcctggctaaggagaacgtgaaggacgcggaaatcacggacaaagatctcgtttccgtgtatgaggaaattctgagcgtcgtgaataagtacttcgagctgtacgacatcaacaaatttagacagaaacttaatgagggactggaaattttccggaagctcccggtgtataacgtctacgagtctaataagatcaagcaggttggcaaatttgaagtgctgaaccgcatcctcatggggctgcatgccaatgctatgattacagatcttaaggtgctgggcatcaaaaccaagctgggacagatgcaagtcaacggcgggattaaactctcccccgacgccaagctgatctatcagagccctaccggaattttctctagagccgtgcgggttaaggatcttggctga

SEQ ID NO: 4139 - RNA, 4020 nt, synthetic construct
  misc_feature 1..4020: note = Cas9 variant
  source 1..4020: mol_type = other RNA
atgagcctgaacaccaataagaaatacaacatcggcctcgacattgggacaacgtccgtgggatgggccgtcaccgatgctgacggccagaagctgcttaaagccaagaataaaaacctgtggggagtttctctcttcgaggcggggaagacagctgccgaaagacggggctatcgcagcaccagacggcgcctgaatcacagaaagtttcggcttcgcctgctcgaggatatgttcgaaaaagagatcctgtccaaggacccctctttcttcattagactgaaagaagcctttctcagccctaaggatgagcaaaaacagttcaaggggaacatcctgtttaatgacaaggattacacagacgctgattattacgagcagtataaaaccatttaccatcttcggtatgacctgatctcccagcaccgccaattcgatatcagagaagtgtacctcgccattcatcacctgatcaagtaccggggacattttatttatgaggaccagacattcaccacggatggcaaccagcttcagcaccacatcaaagctattatcaccatgattaattctatcctgaaccgcatcattatcccggaaacaattgacatcaatgtgtttgagaagaccctcctggacagaacaatgaaccggagctccaaagtcaagttcctgattgagctcaccggcgaagataaacaagacaagcccctgcttaaggagctgtttaatctcatcgtggggctgaaagccaagcctgcgagcatcttcgaacaggagaaccttgccacgattgttgaaacaatgaatatgtctaccgaacaggtgcagctggatctcctgacactggctgacgtcctcgccgatgaggaatacgacctgcttctgaccgctcagaaaatctattccgccattatcctcgatgagagcatggacggatacgaatatttcgcggaggccaagaaagaatcttaccgcaagcatcaggaggagctggtgcttgttaagaaaatgctgaagtccaacgctattaccaacgatgaaagagccaaatttgagtatttctacacagactacatcggcgctaagagctctaattatgaagagtccaaaatcattaagaaggggctcagcgccgcctacggaaaatattccaaggaagaacggctgtttaaacacatcgagctgctcctggctaaggaaaacgtgcttacgaccgtcgagcatgatctgctcgagaaaaatattacattcgcgtctctgctgccccttcagagaagctcccgcaacgccgtgatcccttaccaagtgcacgagaaggagctcgtcgctattctggaaaatcaggccacctattacccctttctgctcgagcagaaggacaacatccacaaactgcttacattccggattccttattacgttggcccgctggccgaccagaaggatagcgaatttgcttggatggtgagaaaacaagccgggaagatcacccccttcaattttgaggaaatggtggacatcgatgcgtcttccgaggctttcattaaacgcatgacgaacaagtgcacatacctcatccatgaggacgtcattcctaaacacagcttttcttatgccaagttcgaagtgctgaatgagctgaacaagatccggcttgatggaaaacccattgacatccctctcaagaaaagaatctttgaaggcctgttcctggagaagaccaaagttacccatacaagcctcaagaagtggctggccgaatacgagcacatgaccgtgtccgtcgtgcagggcacacagaaagagacggaatttgctacctctcttcaggcctttcatcgcttcgttaagatttttgatcgggagacagtgagcaatcccgctaacgaagagatgttcgagaaaatcatttattggtccaccgtctttgaggacaagaaaatcatgagacgcaagctgagcgagtacccgcaactcacagaacagcaacaggtgcaactggcccaggtccggttcagagggtggggacgcctgtctcagcggcttattaatagaatcaagacccctgtgtccggcgatgaggaccacaaactcagcatcaacgaaattctgtggcagacgaatgagaactttatgcaaatcattcggaacaaggattatctgttcaaaaagatcattgaggaacagtttgagaatgaaaccgcgctcctgaacaaacagcgcatcgacgagcttgccacatctcccgctaataagaaggggatctggcaagccattaaaatcgttaaggaactggagaaagtgctccagcagcctgctgagaacattttcatcgaatttgccagatccgatgaggaaagcaagcggtccacccccagagacaaattcattgagaaggcgtacgcccagctgaaaaaggaaacagacacctttaatctggagcaccttaaggagctcaaacaacgctctaagcagctgagctcccagcggctgttcctctatttcatccagaacggaaaatgtatgtactctggcgaacatctggatattgagagacttgacagctacgaagtcgatcacatcctgccccaatcctatatcaaggacaatagcattgagaacctcgctctggtgaaaaaggttgaaaatcagcgcaagaaagattctctgcttctgaactccagcatcattaatcagaactactctagatgggagcagctcaagaatgccgggctgatcggagagaaaaagtttcggaacctcacgcgcacaaaaattaccgacagagataaggaaggcttcatcgctcggcaactggtggagacacgccagatcaccaagcatgtcacccagcttctgcaacaggaatataaagacacaacgaaggtgtttgccattaaagccaccctcgtgtccgatctgagacggaagttcgagtttatcaaaaatcgcaacgttaacgactaccaccacgctcaggatgcgttcctggtcgcctttcttggcacaaatattaccagcaactatcctaagatcgagatggaatacctgttcaaggggtatcagcattacctcaatgaggtgggaaaatctgctgccaagccgaaatttacattcattgtggaaaacctgagcaagcaacagtacaattccaccacgggcgaggtcaaatggaaccccgaagtggacatcgccaagctcaagagaatcctgaattttaaacagtgcaacattgttcggaaggtggaggagcagagcggggctcttttcaaagaaacaatctatcctgtcgaggaatcttccagcaagaccattcccctgaaaaagcacctcgataccgccatctacggaggctatacagcggtgaattacgcttcctatgccctgattcaattcaaaaaggggcgcaagctgaaaagagagatcattggcatccctcttgccgttcagacccggatcgacaactctgaaacaagcctgcagacgtacattgctgagcagatcaagtccgaggtggaaattctcaatggaagaatcctgaaatatcaactcatttctaacaatggcaaccgcctgtacatcgccgggccccgggagagacataatgcgcgccagcttatcgtcagcgacgaagctgccaaggtgatttggctgatctccaccaaacaggccgttgaggctacatttctgaagcactacaccctcgaacatctggaggccgtgttcgaggaacttattcggaagcaggctgccgattatcaaatctttgagaacctgattaaaaagatcgaagtcaacaaagcgtacttctattcttgtacatacaatgagaaggtgaaagtgatcgaggaactcctgaagattacccaggccaacgctacgaatggagacctcaagctgcttaaaatgaccaacagagagggccgcctggggagcgtctccgttgccctggattttaagatcattaatcagagcgtgacaggactctatcaatctatcgaagactacaacaattga

SEQ ID NO: 4140 - RNA, 4020 nt, synthetic construct
  misc_feature 1..4020: note = Cas9 variant
  source 1..4020: mol_type = other RNA
atgagcctgaacaccaataagaaatacaacatcggcctcgacattgggacaacgtccgtgggatgggccgtcaccgatgctgacggccagaagctgcttaaagccaagaataaaaacctgtggggagtttctctcttcgaggcggggaagacagctgccgaaagacggggctatcgcagcaccagacggcgcctgaatcacagaaagtttcggcttcgcctgctcgaggatatgttcgaaaaagagatcctgtccaaggacccctctttcttcattagactgaaagaagcctttctcagccctaaggatgagcaaaaacagttcaaggggaacatcctgtttaatgacaaggattacacagacgctgattattacgagcagtataaaaccatttaccatcttcggtatgacctgatctcccagcaccgccaattcgatatcagagaagtgtacctcgccattcatcacctgatcaagtaccggggacattttatttatgaggaccagacattcaccacggatggcaaccagcttcagcaccacatcaaagctattatcaccatgattaattctatcctgaaccgcatcattatcccggaaacaattgacatcaatgtgtttgagaagaccctcctggacagaacaatgaaccggagctccaaagtcaagttcctgattgagctcaccggcgaagataaacaagacaagcccctgcttaaggagctgtttaatctcatcgtggggctgaaagccaagcctgcgagcatcttcgaacaggagaaccttgccacgattgttgaaacaatgaatatgtctaccgaacaggtgcagctggatctcctgacactggctgacgtcctcgccgatgaggaatacgacctgcttctgaccgctcagaaaatctattccgccattatcctcgatgagagcatggacggatacgaatatttcgcggaggccaagaaagaatcttaccgcaagcatcaggaggagctggtgcttgttaagaaaatgctgaagtccaacgctattaccaacgatgaaagagccaaatttgagtatttctacacagactacatcggcgctaagagctctaattatgaagagtccaaaatcattaagaaggggctcagcgccgcctacggaaaatattccaaggaagaacggctgtttaaacacatcgagctgctcctggctaaggaaaacgtgcttacgaccgtcgagcatgatctgctcgagaaaaatattacattcgcgtctctgctgccccttcagagaagctcccgcaacgccgtgatcccttaccaagtgcacgagaaggagctcgtcgctattctggaaaatcaggccacctattacccctttctgctcgagcagaaggacaacatccacaaactgcttacattccggattccttattacgttggcccgctggccgaccagaaggatagcgaatttgcttggatggtgagaaaacaagccgggaagatcacccccttcaattttgaggaaatggtggacatcgatgcgtcttccgaggctttcattaaacgcatgacgaacaagtgcacatacctcatccatgaggacgtcattcctaaacacagcttttcttatgccaagttcgaagtgctgaatgagctgaacaagatccggcttgatggaaaacccattgacatccctctcaagaaaagaatctttgaaggcctgttcctggagaagaccaaagttacccatacaagcctcaagaagtggctggccgaacacgagcatatgaccgtgtccgtcgtgcagggcacacagaaagagacggaatttgctacctctcttcaggcctttcaccgcttcgttaagatttttgatcgggagacagtgagcaatcccgctaacgaagagatgttcgagaaaatcatttactggtccaccgtctttgaggacaagaaaatcatgagacgcaagctgagcgagtatccgcaactcacagaacagcaacaggtgcaactggcccaggtccggttcagagggtggggacgcctgtctcagcggcttattaatagaatcaagacccctgtgtccggcgatgaggaccacaaactcagcatcaacgaaattctgtggcagacgaatgagaactttatgcaaatcattcggaacaaggattacctgttcaaaaagatcattgaggaacagtttgagaatgaaaccgcgctcctgaacaaacagcgcatcgacgagcttgccacatctcccgctaataagaaggggatctggcaagccattaaaatcgttaaggaactggagaaagtgctccagcagcctgctgagaacattttcatcgaatttgccagatccgatgaggaaagcaagcggtccacccccagagacaaattcattgagaaggcgtatgcccagctgaaaaaggaaacagacacctttaatctggagcatcttaaggagctcaaacaacgctctaagcagctgagctcccagcggctgttcctctacttcatccagaacggaaaatgtatgtattctggcgaacacctggatattgagagacttgacagctacgaagtcgatcatatcctgccccaatcctacatcaaggacaatagcattgagaacctcgctctggtgaaaaaggttgaaaatcagcgcaagaaagattctctgcttctgaactccagcatcattaatcagaactattctagatgggagcagctcaagaatgccgggctgatcggagagaaaaagtttcggaacctcacgcgcacaaaaattaccgacagagataaggaaggcttcatcgctcggcaactggtggagacacgccagatcaccaagcacgtcacccagcttctgcaacaggaatacaaagacacaacgaaggtgtttgccattaaagccaccctcgtgtccgatctgagacggaagttcgagtttatcaaaaatcgcaacgttaacgactatcaccatgctcaggatgcgttcctggtcgcctttcttggcacaaatattaccagcaactaccctaagatcgagatggaatatctgttcaaggggtaccagcactatctcaatgaggtgggaaaatctgctgccaagccgaaatttacattcattgtggaaaacctgagcaagcaacagtacaattccaccacgggcgaggtcaaatggaaccccgaagtggacatcgccaagctcaagagaatcctgaattttaaacagtgcaacattgttcggaaggtggaggagcagagcggggctcttttcaaagaaacaatctactctgtcgaggaatccagctccaagaccattcctctgaaaaagcatctcgataccgccatctatggaggctacacagcggtgaattatgcttcttacgccctgattcaattcaaaaaggggcgcaagctgaaaagagagatcattggcatcccccttgccgttcagacccggatcgacaacagcgaaacatccctgcagacgtatattgctgagcagatcaagtctgaggtggaaattctcaatggaagaatcctgaaataccaactcattagcaacaatggcaaccgcctgtatatcgccgggcctcgggagagacacaatgcgcgccagcttatcgtctccgacgaagctgccaaggtgatttggctgatctctaccaaacaggccgttgaggctacatttctgaagcattacaccctcgaacacctggaggccgtgttcgaggaacttattcggaagcaggctgccgattaccaaatctttgagaacctgattaaaaagatcgaagtcaacaaagcgtatttctacagctgtacatataatgagaaggtgaaagtgatcgaggaactcctgaagattacccaggccaacgctacgaatggagacctcaagctgcttaaaatgaccaacagagagggccgcctggggtccgtcagcgttgccctggattttaagatcattaatcagtctgtgacaggactctaccaatccatcgaagactataacaattga

SEQ ID NO: 4141 - RNA, 4020 nt, synthetic construct
  misc_feature 1..4020: note = Cas9 variant
  source 1..4020: mol_type = other RNA
atgaagaaagagtacaccatcggcctggacattgggacaaacagcgtgggatggtccgtcctcacggatgactatagactggtttctaagaaaatgaaggtggccggcaataccgaaaagagctccacaaagaagaacttctggggagtgcggctttttgatgagggacagaccgctgaagcccgcagatctaaacggacagcgcgcagacggctggctcgcagacggcaacgcatcctcgagctgcagaagattttcgcccccgaaatccttaaaattgacgagcactttttcgccagactgaatgagagctttctcgtcctggatgaaaagaaacagtcccggcatcctgtgttcgctaccatcaagcaggagaagtcttaccaccaaacatatccgaccatctaccatctgcgccaggccctcgctgacagctccgaaaaagccgatattagactggtttatcttgcgatggcccatctgctcaagtaccggggccactttctgatcgagggggagcttaacacggaaaatagctctgtgaccgagacattccgccagtttctgtccacctataaccagcaattcagcgaagctgacgataaacagacagagaagctcgacgaagccgtcgattgctcttttgtgttcaccgagaaaatgtccaagacgaaaaaggctgagacactgctgaagtactttccccacgaaaagagcaatggatacctctctcagttcattaagctgatggttggcaaccagggcaatttcaaaaacgtgtttgggcttgaggaagccaagctgcaattctccaaagagacctatgaagaggacctcgaggaactgcttgagaagatcggagatgactacattgacctgtttgtccaggcgaagaatgtgtatgatgccgtgctcctgagcgaaatcctgtccgactctaccaaaaacacaagagctaagctcagcgccggcatgattcggagatacgatgctcacaaagaggacctggtccttctgaagcgcttcgttaaagaaaatctccctaagaagtatcgggcctttttcggggataactccgtgaatggatacgccggctatatcgaggggcatgctacccaggaggacttttacaaattcgtgaagaaagaactgacaggaatcagaggcagcgaggtctttcttacgaagattgaacaagagaacttcctgcgcaaacagcggacctttgataacggcgtgatcccccaccagattcatctcacagagctgagagcgatcattgccaatcagaagaagcactaccctttcctgaaagaggaacaagaaaagctcgagtctctgcttacctttaaaatcccctattacgttgggcctctggctaagaaacaggaaaactccccgttcgcctggctcatccgcaagagcgaggagaaaattaagccctggaatctgcctgaaatcgtggacatggagggatctgccgtccggttcattgaaagaatgatcaacacagatatgtatatgccccacaataaggtgctgcctaaaaacagccttctctaccagaagttttccatttataatgagctgaccaaagttcgctaccaggacgaacggggccaaatgaactatttctctagcatcgagaagaaagagatctttcatgaactgttcgagaagaatagaaaggtgacgaaaaaggatctccaggaatttctgtaccttaaatacgacattaagcacgctgagctgtccgggatcgaaaaagccttcaacgcgagctatacaacctaccatgactttctcaccatgtctgagaataagcgcgagatgaagcagtggctggaagatcccgagctggcttccatgttcgaagagattatcaaaacacttaccgtctttgaggaccgggaaatgattaagacaagactcagccaccatgaggccacgctgggaaaacacatcattaagaaactgaccaagaagcactatacaggctgggggcggctctctaaagaactgatccagggaatccgcgataagcaatccaacaaaaccattcttgactacctgatcaatgatgacgatttcccgcatcacagaaaccggaattttatgcagctcattaacgacgatagcctgtccttcaagaaagagatcaagaaagcccagatgattacagacaccgaaaacctggaggagatcgtgaaggaacttacgggctctcctgctatcaagaaaggcattctccagagcctgaagatcgtcgatgagattgtggggatcatgggatatgaacccgccaatattgttgtggagatggctagagaaaaccaaaccacaggccgcgggctgaaatcctctcggcctagactcaaggccctggaggagagccttaaagactttggatcccagctgctcaaggaataccccaccgataatagctctctgcagaaggaccgcctgtatctttactacctccaaaacggcagagacatgtatacaggggcgcccctggatatccatcggctgtccgactacgatatcgaccacattatccctcgcagcttcaccacggataattctattgacaacaaagtcctcgtgtccagcaaggagaatagactgaaaaaggatgacgttccgtctgaaaaagtggtcaagaagatgcggagcttctggtatgatctttactccagcaaactgatctctaagcgcaaactcgacaacctgacaaagattaaactgaccgaggaagataaggccggctttatcaagagacagcttgtggagacacggcagatcaccaaacacgtggctgggattctgcatcaccgcttcaataaggccgaggacaccaacgaacccatcagaaaagttcggattatcacactcaagtccgctctggtcagccagtttcgcaatagattcggcatttataaagtgcgggagatcaacgaataccatcacgcccatgatgcgtatctcaatggggtggtcgccctggcccttctgaagaagtaccctcaactcgctcccgagtttgtgtacggagagtatctgaaattcaacgctcacaaggccaataaagccacggttaagaaagaattttactccaacattatgaagttctttgagtctgacacccctgtgtgtgacgaaaacggcgagatcttctgggataaaagcaagtccatcgctcaggtcaagaaagtgattaatcaccatcacatgaacatcgttaagaaaacagaaattcagaaagggggattttctaaagagaccgtggagcccaagaaggacagctccaaactgcttccgagaaagaataactgggatcctgcgaaatatggcgggctgggctctcccaatgtcgcctacacagtggctttcacctatgaaaagggaaaagcccgcaagcggacgaacgccctcgagggcatcacaattatggaaagagaggctttcgaacagagccctgttctgtttctcaagaataaagggtacgagcaagccgagatcgaaatgaagctgcccaaatatgcgcttttcgagctggaaaacggacgcaagcggatggtggcttccaataaagaggcccagaaggccaacagctttctcctgcctgaacatctggtcacccttctgtaccacgctaagcagtacgacgagatctctcataaagagtccttcgattatgtgaatgaacaccacaaggagtttagcgaagtgttcgccagagtcctcgagtttgcgggcaaatacaccctggctgagaagaacattgaaaaactcgagaagatctataaagaaaatcagacagacgatctggccaaacttgcctcttccttcgttaacctgatgcaatttaatgctatgggggcccccgctgacttcaagtttttcgatgtgaccattccgcgcaaacggtacacaagcctgacggagatctggcagtctaccattatccatcagtccatcacaggactctatgaaacccgcattagaatgggcaagtga

SEQ ID NO: 4142 - RNA, 4023 nt, synthetic construct
  misc_feature 1..4023: note = Cas9 variant
  source 1..4023: mol_type = other RNA
atgaagaaagagtacaccatcggcctggacattgggacaaacagcgtgggatggtccgtcctcacggatgactatagactggtttctaagaaaatgaaggtggccggcaataccgaaaagagctccacaaagaagaacttctggggagtgcggctttttgatgagggacagaccgctgaagcccgcagatctaaacggacagcgcgcagacggctggctcgcagacggcaacgcatcctcgagctgcagaagattttcgcccccgaaatccttaaaattgacgagcactttttcgccagactgaatgagagctttctcgtcctggatgaaaagaaacagtcccggcatcctgtgttcgctaccatcaagcaggagaagtcttaccaccaaacatatccgaccatctaccatctgcgccaggccctcgctgacagctccgaaaaagccgatattagactggtttatcttgcgatggcccatctgctcaagtaccggggccactttctgatcgagggggagcttaacacggaaaatagctctgtgaccgagacattccgccagtttctgtccacctataaccagcaattcagcgaagctgacgataaacagacagagaagctcgacgaagccgtcgattgctcttttgtgttcaccgagaaaatgtccaagacgaaaaaggctgagacactgctgaagtactttccccacgaaaagagcaatggatacctctctcagttcattaagctgatggttggcaaccagggcaatttcaaaaacgtgtttgggcttgaggaagaggccaagctgcaattctccaaagaaacctatgaggaggacctcgaggaactgcttgaaaagatcggagatgactacattgacctgtttgtccaggcgaagaatgtgtatgatgccgtgctcctgagcgagatcctgtccgactctaccaaaaacacaagagctaagctcagcgccggcatgattcggagatacgatgctcacaaagaagacctggtccttctgaagcgcttcgttaaagagaatctccctaagaagtatcgggcctttttcggggataactccgtgaatggatacgccggctatatcgaggggcatgctacccaggaagacttttacaaattcgtgaagaaagagctgacaggaatcagaggcagcgaagtctttcttacgaagattgagcaagagaacttcctgcgcaaacagcggacctttgataacggcgtgatcccccaccagattcatctcacagaactgagagcgatcattgccaatcagaagaagcactaccctttcctgaaagaggaacaagagaagctcgaatctctgcttacctttaaaatcccctattacgttgggcctctggctaagaaacaggagaactccccgttcgcctggctcatccgcaagagcgaggagaaaattaagccctggaatctgcctgaaatcgtggacatggaaggatctgccgtccggttcattgagagaatgatcaacacagatatgtatatgccccacaataaggtgctgcctaaaaacagccttctctaccagaagttttccatttataatgaactgaccaaagttcgctaccaggacgagcggggccaaatgaactatttctctagcatcgagaagaaagaaatctttcatgagctgttcgaaaagaatagaaaggtgacgaaaaaggatctccaggagtttctgtaccttaaatacgacattaagcacgctgaactgtccgggatcgagaaagccttcaacgcgagctatacaacctaccatgactttctcaccatgtctgagaataagcgcgaaatgaagcagtggctggaggatcccgaactggcttccatgttcgaggagattatcaaaacacttaccgtctttgaagaccgggagatgattaagacaagactcagccaccatgaagccacgctgggaaaacacatcattaagaaactgaccaagaagcactatacaggctgggggcggctctctaaagagctgatccagggaatccgcgataagcaatccaacaaaaccattcttgactacctgatcaatgatgacgatttcccgcatcacagaaaccggaattttatgcagctcattaacgacgatagcctgtccttcaagaaagaaatcaagaaagcccagatgattacagacaccgagaacctggaggaaatcgtgaaggagcttacgggctctcctgctatcaagaaaggcattctccagagcctgaagatcgtcgatgaaattgtggggatcatgggatatgagcccgccaatattgttgtggaaatggctagagagaaccaaaccacaggccgcgggctgaaatcctctcggcctagactcaaggccctggaggaaagccttaaagactttggatcccagctgctcaaggagtaccccaccgataatagctctctgcagaaggaccgcctgtatctttactacctccaaaacggcagagacatgtatacaggggcgcccctggatatccatcggctgtccgactacgatatcgaccacattatccctcgcagcttcaccacggataattctattgacaacaaagtcctcgtgtccagcaaggaaaatagactgaaaaaggatgacgttccgtctgagaaagtggtcaagaagatgcggagcttctggtatgatctttactccagcaaactgatctctaagcgcaaactcgacaacctgacaaagattaaactgaccgaagaggataaggccggctttatcaagagacagcttgtggagacacggcagatcaccaaacacgtggctgggattctgcatcaccgcttcaataaggccgaagacaccaacgagcccatcagaaaagttcggattatcacactcaagtccgctctggtcagccagtttcgcaatagattcggcatttataaagtgcgggaaatcaacgagtaccatcacgcccatgatgcgtatctcaatggggtggtcgccctggcccttctgaagaagtaccctcaactcgctcccgagtttgtgtacggagaatatctgaaattcaacgctcacaaggccaataaagccacggttaagaaagagttttactccaacattatgaagttctttgaatctgacacccctgtgtgtgacgagaacggcgaaatcttctgggataaaagcaagtccatcgctcaggtcaagaaagtgattaatcaccatcacatgaacatcgttaagaaaacagagattcagaaagggggattttctaaagagaccgtggaacccaagaaggacagctccaaactgcttccgagaaagaataactgggatcctgcgaaatatggcgggctgggctctcccaatgtcgcctacacagtggctttcacctatgagaagggaaaagcccgcaagcggacgaacgccctcgaaggcatcacaattatggagagagaggctttcgaacagagccctgttctgtttctcaagaataaagggtacgagcaagccgaaatcgagatgaagctgcccaaatatgcgcttttcgaactggagaacggacgcaagcggatggtggcttccaataaagaagcccagaaggccaacagctttctcctgcctgagcatctggtcacccttctgtaccacgctaagcagtacgacgagatctctcataaagaatccttcgattatgtgaatgagcaccacaaggaatttagcgaggtgttcgccagagtcctcgagtttgcgggcaaatacaccctggctgaaaagaacattgagaaactcgaaaagatctataaagagaatcagacagacgatctggccaaacttgcctcttccttcgttaacctgatgcaatttaatgctatgggggcccccgctgacttcaagtttttcgatgtgaccattccgcgcaaacggtacacaagcctgacggaaatctggcagtctaccattatccatcagtccatcacaggactctatgagacccgcattagaatgggcaagtga

SEQ ID NO: 4143 - RNA, 4023 nt, synthetic construct
  misc_feature 1..4023: note = Cas9 variant
  source 1..4023: mol_type = other RNA
atgaagaccgactacttcatgggcctggatatggggacaggaagcctcggctgggccgtgacggactcctcttatcacctgtgcagagctcatgggaaagatctttggggagtccggctgtttgagaccgcccagacagcggaagaacgcagagttttccggtgtaaccgcagacggctcgaccgcagaaagcggcgcatccaactgcttcaggatatttttgctcccgaaatctacaaaattgaccctggcttctttctgagactcaaggagagccggtatctgccggaagataaaaagaatctggaggggaagacccccgagctcccttacgccctgttcgtggacaaaaagtatacagataaagactttcacaaggaataccccaccatctatcatcttcgcctgagactcatgcaggatcggacccctgccgacgtgcgcctggtctaccttgctctgcaccatctcattaaacacagaggacacttcctgtttgccggcatcgaggctgataaggtgacagacttctccgccgcgttttctgagttcctgcggatcgttcaggagcaagagctcgacattagctttacgcccgatgaagagtcctctcagatcattaaggaaaccctgcagaacacaaatttcaccagaagcaaaaagtccacagagcttatcaaaggcctgaaggccagcaccgggtgcgaaaaagctctcctgaaacttatttctggatgtaaagtgaagctgtccgccgtcttcgacgatcctggctgcgacgcttacgagaagccccaggtgtgttttgccgagagctcttatgaagattacgcggccatcctcgaggacgaactggaggatcgcttcattgttatcgctgccgctaaagccctgtatgactggtccgtgctcgtcaacatcctgggggaagccagcacggtgtctgaggctaaggtgggaatttacgagaaacatcggagagatcttaagtatctgaaacacctcgtcaagacaaatctgacccgcgaagactaccaagatctttttgttaaggcgggcgccaaaaagaacaattattgcgcttacatcgggatgacaaagaagaacaataaaaaggtggtgctggaggaaaagcggtgtaccaaagaggacttctacgcctatctcaagaaagaaatttactccaaggtccaggagaacccggaggccgaatatctgctggaggaactcgagaaaggaacctttctgcctagacaggtgagcaaggacaatggcgttatcccctaccagcttcaattcctggagctccagaagattctgaaaaacgctgtggaatatctgccttttcttaaggaggaatccgagaaaatccagcaaatcatgacattccgcattccctactatgtcggcccgctcaatgggaagaaagaaggacagaacacgtttgcctgggcggtgcggaagaataacgagcctgtttacccctggaacttcgaggaagtgatcgataccgaggcttctgccgaacagtttattagacgcatgacaaataaatgcacctacctgcctggcgaggacgtcctgcccaaggaaagcctcctgtattccaagttcatggtgcttaacgagctgaataacctccggatcaatgggacaaaaattagcgtcgagctgaagcaggaactgtacgagaaactttttcaaagatatcgcaaggtgtctgccaaaaagctccgggattacctggttagaaacggaatcaccgaaaaggacgctgagatctccggcattgatggggacttcaaaggaacgctgcgggcctatcatgatttcaaggaaaaactcacaggcgtggagctgaccgaggctgaaaaggagaccatcattcttaatatcacactgtttggcgaagacaaagtcctcctgaagaagcgcatgcagagactgcttcccaacctcaccgaggggcagaaaaaggccattgtgacactgaattacagcggatggggccggctgtctagagagttcctcgaagaggttcaggcgcctaacccggaaagcggggagatcctgtccattatccgcgccctttgggaaacgaatgctaacctgatgcaactcctgtctaatcagtatggataccaggagatcctggagcagatgcgggccgattggaccggccacaaacttgactaccaaacagtggaggaactctatgtcagccccgctgtgaagagacagatttggcagaccctccaggtggttaaagaactgaagaaggtcatgggcggggagcctaaacgcgtgtttctcgaagtggccagagagaagatggagtccggacggacagtcagccgcaaaaagcacctgaaagatctttacctgtcttgtaagtccgaagagagaaactggctcgcggaactggaccggcatgaggaacacagctatcgctctgatagactgttcctttactatacccaaaaaggccggtgcatgtactgtgggaagcccatcgacctgggacatctctgggacgtgaatatgtatgatattgaccacatctaccctcagtccaaggttatggatgacagcattcgcaacagagtgctgacgtgccggacctgcaacgccgagaaaacagatcattaccccctcaaggctgagatccgccagaaaatgagaccgttttgggactccctgaaggccggcaatttcatcgaagaggaaaaatggaagcggcttattagatctgaggagtttaccagcacagaactggctgggttcatcgagcgccaactcgtcgaaacccggcagtccacgaaggccgtggccgatattctgaaacaggctatgcctgagacagaaatcgtttatgtgaaggcgaaaaacgtctctgcctttagacaggacttcaattttgtgaagaaccgcgatgttaatgacttccaccacgctaaagatgcctacctgaacattgtggtcggaaatacctattttgtgaagttcacaaagaacgccagctggttcatcgagcggaatcccggcagatcctacaaccttaaacgcatgtttaccagcgactatgatgtgatgtctaatggggagatcgcttggaaggccggcaactccggaaccattacaacggtccggaaaatgatgaagaaaaatagcgttctgttcaccagacgctcttttgaagtgtccggcgggctgttcgaccaacagctgatgaagaagggaaaaggccaggtgtacgtcaagagcggggacgagcggctcagatctatcgaaaaatatggaggctacaacaaggcgacaggggcttactttatgctggtggagagcgaaggcaaaaagggagttaagaaacggaccattgagttcgtgcctctttatcgcaaggccgagctggaagcctccgaggagaaaatgctcgaatacctgagaacagaaatcggcctgaaggagccccatgtccttctgcacaaaattaagaccgatacgctctttcaggctgacgggttcaaaatgcatctgagcggacggacaggcaagcaactcgtgtttaagggggccaatcagttcctggttgcggaggattatgaacgccttctgaaaaaggtgggaaaagtcaccgagcagctgaagaccaacaaaaactacaagatcaatgactatgatggcatcacagaagaggggctcaaggctctgtactctgagtttctttccaaactgcagaaggccccttatggcaacagactcggaacccaagccgaaacactggagaatggcaaagaaaagttcgacaaactcagcctggagaacaagtgtcaggtgctttccgaaattctgcacctgttccagtgcaattctagcgctgccgatctctccaagctgggagggcccggccacgggggaatccttgttctgtctaacgagattacgaaatgtaataagatcagcattatccatcaatccccggctggcatttacgagcaggaaatcgacctcaaaaccctgtga

SEQ ID NO: 4144 - RNA, 4023 nt, synthetic construct
  misc_feature 1..4023: note = Cas9 variant
  source 1..4023: mol_type = other RNA
atggagcaggaatactatctgggcctcgacatggggaccggaagcgtgggctgggccgtcacagattccgagtaccacgttctgagaaagcatgggaaagctctttggggagtgcggctgttcgaatctgccagcacggcggaggaacgcagaatgtttcggacctcccgcagacggctcgaccgcagaaactggcggatcgagattctgcaagagatcttcgctgaagagatttctaagaaagatcccggctttttccttcgcatgaaggaaagcaaatattaccctgaggacaagagagatatcaatgggaactgcccggagctgccctatgccctctttgtggacgatgacttcacagataaggactaccacaaaaagtttcctaccatttatcatctgcggaaaatgctgatgaatacagaagagacccccgatatccgcctcgtctacctggccatccaccatatgatgaagcacagaggacacttccttctgtccggcgacattaacgaaatcaaagagtttggcacaaccttctctaagctcctggaaaatattaagaacgaggagcttgattggaatctggaactcgggaaagaggaatacgctgtggttgagagcatcctgaaggacaacatgctgaatcggtccacgaaaaagacccgcctcattaaagccctgaaggctaaaagcatctgtgaaaaggccgtgcttaacctgctcgcgggaggcacagtcaagctgtctgacatttttgggcttgaggagctgaatgaaaccgagagacctaaaatctccttcgccgataacggatatgacgattacatcggcgaagtggagaatgaactcggggagcagttttatattatcgagacagctaaggccgtttacgactgggctgtgctggtcgaaattctgggaaaatataccagcatctctgaggccaaggtggcgacgtacgaaaaacataagtccgatctccagttcctgaagaaaattgtgcggaagtatcttacaaaagaggagtacaaggacatcttcgtcagcacctctgataaactgaagaactactccgcctatatcggcatgacaaagattaatggcaaaaaggttgacctccagagcaaaagatgctccaaggaagagttttacgatttcatcaaaaagaacgtgctgaagaaacttgaagggcaacccgagtatgaatacctgaaggaggagctcgaacgcgagacctttctgcctaaacaggtgaaccgggacaatggagtcattccgtatcagatccacctgtacgaactcaagaaaattctgggcaaccttagagataagatcgacctgatcaaagagaatgaagacaagctcgtgcagctgttcgagtttcgcattccctattacgttgggcctctgaacaagatcgatgacggaaaagagggcaagttcacctgggctgtgcggaaatctaatgaaaagatttacccctggaactttgagaatgtcgtggatatcgaagccagcgctgagaaattcattagacgcatgacaaacaagtgtacgtatcttatgggggaagacgttctccctaaggattccctgctgtacagcaaatatatggtgctcaatgagctgaacaatgtcaaacttgacggagagaaactgtctgtggaactcaagcaacggctgtacaccgatgtcttttgcaaatatagaaaggtgacagttaagaaaatcaagaactacctgaaatgtgagggcattatctccggcaatgtggaaatcaccgggattgacggagatttcaaggccagccttacagcctatcatgactttaaagagatcctcaccggcacggagctggctaagaaggataaagaaaacattatcacaaatattgtcctgttcggggacgataagaaactcctgaagaaacgccttaaccggctgtacccccagatcaccccgaaccagctcaagaaaatctgcgcgctgtcttacaccggatggggcagatttagcaagaagttcctggaggaaattacagcccctgaccccgagaccggggaagtgtggaatatcattacagctctttgggagtccaacaataacctcatgcagctgctgtctaatgagtatcgcttcatggaagaggttgaaacgtacaacatgggcaaacaaaccaagacactcagctatgagaccgtggaaaatatgtacgtctcccctagcgtgaaacggcagatctggcagacactgaagattgtgaaagagcttgagaaggttatgaaggaatctcccaaaagagtctttatcgagatggcccgggaaaagcaagagtccaaacgcaccgaaagcagaaagaaacagctgatcgacctctataaggcctgtaagaacgaggagaaagattgggtgaaggaactgggagaccaggaggaacagaaactgcggtctgataaactttacctctattacacgcaaaagggcagatgcatgtactccggggaggtgattgagctgaaggacctgtgggataataccaagtatgacatcgatcacatttacccccagagcaaaacaatggacgattccctcaacaatcgcgtcctggtgaagaaaaagtataacgctaccaaatctgacaagtaccctcttaatgaaaacatccggcacgagagaaagggattctggaaaagcctgctcgatggcgggtttatttccaaggaaaaatatgagcgcctgatcagaaatacagaactgtctccggaggagcttgccggattcatcgaacggcagattgttgagacccgccagagcacgaaggcggtggctgaaatcctgaaacaagtctttcccgagtccgaaattgtgtacgttaaggccggcacagtgagcagattccggaaagactttgagctcctgaaggtccgcgaggtgaacgatctccatcacgccaaggacgcttatctgaacatcgttgtgggcaattcttactacgtcaaattcaccaagaacgcctcctggtttattaaagaaaatcctgggagaacatataaccttaagaaaatgttcaccagcggatggaatatcgagcggaacggcgaagtggcttgggaggtggggaagaagggaaccattgtcacagttaaacagatcatgaataagaacaatatcctggtgacgcgccaggtgcatgaagccaaaggcgggctctttgaccagcaaattatgaagaaaggaaagggccagatcgcgattaaggagaccgatgagagactggcctctatcgaaaaatacgggggctataacaaggctgccggagcttacttcatgctggtcgagtccaaagacaagaaaggcaagacaattcggaccatcgaatttatccccctttatctgaagaataaaattgagagcgatgagtctatcgccctcaacttcctggaaaaggggcgcggactcaaagagcctaagattctgcttaaaaagatcaaaattgacacactgttcgatgtggacggctttaagatgtggctcagcgggagaaccggagatcggctgctgttcaagtgtgcgaatcagcttatcctggacgaaaagatcattgttacgatgaagaaaatcgtgaagtttattcagagacgccaagagaaccgggaactcaaactgtccgataaggacggcatcgataatgaggtcctcatggagatttacaacacattcgtggacaagctggaaaacaccgtttatagaatccgccttagcgagcaggccaaaaccctgattgacaagcagaaagaatttgagcggctgtctctcgaagataagtccagcacactgttcgagatccttcacatctttcaatgccagtcctctgctgccaatctgaaaatgattgggggccccggaaaggctggcatcctcgtgatgaacaataacattagcaagtgtaataaaatctccattatcaaccagtctccgaccgggatcttcgagaatgaaattgacctgctcaagatctga

SEQ ID NO: 4145 - RNA, 4023 nt, synthetic construct
  misc_feature 1..4023: note = Cas9 variant
  source 1..4023: mol_type = other RNA
atgggcgaggaatacttcctggggctcgacatgggaaccggcagcctggggtgggccgtgacagatgacaagtatcagatccttagacggcacggaaacgctctgtggggcgtccgcctctttgagacggccaataccgcggaagagagacggatgttccgcacaaacagacggcgcctggatagacaagggtggcggattaaaatccttcaggaactgtttgctgaggagatttgccgcgttgaccccggattctacctcagaatgaaggaatccaaatattaccctgaggataagcgggacgccaatggcgaatgtccggccctgccctatgctctgtttgccgatgctcagtacaccgacaaagattatcatcgcgagttccctacaatctaccacctcagaaagatgctgatggagaccgaaacaacccccgacattcggcttgtgtacctggcctttcatcacatgatgaagcatcgcggccacttcctcctgtctggggatatcagccaggtgacggagtttagaaacaccttccttcaaatgatcgcgaatattaaatccgaagaactggacttttctctcgaaatcgaggagacacagatgggacagattgaagccgtcctgaaggatcacaaactgacccggagcgagaagaaaagacgcctcacacagatcctgaagcctgctaccgcctgcgaaaaggctattttcacgcttctgtccggcgggacagtgaaactctctgacatctttggaaaggccgagctggacgaaggcgagcggcccaaaattagcttcgcggataacgggtatgacgattactccgccagcgttgaggctgaccttggagaacaatattacatcatcgagtctgccaaggctgtgtatgattggtccgtcctgagcgacattctcggcgattctgtgtccatcagcgacgccaaagttaagctgtacgaaaaacataagaaggatctggcctatctcaaaaaggtggtcagagagaatctgcctcgcgaagtgtacaaccaggtgttcgtcaataccgacgagaaactttgtaactactgcgcttatattggcatggcgaagaaaaatgggcggaaggttgccctggagggaaagagatgtacacgcgaagagtttgaatctttcctccggaaaaagatcgtgaacaaaattgaggataaggagatccaggaatacctgtccgaggaaatcgagaaaggcacctttcttccgagacaggtgaccaaggacaatggggtcattccctatcaaatccacctgtacgaactccgcaagattatcgacaacctgagccctcggatgcccttcattagagataatggagacaaaatcatccagctgtttacattccgcattccttattacgtgggccccctcgggaagggagagggctccgagaaattttcttgggctgttcggagaacggatgaagccatctatccgtggaacttcaaggacgtgattgatgtcgaggccagcgctgaaaaatttatctgccggatgaccaacaagtgtacatacctgtacggcgaggacgtgcttcctaaggatagccccctgtattccaaattcatggttctcaatgaactgaacaatctgaagctcgacgggcagtctgtgtccgtcgagctcaaacaacgcatttaccaggagctgttttgccataccagaaaggtgacacagaaaaagctggtcagctatctcgtgcgggaaggaatcaccggcaaaaacgttgagatttctgggatcgatggagacttcaaggccagcctgacggcgtaccacgattttaaggaaaaacttacaggcgtggagctgtcccagcaagaacaggaggagatcgtcagaaatattgtgcttttcggggaagacaagaaactgctgaagcagcgccttgagggccggttccctcagctcacccaaaaacagatctctgttattgctaccctgagctataagggatggggcagactgtcccgcgaatttctcgagaacatcacagtgcccgcccccgggaccggagaggtctggaatattatcacagccctgtgggaaacgaacgataatcttatgcagctgctctacggcgagtatgggttccagaccgaaatcgagtgttttaacgctaaggagaaaaagaaaagcctgtcttacgagacaattgaggaatcctacgtgagcccttctgtgaagagacaaatctggcagaccctgcaggttgtcaaagagcttaagaaggtgatgcggggagacccgaaacgcgtgttcattgaaatggccagagagaatcaggaatccaagcggacagagagccgcaaaaagaccctcctggacctgtataaaaactgcaagaaggaggaacccgagtggatcgctgaactcacggagcacctggaaaaacttgatgactcccaactgagaaaggataaactctttctgtactatacccagaagggccggtgtatgtactctggggagcgcattgagctggaagacctttgggataatacaagatatgacatcgatcatatctaccctcagagcaaaaccatggacgattccgtcgacaaccgggtgctcgttaagaaagagtataatgccaagaagacagatgtgtaccccattgcggccgacatccgcggcaaaatgtctcctttctggaagaaactgctggataacaagctcattagcaaaaagaagtacgacagactggtccggaccgaagaacttacgcccgaggaactggctggatttatcgacagacaactcgtggagacacgccagtccaccaaagttgtggccgaaattctgaaggaggctttcccggatacagaaatcgtctatgtgaaagccggcaacgttagcaattttcggcacatgttcgacatcgtgaaggtcagagagctgaacgatcttcatcacgcgaaagacgcctacctgaatattgtggtggggaacgcttattacgtcaagtttaataagaacgccgcttggttcatcaaagagaatcctggacgctcttataacctcaagcggatgtttgattacgacattagacgcaataacgaagttgcctggctggccggctccaccgggaccatcagccaggtgaaaaatatggtgtctaagaaccatattctcgtcacacggaaatcctatgaggtgacgggaggcctgttcgatcagcaacttatgaagaaggggaaaggccaggttcccgtgaagaccagcgacgaaagactgggaaatatcgagaaatacggcgggtacaacaaggcttctggagcgtatttcatgctcgtcaaaagcaagaataagaaaggcgaggagcagcgcacaattgagtacgtgcctatctatctgaagcactacatcgaagagtccaaagaaaacgccctggattatcttaagaacgagcggaaactgaatgaacccgagattctcctggacaagatcaaaaaggataccctctttagagttaacgggttctacatgtgcctgagcaagcggacaggaaaacagcttgcttttaagggcgccaatgagctgctcctgcctgaacccgagaccctgcttctgaaaaagattacgaaatatatccaacgcagaaaggaaaacaaggacctcaaactgacaaagcaggacaatattaccgagaaagagctcctggaactttacgatgtgttcaccgagaagctgaaccactctgtctacgccgtgtgcctggggacacagggcaaaaccctcgttcagaagaagccggcttttgtggccctgcctgtcgaagagaaatgtatcgtgctttccgaaatcctgcatctcttccaatgccagagcggatccgcgaatctgaagctcattggcgggcccgcttctgccggaatcctgtatcttaacagcaatatttccgacgccggcgagatcctgattatcaaccagtctcccagcgggatctttgagaaacggattgatctgctccgcctgtga

SEQ ID NO: 4146 - RNA, 4023 nt, synthetic construct
  misc_feature 1..4023: note = Cas9 variant
  source 1..4023: mol_type = other RNA
atgaagaaagagtacaccatcggcctggacattgggacaaacagcgtgggatggtccgtcctcacggatgactatagactggtttctaagaaaatgaaggtggccggcaataccgaaaagagctccacaaagaagaacttctggggagtgcggctttttgatgaggggcagaccgctgaagcccgcagatctaaacggacagcgcgcagacggctggctcgcagacggcaacgcatcctcgagctgcagaagattttcgcccccgaaatccttaaaattgacgagcactttttcgccagactgaatgagagctttctcgtccctgatgaaaagaaacagtcccggcatccggtgttcgctaccatcaagcaggagaagtcttaccaccaaacatatcccaccatctaccatctgcgccaggccctggctgacagctccgaaaaagccgatattagactcgtttatctggcgatggcccaccttctgaagtaccggggccattttctcatcgagggggagctgaacacggaaaatagctctgtgaccgagacattccgccagtttctttccacctataaccagcaattcagcgaagctggagacaaacagacagagaagctggatgaagccgtcgactgctcttttgtgttcaccgagaaaatgtccaagacgaaaaaggctgagacactcctgaagtactttcctcacgagaaaagcaatggctacctgtctcagttcattaagctcatggttggcaaccaggggaatttcaaaaacgtgtttggactggaggaagaggccaaacttcaattctccaaagaaacctatgaggaggatctggaagaactcctggaaaagatcggcgacgattacattgacctttttgtccaggcgaagaatgtgtatgacgccgtgctgctcagcgagatcctgtccgattctaccaaaaacacaagagctaagctgagcgccgggatgattcggagatacgacgctcacaaagaagatctcgtcctgcttaagcgcttcgttaaagagaatctgcccaagaagtatcgggcctttttcggagacaactccgtgaatggctacgccgggtatatcgagggacatgctacccaggaagcgttttacaaattcgtgaagaaagagctcacaggcatcagaggcagcgaagtctttctgacgaagattgagcaagagaacttccttcgcaaacagcggacctttgataacggggtgatccctcaccagattcatctgtctgaactcagagccatcattgctaatcagaagaagcactaccccttcctgaaagaggaacaagagaagctggaatccctcctgacatttaaaatcccttattacgttggaccgcttgccaagaaacaggagaacagccccttcgcctggctgatccgcaagtctgaggagaaaattaagccttggaatctccccgaaatcgtggacatggaaggcagcgctgtccggttcattgagagaatgatcaacaccgatatgtatatgcctcacaataaggtgctgcccaaaaactccctgctttaccagaagttttctatttataatgaactcacaaaagttcgctaccaggacgagcgggggcaaatgaactatttcagctccatcgagaagaaagaaatctttcatgagctgttcgaaaagaatagaaaggtgaccaaaaaggatctgcaggagtttctctacctgaaatacgacattaagcacgccgaacttagcggaatcgagaaagcgttcaacgcttcttatacgacataccatgattttctgaccatgtccgagaataagcgcgaaatgaagcagtggctcgaggacccggaactggccagcatgttcgaggagattatcaaaaccctgacagtctttgaagaccgggagatgattaagaccagactttctcaccatgaagccacactcggcaaacacatcattaagaaactgacgaagaagcactataccgggtggggacggctgtccaaagagctcatccagggcatccgcgataagcaaagcaacaaaacaattctggactaccttatcaatgatgacgatttccctcatcacagaaaccggaattttatgcagctgattaacgacgattccctctctttcaagaaagaaatcaagaaagctcagatgattaccgacacagagaacctggaggaaatcgtgaaggagctgaccggcagccccgccatcaagaaagggattcttcagtccctcaagatcgtcgatgaaattgtgggaatcatgggctatgagcctgctaatattgttgtggaaatggccagagagaaccaaacgaccgggcgcggactgaaatctagccggcccagactgaaggcgctcgaggaatccctgaaagactttggcagccagcttctgaaggagtaccccacagataattcttccctccagaaggaccgcctgtatctgtactaccttcaaaacgggagagatatgtataccggcgcccctctcgacatccatcggctgagcgactacgatatcgaccacattatcccgcgctctttcacaaccgataattccattgacaacaaagtcctggtgagctctaaggaaaatagactcaaaaaggatgacgttcccagcgagaaagtggtcaagaagatgcggtccttctggtatgatctgtacagctctaaacttatctccaagcgcaaactggacaacctcacgaagattaaactgacagaagaggataaggctggatttatcaagagacagctggtggagacccggcagatcacaaaacacgtggccggcattcttcatcaccgcttcaataaggctgaagacaccaacgatcctatcagaaaagttcggattatcaccctcaagagcgccctggtctcccagtttcgcaatagattcgggatttataaagtgcgggagatcaacgaataccatcacgcgcatgacgcctatctgaatggagtggtcgctctcgccctgcttaagaagtacccccaactggctcctgagtttgtgtacggcgagtatctcaaattcaacgcccacaaggccaataaagctacagttaagaaagaattttactctaacattatgaagttctttgagagcgatacgcccgtgtgtgacgaaaacggggagatcttctgggacaaatccaagtctatcgcgcaggtcaagaaagtgattaatcaccatcacatgaacatcgttaagaaaaccgaaattcagaagggaggctttagcaaagagacagtggagccgaagaaggattcctctaaactgctgcctagaaagaataactgggaccccgccaaatatgggggccttggaagccctaatgtcgcttacaccgtggccttcacatatgaaaagggcaaagcccgcaagcggaccaacgctctggaggggatcacgattatggaaagagaggccttcgaacagtcccccgttctctttctgaagaataaaggatacgagcaagcggagatcgaaatgaagctccctaaatatgctctgttcgagcttgaaaacggccgcaagcggatggtggccagcaataaagaggcccagaaggctaactcttttctgctccccgaacatctggtcacactgctttaccacgccaagcagtacgatgagatctcccataaagagagcttcgactatgtgaatgaacaccacaaggagttttctgaagtgttcgcgagagtcctggagtttgctgggaaatacaccctcgccgagaagaacattgaaaaactggagaagatctataaagaaaatcagaccgatgacctcgccaagctggcttccagcttcgttaaccttatgcaatttaatgccatgggagctccggccgatttcaagtttttcgacgtgacaattcctcgcaaacggtacacctctctgacagagatctggcagtccacgattatccatcagagcatcaccggcctgtatgaaacacgcattagaatggggaagtga

SEQ ID NO: 4147 - RNA, 4023 nt, synthetic construct
  misc_feature 1..4023: note = Cas9 variant
  source 1..4023: mol_type = other RNA
atggagcaggaatactatctgggcctcgacatggggaccggaagcgtgggctgggccgtcacagattccgagtaccacgttctgagaaagcatgggaaagctctttggggagtgcggctgttcgaatctgccagcacggcggaggaacgcagaatgtttcggacctcccgcagacggctcgaccgcagaaactggcggatcgagattctgcaagagatcttcgctgaagagatttctaagaaagatcccggctttttccttcgcatgaaggaaagcaaatattaccctgaggacaagagagatatcaatgggaactgcccggagctgccctatgccctctttgtggacgatgacttcacagataaggactaccacaaaaagtttcctaccatttatcatctgcggaaaatgctgatgaatacagaagagacccccgatatccgcctcgtctacctggccatccaccatatgatgaagcacagaggacacttccttctgtccggcgacattaacgaaatcaaagagtttggcacaaccttctctaagctcctggaaaatattaagaacgaggagcttgattggaatctggaactcgggaaagaggaatacgctgtggttgagagcatcctgaaggacaacatgctgaatcggtccacgaaaaagacccgcctcattaaagccctgaaggctaaaagcatctgtgaaaaggccgtgcttaacctgctcgcgggaggcacagtcaagctgtctgacatttttgggcttgaggagctgaatgaaaccgagagacctaaaatctccttcgccgataacggatatgacgattacatcggcgaagtggagaatgaactcggggagcagttttatattatcgagacagctaaggccgtttacgactgggctgtgctggtcgaaattctgggaaaatataccagcatctctgaggccaaggtggcgacgtacgaaaaacataagtccgatctccagttcctgaagaaaattgtgcggaagtatcttacaaaagaggagtacaaggacatcttcgtcagcacctctgataaactgaagaactactccgcctatatcggcatgacaaagattaatggcaaaaaggttgacctccagagcaaaagatgctccaaggaagagttttacgatttcatcaaaaagaacgtgctgaagaaacttgaagggcaacccgagtatgaatacctgaaggaggagctcgaacgcgagacctttctgcctaaacaggtgaaccgggacaatggagtcattccgtatcagatccacctgtacgaactcaagaaaattctgggcaaccttagagataagatcgacctgatcaaagagaatgaagacaagctcgtgcagctgttcgagtttcgcattccctattacgttgggcctctgaacaagatcgatgacggaaaagagggcaagttcacctgggctgtgcggaaatctaatgaaaagatttacccctggaactttgagaatgtcgtggatatcgaagccagcgctgagaaattcattagacgcatgacaaacaagtgtacgtatcttatgggggaagacgttctccctaaggattccctgctgtacagcaaatatatggtgctcaatgagctgaacaatgtcaaacttgacggagagaaactgtctgtggaactcaagcaacggctgtacaccgatgtcttttgcaaatatagaaaggtgacagttaagaaaatcaagaactacctgaaatgtgagggcattatctccggcaatgtggaaatcaccgggattgacggagatttcaaggccagccttacagcctatcatgactttaaagagatcctcaccggcacggagctggctaagaaggataaagaaaacattatcacaaatattgtcctgttcggggacgataagaaactcctgaagaaacgccttaaccggctgtacccccagatcaccccgaaccagctcaagaaaatctgcgcgctgtcttacaccggatggggcagatttagcaagaagttcctggaggaaattacagcccctgaccccgagaccggggaagtgtggaatatcattacagctctttgggagtccaacaataacctcatgcagctgctgtctaatgagtatcgcttcatggaagaggttgaaacgtacaacatgggcaaacaaaccaagacactcagctatgagaccgtggaaaatatgtacgtctcccctagcgtgaaacggcagatctggcagacactgaagattgtgaaagagcttgagaaggttatgaaggaatctcccaaaagagtctttatcgagatggcccgggaaaagcaagagtccaaacgcaccgaaagcagaaagaaacagctgatcgacctctataaggcctgtaagaacgaggagaaagattgggtgaaggaactgggagaccaggaggaacagaaactgcggtctgataaactttacctctattacacgcaaaagggcagatgcatgtactccggggaggtgattgagctgaaggacctgtgggataataccaagtatgacatcgatcacatttacccccagagcaaaacaatggacgattccctcaacaatcgcgtcctggtgaagaaaaagtataacgctatcaaatctgacaagtaccctcttaatgaaaacattcggcacgagagaaagggattctggaaaagcctgctcgatggcgggtttatctccaaggaaaaatatgagcgcctgatcagaaataccgaactgtctccggaggagcttgccggattcattgaacggcagatcgttgagacacgccagagcaccaaggcggtggctgaaattctgaaacaagtctttcccgagtccgaaatcgtgtacgttaaggccggcacggtgagcagattccggaaagactttgagctcctgaaggtccgcgaggtgaacgatctccatcacgccaaggacgcttatctgaacattgttgtgggcaattcttactacgtcaaattcacaaagaacgcctcctggtttatcaaagaaaatcctgggagaacctataaccttaagaaaatgttcacaagcggatggaatattgagcggaacggcgaagtggcttgggaggtggggaagaagggaaccatcgtcaccgttaaacagatcatgaataagaacaatattctggtgacacgccaggtgcatgaagccaaaggcgggctctttgaccagcaaatcatgaagaaaggaaagggccagattgcgatcaaggagacggatgagagactggcctctattgaaaaatacgggggctataacaaggctgccggagcttacttcatgctggtcgagtccaaagacaagaaaggcaagaccatccggacaatcgaatttattcccctttatctgaagaataaaatcgagagcgatgagtctattgccctcaacttcctggaaaaggggcgcggactcaaagagcctaagatcctgcttaaaaagattaaaatcgacaccctgttcgatgtggacggctttaagatgtggctcagcgggagaacaggagatcggctgctgttcaagtgtgcgaatcagcttatcctggacgaaaagattatcgttaccatgaagaaaattgtgaagtttatccagagacgccaagagaaccgggaactcaaactgtccgataaggacggcattgataatgaggtcctcatggagatctacaacacgttcgtggacaagctggaaaacacagtttatcgcattagacttagcgagcaggccaaaaccctgatcgaccggcagaaggaatttgagagactgtctctcgaagataaatccagcaccctgttcgagatccttcacatttttcaatgccagtcctctgctgccaatctgaagatgatcgggggccccggaaaagctggcattctcgtgatgaacaataacatcagcaagtgtaataagatttccatcatcaaccagtctccgacagggattttcgagaatgaaatcgacctgctcaaaatttga

SEQ ID NO: 4148 - RNA, 4026 nt, synthetic construct
  misc_feature 1..4026: note = Cas9 variant
  source 1..4026: mol_type = other RNA
atgagattccagaacaagaaaaccggcgactactttgtggggctggatatcggaacaaatagcgtcggctgggccgttacgaacgagaagtatgaaattctccgggctaaaaatcaccgcatgtgggggtccagactgttcgaggaaggaaagaccgccgaggaacggcgcgtgcatagagcgggccggcgcagacttaaccggcgcaatgacagactgatgatcctcgaggatctgtttgctgaggaaatttctaaagtggacaaggccttctaccaacggcttcacgagagccagtatcgccaggaacataagacagtctccgggccctactttctgttcaacgataaagagtttaccgacgaggattatcacatcgactaccctacaatttatcatctcagagtggccctgatgaaggctccggccaaagatgttcggctcctgttcctggctatccaccacatcattaagtaccgcggaaattttcttcatgaaggcgagaccttcaaaacaaccggcgggctgacggacatcctccagagagtgctggcctgcaacgaattttctggacttaagcaacacattgatgacaccgcgctggtcaagctcctgacaaataaaggcatcacccggagcgatattgccaagcagatctccgagctggctacagacaaactctacagaaagcaggccaaggctttcgcctctctggtgcttgggctgaaggcgaacctcgacgatctgtttaatgaacccgagtataaagagcttgacagcgaaattcgcaccgttgagttctccggaaaggaatactgggaggaacgggataagtatgagccttacctgggcgagagcctcttcgccctggacgggtgtaaaacgctgtatgatacactcctgctttctaacatcaagcccgacggaaaatacctgtccgaagctaaggtggagacctttgaaaaacatcacgagcacctcgaaagcctgaaggatcttctgaagtctaataaagccctctataacagagtcctgcgcgacgatgagaagaatctgaacaactacatcacatacattggcaaatccgagttcaataagcggtgcagcagagacgaattttataaattcctcaagcagaccatcaaggatatttctgacaacgagaataaagctgaaatcgtgcaactgatggagcttgactcctttctgcctctcctgcgcgtgcgggagaacggcgtcattccctaccagatccatgaagaggaactggagcagatccttaatgttagctccgaaaagtatcctttcctcaacaaagccgatgggtctggatttaccattgcccagaagatcctgaaactgctcacattccgcattccgtactttgtgggccccctgaatcctgctcacaaggacagagataacgggttcgcgtgggtggtccggaaggcccccggaaaagtgtatccttggaattttgaggacaaggttgatatcagcgcttccgccacggccttcattgagaaccttaccaataaatgtacatacctgatcggcgaagacgtgctccccaagtatagcctggcttactctaaattttccctgcttaacgagctcaataacctgagatacgatgggaagccgctgagctatgaaaccaaacaatctttcatcaaggactgcttcgagaaggaacatcgcaaaatgacagagaagcggattagagagtttctcaaacacctgggaggcaccgatggcaagggggcccttacgggactggacgtcgatatcaaaagcgacctcaagtcctaccgggatatggtgcgcattctgggcgacgggttcgacgaaacaatggcggagagaatcattcggtatgttaccctgtttggagaagctaagaaagtgcttctctctaccctggagatcgagttcggcgatgacctgagcgatacacagaagaaacagattctcaagctgcaatacagagactgggggcgcctttccgccaccctgctcaaaggcatcaagggagtcgccggcgataatcctgaatgtagcatcctggagtgcatggaacagcagcccctgaaccttatggaggtgctctcttcccataacacatatctggctgccattgaagagtttaataaggagcggacggaacctaccgacatcgtcgattacaaactggtggacgatctctatattagccccgctgttaagagatctgtgtggcagacactgcgcatccttgacgagattaccaaactgagagggtccgtccccaagaaagtgttcgttgaagtggcccggacaaaccgcgcggagaagaagaaaaccgatagcagaaaggaacggctcctgcaactgtacaaaacgatcaaggacgagggacgcaattggaccgaggaaatcaaacagagagatgccggcgactttaactccaagaaacttttcctgtactatacacagcaggggcggtgtatgtactctggagagaagattaccagcatcggcgacctctttacatccaagtatgatattgaccacatctaccctcgctctgtcaccaaagataatagctgggacaacctggtgctcgtgaaggctgaactgaatagagagaaaaaggatatttatccgatcgaaaaagacacgcaagatcggtgcatctccctttggaagcagctgctcgagcaggggctgattagcgagcgcaagtacgaaagactggttcggacaacaccccttaccgccgacgagctggctgatttcgtcaacagacagctcgtggaaaccaatcaatctgtgaaagccgtcaccaacctgctcaagcgcctgtatcctgacacaacgatctgttacgtgaaagcggagaatgtttccgattttcggcaggaaagagagttcgtgaaacttcgcagcctgaacgcccaccatcacgctaaagacgcctacctcaatattgtcgtgggcaacgtttatcatgagaagtttaccaataacccccggaacttcatcaagaatgctagatctgacaaaaagcgcccttactccctgaaccacatgttcgattatctgcttcaggtgggaaataaagaaatttggaaccccaagacagacaataacctggtcaaaaagatgatgcggaataacgatgtgcaggttaccagaatgctcgtggagcaaacaggcgccctgtacgacgccaccatctataaggctagcgtcacgaaatctgaaagctacgtgccgctcaagtccagcgatgcgatcctgtctgacgtgaaaaagtatgggggatttacatccattaaaatcgcctactacagcattttccgcttttataagaaaaattccgaggagttcgaaacccacatcatttctatccctgtccttaaagctggcaccctgaacagcaaggaggattacgttgcctatggggaagagattatgaataaacagaagtttgaccgggtggaactggtgtacaaaaagctctgcatgaactccctggtcagaatcaatggagtgatgtattaccttggcgggaaaacaaacaattctctgtatatcgatagcgccatttccctcgttctgcccgacaacatcgctaagaagattaaagccgtggagaagtacatcgcgcgggtcgctgagaacggcaattacaaacctcagcccgatcaagtgtctcctgaatttaacatgattatctataaggccctcaccgagaaaatgaagcagcccgccttcgttggactgaagacaaatcgcgaaaacgagcttgaaaaagagacgaccatcacagctttcattgccatgaccctgatcgagcagtgtaagatgctgatggaaattctcaatctgcttacacagcaaaagaccacgtacgcgctgaagccgatcggcgtgagcgcttccagaagcaccctcgggatgaacattacaggactgtctgagtttaccatcatcacacagtccgtcaccggcctccaggaaaaagagattcggatcatttga

SEQ ID NO: 4149 - RNA, 4026 nt, synthetic construct
  misc_feature 1..4026: note = Cas9 variant
  source 1..4026: mol_type = other RNA
atgtggggcagcagactgttcgaggaagcctccaccgctcaggaccggcgcgagcacagatctaaccggcgcagactcgaacggcgcaagtacagactggatcttctggaggaactctttgtggaggagatcaataaaattgaccccgagttctttatccggctgcgcgagagcaagttccattttgaagatagatcccttaaaaacacattcattctgtttaatgacaagatggaagggggatataacgataaagtcttcttttctaagtaccctacgatctatcacctccggagcgccctgattaatggcaacaaggaggacgttcgcgcggtgttcctggctatccataatatcctcaaaaacagagggcactttctgcttgccggaaatgatattaacatctccctgtctctcaatgacaccctgacagatcttttcgaatacctgaagattcatctcggcatcgaggtggaatttgagaacaaactgaaggacattgaaaagatcgccctggataagaatctcagcaagtccgacaaacaaaagaaaattgtccagctgcttgagaccgattataagaaacagctggctgacgtgttcaagctcagcctggggcttacagccaacatggagaatatcttcggaaaagaaaacgagcagggcctggaatttatcaacgctgagaataagattaagaaaatccaattcgactcttcctacgaagagaacattgccgagtttgatcagttctatggcgaatactttgagatcattgacatctgcaagaaaatctacgatgcgattagcctctctcagatcctggttgacgggaagggactgtccgaaagcaaagtgctctcttatgagaagcacaaggaagatctgaaacttctgaagaaagtcctcaagaatattgacaaagcctacgataacaagggcgaggaccggctggtgtataaggttcttaaagaggataaggacaaagggaccaattacgtgaactattccaagctgagcaataacggaacagctaccacgaaagaagagttctacaagtttctctccaagaatctggatctgaaaaagttcggcaaactcaacaaggaagacatcgagaccctggactatattaattctgagatccttctggggcgctttctcccgctgcagaaagaaaagatcaacggagtcattccctaccaactgcagatgaaagagcttacacagatcctcaataacgccagcaagtacctgcctttcctgaataagattgaagatggcatgaccgtgaaagacaagatcatttccctcatcaaatttcggattccctattacgtgggccctctgaacgagtataacagaatcgaaaatgggaacggattcgcttggatcgagaagaaaaagaatgagaagatttttccctggaacttcaatgatgtcgttgacatcgaaaagagcgccgagaagttcattaacaatcttacaaacaaatgtacctacatcaaggaagagacggtgctgcctaaaaattctattatctattccaagtttatggtgctcaacgaactgaataacctgcagtacggcaataagaaacttgatatcgagctcaagatgaaaatgtatacagacctgttcctggagaagaaagataacagaaaggtcaccgaaaagcgcattctcgagtactttcggatcaatgggattaacgacggaaaagaaaagctgacaggccttaacaatgagatccacgcggatatgaaaagctacagagacatgtgcgaaattatgggggagaacttcaatatcaacgtggccgagaatatcattaactggatcaccgtttttcatggagaaaagaaaattctgatcaataagattaaaaacgtgtatggcaagatgttcaatgatgagcaaatctctaagctcagcaaactgaactactccgactggggccgcctgtctaagaaacttctcaccgatatcaagtgttatattgacgctgacgggatcaattttccggtcagcattctggaagccatggaggtgtccaacaaaaatctgatggagctcctgagcaacaagtacgaatttatctcttgcattgatgacatcaataacaagtattttggagatcgggacatttccgctagcgagcttatcgatgaactgtacgtttctcccgccgtgaaaagaggcatctggcagtccgtccgcattctcgaggaaatcgtgagcattatcgggcacaaccctaagaaaattttcatcgagatgacacggcataatgaggaaaaggtccagaaatcctctagacgccacaacctggaggaactgtataaggccatccggaaggaccccgagtacgtggaacttattaaagagtttgatagcacgaccgacacagattccttcaagatcaaaaagctctacctgtattttatgcaactgggaaaatgtgcttactctaaggagaagattgacttcgataaactcttcaccgacagctatgatatcgaccacatttaccctagatccaagacaaaagacgatagcatccataataacctggttcttgtgaaggcgaaatataatcgcgaaaagaccgacgtctaccccatcgatattaacatccagaagaatatgaactctttttggaatttcctgtatacgaaaaagtttattacagaggaaaaatacaagcggctcatcagaacctccgacctgaccgatgaggaactggccaaattcattagccggcagcttgtggagacatctcagtccaccaaggctacagccgaggttctgaaacaaatctacggcgacagcgatatttgctatgtgaaggccgaaaacgtctctgactttcgctacgggagctccagacagaaggataaaaatgacatccagaaactcttcgtgaaatgtcgggaggtgaaccactttcatcacgctaaggatgcctatctgaatatcgttgtcggcaacgtgtacgacgtgaaattcacgaagaatccggtcaactttattaagaaaaataagatgggaaacaaaagcaactattctctcaatcatatgttctgctttgacgtggaaagaaacggctacaaggcgtgggattccagcgagaccatcaaaacagttgggcgcatgatgaagtccaatgacgtgcggattaccaagcacgtccaccctacaagaggagagctgtatgatgctaccatctacaaagccaagattgccaaaacgggctcttacatgccccttaagagctccaaaaacacccctctgtctgacgtgacaaagtatgggggatacaccaagatcaaaatcgcttattacagcgtttataagtacaaattctccgataagaatctcattaaaacagaaatccgcctgattcccatccccatttatctgtctaagaacgacgatgacatcaaagagtacgtgaagaattaccttaacgatagagtcaatagcaagctgatcgacttcaccaaaatttatgataagctctacgtgaactccctgatcaaaattaatggctatctctactatcttgggggcaagacgaacgaccgggtttggatcgataatgccgtgagcattgtcctggacgacaaaatcgaatacctgattaagcgcatctctaacgatatcaagtatggatacgagattaatgtgtccgacgatgaactcatggacatctacgagagcctggctgagaaagccaacaagaaaattttctataacagactgtctgatttcgaaaagatcttttccaatatggacgtgaaaaagaagttcgtcaaacttgagaagaacgataaatgtcgggttctgctccagctgctcaatgtgctgacagacagccaaaccacatacaaacttgaaatggtgggcctgaaacattctcgctccaacattgggatgaagatcagcaatctggaggaatttaaggtcatcaactccagcattaccggactctattctaatgagatcgatattctgaacatctga

SEQ ID NO: 4150 - RNA, 4026 nt, synthetic construct
  misc_feature 1..4026: note = Cas9 variant
  source 1..4026: mol_type = other RNA
atggagaaggactactatctgggcctcgatatggggagcggatccgccggctgggctgtgaccgacgatcagtaccacgtcctgagagcccatgggaaagcgatgtggggaacacggcttttcgaatctgctaacacggccgaggaacgcagaatcaatcggaccgcccgcagacggctgaagcgcagaaaccaacggattgagtggctccaggaaatctttgctgaggagattaatacaaaagacagcggcttctttcgcagaatgaaggaatcccggtattgggccgaggataaacgcgacgaaaacgggtcttgccccgagatgccttacagcctgttcatcgatgaggactttaccgataaggaatatcacgagaagttcccgacaatttaccatcttagaaaatatctgatgaccacagaagagacccccggaatccggctcgtttacctggcttttcaccatatgatgaagcaccgcggccacttcctgctcaatggcaacatcgaagagattagaaaatttcggaagacgttcgaccagtttctggaggtggtgagaaatgaagagatggggttcgccggagaaatcgaggaagagacctacaaaaagattgagatgacacttaaggatgtcaacctgacccgctccgcgaaaaagacaaccctcatcaaatctctgaaggtgacgcgggttgaagagaaagaacttctggccctcattagcggctgtacagtgaagctgtccaatatctttaacgacaaaagcctggatgagaccgaaagacctaagatttctttcgctgacgccgggttcgacgattatgaggctgagatccagtccaatctcaacgaaaagtactatatcattgagagcgccaaagcggtctacgactgggccgctctggccgatatccttggagaatattcttgcatttccgaggctaaggtggccctgtacgagaaacatcacaaggacctcaaacgcctgaaggatcttgttcggaataacatcagctctgaagtgtataaggagatttttgtcgacgtgtccggcaaatacaagaattactgtgcctatatcgggacaaccaacatcaacggaaagaagaaagatttcgaaggcaagaagtgcaccaaagaggacttttacgcttatctgaagaaaagcgtgattgaatgtatcaatgattccgagaagacagactggctcaaactggagctggaaaagggcaacttcctccccaagcaactgacgggggaaaattctgtcattccttaccaggttcatctttatgagctgaacgcgatcattaccaatctccaggagagaatccccctgcttaaacgcgatggagaaaagatccggcagatttttacattcagagtgccttactatgtgggcccgctgaacgggatcagcattgacggcaaaaagaccaattgggtcaaacgcaaggagggagtgatctacccctggaacttttccgacattgttgatgaggaaagctctgccgagtccttcatccggagaatgacaaataaatgcacctacctcattcacgaagacgtgctgcctaagtatagcctgctctactctcgctttgaggtcctgaacgaacttaataacgtgcggctgaatggggagctcctgagcgttgagctgaagcagaaaatctatgaagatgtgttccagagataccggaaggtcacgcagaaacgccttaagagatatctcctgacagagggaatcattgacgaaaacaccgtgatcaccggcctggatggcgactttaaagggtccctcacagcttaccacgatttcaaggagaagctgaccggacttaatctgacagagcgggaaaaagaggaaattatcctcaacattacgctgtttggcgacgccagatctctgcttcgcaagcggatcgggaaaatctgtagccagctctccgataagcaaaaagagaacctgagcaagctgtcttatcagggatggggcagactctccaagaaattcctgaatgggattgccatcagcgtccagggcgaagaggagtggaccattatcaaggctctttgggaaacacaagacaacctgtctcagctcatgggagccaaatacaccttccgcaatgcggtggagaaggaaaacggcgagctggaaaatagagagatttcctacgagacagttaaagatctgagcatctccccctctgtgaagcggcaggtctggcagagccttctcatcgtgaaggaaatttgcaaaatccaaaagaaacctccccgcaaggtttttgtggaggtcgctaaagaaaagaccaactccgggagaacggagtctcggaaaaagcgcctgcaggacttctataagtactgtagcaaatatgaaaaggagctgtacgatgagtccattcagaataaactcgaaaagtgcagcgagtctgacctgagatccgacaaactttttctgtattacatgcagatgggacggtgtatgtataccggccaaccgatcgatttcgacgaactctggaacaatcagaagtacgatattgaccatatctaccctcagagcaagacaatggatgactctatcgataaccgcgtgctggtgaaaagaatttccaatcaggagaagaccgacgtttatcccatccgggccgatattcgcgagaaaagacgggggttttggaaggaactgaaaaacgtcggacttatcagcgaggaaaagtacaagagactcacacgcgccaccgagttcgaacctgctgagctggccggctttatttctcggcaactggtggagaatagacagacgacaaaagtggtcgctagcatcctcaagcaggccatgcccgacaccgaaattgtgtatgttaaagcgcgcacagtgtccgagttccggcacaagtttaacttcatcaaagtcagagaaatgaatgattttcatcacgccaaggacgcttacctgaacgtggttgtggggaacacctatcttgtcaagttcaccaaaagccccgtgaattttatcgagaaccattctaatcgctcctacaacctgaagaaaatgttcacagatggccgggttgaaagaaatggagagattgcctggatcagcggcgagaacgggacgattggaaccgtgcgcaatatcatgaagaaaaacaatattctcgtcacacggagagctcacgaagccaccggcgggttctttgaccagcaactgatgaagaagggaaaaggccaggtgcctgtgaaggggtccgacgagcggctgcttgatatcgaaaaatatggcggatacaacaaggagacaggcgcgtacttcgtcctggttgaatctgacgagaaaaaggggaaaaagaagcgcaccatcgagtatgtgccgattagactcaaaaagcagctggaaaataaccggaaagccctcgagaattacctgtgcgaacaacgcggacttacgaaccccgtggtcctgatcgataagattaaaatggacagcctctttagagtggatggcttctttatgtggctgtccgggcggacaggaaatcagctgcttttcaagtgcgctaaccagctggttctctctaccgaggacgaggccaccctgaagaaaatcgtgaagtttgtcaacagacgcaaagaaaataaggagattaaaatctatgaaagcgataagctcaacgaggaaatgctgaatcggctttacaacacattcctgtataagctccaaaattccatctacggcaacagactgggggagcaagctaaaaccctgtctagcaagaaagagaattttgacaaacttcagattgaagagaaatgtctggtgctctatgaaatcctgcacatgttccagtgccagtccgccacaagcgatctccaactgattgagggccctggaaaggccggcacgcttcgcctgaactctaatatcaccaagtacaaaaacattaatatcattaaccagtcccccacagggatctacgaacaggttatcgacctgcagaagatttga

SEQ ID NO: 4151 - RNA, 4026 nt, synthetic construct
  misc_feature 1..4026: note = Cas9 variant
  source 1..4026: mol_type = other RNA
atgggcaaggggtactatgtgggactggacatgggcaccgggagcgtcggatgggccgttacagatgagtcctaccagatcctcagacggcacggcaaagctatgtggggagtgcgcctgttcgaatctgccaagacggcggaggaaagacggatgtttcgcaccggaagacggcgccttgacagacggggctggcgcattgagatcctgcaagaaattttcgctgaggagatcagcagagtggatcccggctttttcctccggatgaaagaatccaagtattaccctgaggacaaacgcgatattcaggggaactgcccggaactgccctatacactttttgtcgacaagaccttcacagataaggactttcataaaaagtaccctaccatctatcacctgagaaaaatgctcatggagacagaggatacccccgacatgcggctggtgtacctggccctccatcacatgatgaagcatcgcggacacttcctgctttctggcgatatcagccaggttacggaatttaaaaataccttcaaccagtttattgagaatatcagaaacgaagagatggacttcgaaattgagctggatgagtccgccgtgcaaatgatcgaagagacactcaaggacaagaatctgacccggtctgctaaaaagagcaaacttgtcaaggggctgaacgccaaaaatgtgagagacaaggcttttctcacactgctgtccggaggcaccgttaaactcagcgatctgttcgggatggaagaacttaacgaaggagagcgccctaagatttctttcgccgacaatggctacgaggaatatgcggccgtggtcgagatggaactgggcgagctctactatatcgtggaatccgctaaggccgtgtacgattgggctattctgagcgacatccttgggggatctacgtccgtcagcgatgccaaagttcgggcgtatgagaagcacaaagccgacctgaagtacctcaaagctgtggtgaaggagtattttcccaaggaagtctacaacgccgtgttcgttgagtcttccgataaactgaataactaccctgcttatatcggcatgacaaagaaaaatgggaagaaagtgagcctggaaggaaagagatgttcccgcgaggagtttatggacttcctcaagaaaaacattgtcgtgaagctgccggatgaagaggccaaaatgtaccttcagtctgaactggagaaggacagctttctccccaaacaggttaataaggataacggcgtgatcccttatcaggtccataagtacgaactgaaaaagattcttgacaacctgggggacaaaatccccttcctcaaggagaatgccgagaaaattgaaaagctgttttccttccggatcccttattacgtgggacccctgagaaccggcaacggcgagaatagcaaatttgcttgggcggaacgcaagtctacagagaagatctatccgtggaacttcgaaaatgtcattgatgtggagcaatccgccgagaactttatccggagaatgaccaataaatgcacctacctcattggggaagacgttctgcctaaggatagccttctgtactctaaattcatggtgctcaacgagctgaataacctgcgccttgacggacagaagatcagcgtcgaactcaaacagaagatttatcgggatgtgttttgtagatcccgcaaggttacacagaaaaagctgaaatcttacctgatccgggagggcatcgctgggaagaatgtggaactcacgggaattgacggcgatttcaaagggagcctgaccgcctatcacgacttcaaggagaaacttatcgatgtcgagctgacacaaaaggaaaaggaggaaattatcctcaacattgtgctgtttggcgacgataaaaagctgcttaaacagagactcaagaagaaattcccccagctgaccgagaagcaaatcaatacagtgaccgccctgtcctacaaaggatggggccggctcagcaagaaactgcttgaggaagttacggtccctgctcccgagacaggggaagtgtggaacattatcaccgccctgtgggagaccaatgacaactttatgcagctcctgtctaaggaatatcagttctccgatcgcatcgaggagtttaacgaagagaaagcggaccccgaagtgagctaccagacaattgaggacctgtatgtctctcctgctgtgaagagacaaatctggcagacccttcagattatccaggaaattgagaaggttatgggagagaaaccgaagcgggtgttcgtcgaaatggccagagagaaacaagaaaataagcgcacagagtcccggaaaaagacgctcagcgatctgtacaccaagtgcaaaaaggaagaacccgagtggatcgaagccctgtgtacatccctcgagaaacatgaggagcaccagctgagatctgacaaactttacctgtattacacccagaagggccgctgcatgtatagcggggagcctatcgatctcgaagacctgtgggataacacaaagtacgacattgatcacatctatccccagtccaagaccatggacgattctctgaaaaatagagtgcttgttaagaaagagtacaacgctaagaaaagcgacacgtatcctattgccgctgatatccaaaagaagatgatgcccttttggaaatccctcctgaccggaggcttcattccgaaggaaaaatacgaccggctggtgcgcaataaccctctcgatgccaatgagctggcggggtttatcgaaagacagatcgtcgagacacggcagagcaccaaggccgtggctgagattcttaaaaagatcctgcccgacacagaaattgtttacgtgaaggccaaaaccgtctctaagttccgccaggactttgatttcatcaaagtgagagacatgaacgatctccatcacgctaaggacgcctatctgaatattgtggtcggcaacgtttactttgtgaaattcacgaagaatgcggcctggttcgtgaaagagaaccctggacggacatataatctggaaaagatgtttatctgggatgtcgctcgcgacggcgagatcgcctggaaggctgggaaatccggaagcattgtgcaagttagagccatgatggaaaagaaccatatccttgtgacccggcgctcttacgaggtcaaaggcgggctgttcgatcagcagattctcaagaaaggaaagggccaagtgcccgttaaggagtccgacgaaagactgcgggatatcgggaaatatggcggatacaataaggccgctggcgtgtattttatgctcgtcagctctaaagacaagaaagggaaggagcagagaacaattgagttcgtgcctatctacctgaaggatcgcgttgagaaagacatggaaagcgcgcggaactaccttatggaggagagaggactgcgcgaacccaagattctcatcaaaaagatcaaaattgacaccctgtttaaggtggatggcttctatatgtggctgtccgggcggaccagcaaccagcttatctttaagggagccaatcagctgattctctctaaagaggacatgaagacactgaaaaaggtcgtgaaatacatccaaagacagaaggaagataaaaacgtgaagatttccatgcgcgacggcatcacggaggaggaactcctgaaactttatgagaccttcctggataagatccggcacagcatttacggggctagactctcctctcaggaaaagacactggtcaatggcaaagagaagtttatcgacctgagcgttgaagccaaatgtcaggtgctttatgagattctgcatctcttccaatgccagtccggagccgctaacctgaagatgatcggcgggccggcctctgcggggattctcgtgatgaataacaatatcagcaagtgtaaaaacatctccattgtcaatcagtctcctaccggcatctacgagaaggaaattgatctgcttcgcgtgtga

SEQ ID NO: 4152 - RNA, 4026 nt, synthetic construct
  misc_feature 1..4026: note = Cas9 variant
  source 1..4026: mol_type = other RNA
atgacccagaaggtgatcccctacaacattggcctggacatcgggacaaatagcgtcggatgggccgttacggataacgagaataaactcctgcacattaagggccataacgggatcggagtgagacttttcaaagaaggccaatccgctgccgagcggtgcgggtttcgcaccacaagacggcgcctgtctagacggaagtggcgcctcagactgcttaatgaaattttcgcggacaaaatcgctaaggtggatcctagctttttcgcccggctgaagcagtccaacgtctctccgaaagaccccaataagaccatgtttggaaacatcctcttcgataatggcaacctgaatgacaaatcctttcacgatgagtataagacaatttaccatctgcgccagtccatcattgaccaccctgaaaagaagttcgatatcagactcatttatctggccatgcatcacatcattaagtaccggggccactttcttaaccaggctaatgtgcaagacttcaaagggggaaagatcgatctggaggagtcttttaaagacctcaacagcatcttcgaaaatcagggccgcgatctgagacttgttaccgaggacgccaacaagtatgtgaaagaactgtccgacaacagcaagacacggaatgatcgccagaaagagctctctaaggtcctgtacattcccatcgacaagaactccgataaaaataacaagaaagtgaccacggagattatcaaggctattctggggatgaaagccaagtttgacgttatcttcggaatcgatgcggaaaatgccaaggagtggagcctcaccttcaactctgacgattttgacgataaaattgaaggcctgtccgctcagatgacagacgaggccggggaaatccttctgattctcaaggagctgtatttcgctcttaatctgagcgatatcctcaacaattctgtgaccgacaaaaacgccaagacactgtccgaggcgatgattaatagatacgacgatcataaagaacaactgaccatgctcaagcaggtcatcgacaacagcgataagaaacacgccaaggctctgaaagccgcttactccgcctatatcgacggagagaataacaagaaaatttcttttgaagatcttcggaagagaatccagaagaatctggacaacagcgagacgtccaaaaagattaacgatctcctggaacatgactacttccttcctaaacagcgcagcaaggagaatggcgccatcccccaccaactgcagcagcaagagctcgataaaattatcgaatctcagaagcactattacccttttctggctgagctgaacccgaatgaaaaacggtccagacaggcgaagtataagctcgacgagctggtggccttccgcgtgccctactatgtcggccctatggttaaagctacagaaaacaatcagagcaacaatgggaagtttgcctggatgattaaaaacgataatatctctgacaaacttaaaaaggaggagatcaccccctggaacttcgataagaaagtggaccggacagaaaccgccaccaagtttattacaagaatgacgaccacagacacctacctgatcggagagcctgtgctccccaaaaatagcctgctgtaccaaaagttcgtcgtgcttaacgaactcaataacctgaaaattaataagcagccgatcacacctgagcagaagcagtatgtttacgagcatgtgatgaaacaaaccaagcgcgtctccctgaaaaagattgctgatgccctcgtgatcaaaggcgactatccctacgcgcctgaaatcacggggacaaccgatcagaagaacatgaacaatggactgtctacctatattgaccttgctaagatctttggcgatgagctggacgatattgaccggaaagaagatttcgagaagatcattgaatggagcacaatctttgaggaccagcacatcttcgccctcaaactgaaggagattaaatggctgaccgaagatcagagaaagcaagttgtgaaacttcgctaccaggggtggggaaagctctccaagaaactgctggccgacctcgtcgatgacaacggccagcggatcattgacctgctttgggatagcaagcaggacttcatgcaaatcgtgaatcagaactcttttaaacaggctattgccgagcataatggcgctcacctggaagagaaggatctcaaagacatcatcaacaatctgtatacaagcccccaaaacaagaaggccattagacaggtcatcctggtggttgatgacattatccgcgcggtggggtacgaacccgtcaatattatgatggagttcgcccgggaggatagcaaagaccatagacttacgaactctcggtcccgccagctcgaaaaggtgtacaaagatatcaccaatagctggtttgacgatgacaacgttaaggacgagctgaaagataagattaaggacaaagctaagttcacagatagactgtatctctactttacccagggaggcaaagacctgtatacaggggaacctcttgatatcgacaatctgtccaactaccaaatcgatcacattctcccgcagtctttcatcctggacaatagcctggataaccgggtgcttacctccaagattaacaatcagatcaaaaaggacaacctccccggagagtttttcggctctaagatgcacaatttttggaaacatctgaaggaactgcacctcattagcaacaaaaagtattacaatctgacgcttacccctaactccatcagcaaattcaataaccaggggagatttatcaatcgccaactggtcgagacaagacaggtgattaagctcgccgctgagatcctgcataaccggtattctgaagagaatggcaccaacattgtgacagttaaggccaatctgacccaccacatgcgcgaaaaattcaacttttacaagaatagaaacgtcaatgattaccatcacgcgttcgacgcctatcttgctgccttcgtgggaaactggctgctccagcagtaccccaaactgaagccttattttgtgtacggcgatttcgctaaaacggagatcgacaacctcaagtcctttaatctgatttataaattcgagcaagcccatcagcttaacgaagaggacgggaagatcgccaaggatacagacgctctgctcggatacatgaaaaatgtctatcactttaagaaaatgctggtgaccaaggaactggagacaaaccatggcaatcttttcaaacagaccctgtaccccagccacgggaagatgaagaacctcatcaatccgaaagaaaaccggtcttccgatatttacggaggctatagctctgagaccggggcgtacgttagcctgatcaaggtgtttaaaaagaataaaattgagaacaagatcattaagatccctctcctgtatattgacaaacttaatcgccaagccaacgctaagcagttcatcagaaattttatcattaaagatgactccaacaagttcgatatcctgagcgagaaaatttttctcaatcagctggtcatcgacggcgatgaactgttcacaatttctggatccggcgaccggcagaacgcccaacagcttatcctgagcgataagtccctcaagatcctgtctaaaaacattaatgtgatcagcaagaacgacctcattatcattttcaatgaaatcatcgatgacatttgtaaatacatgaagatgtatgaggttgaaaactccgacgagacgaaagccaagtttgaggaaatcaatgataaagaccgcatgctgaagattatcaacgatcttctgctggggctccacgctaatgcctctagaagcaacctgtcctctattggacttagcccctccttcggccggtttttcagcgggaatgcgggaatcaagctgtctgagaacgctaaatttatttaccagtcccctaccggcctcttcagccgcaaggtgaaaatctctgacctgtga

SEQ ID NO: 4153 - RNA, 4032 nt, synthetic construct
  misc_feature 1..4032: note = Cas9 variant
  source 1..4032: mol_type = other RNA
atgacctactatctgggcctcgacatggggacaagctccgtgggatgggccgtcacggatgagaactacaatctgatccacagacatcggaaggacctttggggcattcgcgagttcgaggaagctaaaaccgccgttgagagacggacacagcgcatctctagacggcgcagacaacgggaagtggcgcgcattgggctgctcaaggattattttcacgacgagatccagaaagtggatcccaacttctaccagagactggacaatagcaagtattttcctgaggataaagaagaggtcgtgaagggaaagaacggcattttcgctgacgaaaattacaccgatcgggactattttgccgagtacccgacaatcttccatcttcgcagagagctgctcaactccaaagaaccccacgatgttcggctgctgtacctcgccctgcttaatatgtataagcatcgcgggcactttctgaacaccacactcggaaccgacggcgagaatagaaaactgtctgatgtgtaccgggacttcgtcgtgaagacggaagaggttcttggcctgacctttcctcaggaaacagacaacgggaaaatgcaagagatcatgtgcagcagagagttctcccgcaagcggaaggctgaactcctgtgtgccctgctcgagattgataaaaagcagaaacaacaggtggctctgatcgaatgcgtccttggactggacaagtctgtgaaacagatgtatggcaccgccgtgcccgatgactttgataagagcgtcaaagttaatttctccgacagctcttttgaggaaaaggtgtccgaggtggaggaactcctggatgaggaaaagtacgagcttattctgtgtatgaaagaactctatgacacagcggtcctgaaccagatcatgggggattgcaattacctgagcgaggccagagtgcaggagtatgaaaagcacaaagaggacctcaagctgcttaaacgcaccgttaagaagtacggaacggctgaagagtaccagttcctgttccggtcttccgagaaagccagctataacgcttacgtgcattctgtcaattccggcgaaaagattagacgcaacatggatgggcggagcagagacgacctctatacagtgctgaaaaagatgcttaaaaactaccctcaagaggatgccgactgtaagtatatcctggaagagattgaaaaggagcagtttctccccaaacagctggtttccgataatggagtgatccctaaccaaatccactacaaggagatgaaaaagattctggaaaatgcggagcagtatctccatttcctgcgcgaaaaagacgagtctggctacaccgtcgccgaacggatccttaagctgtttgctttccagattccgtactatatcggccccacaagcgagaagtccgggaaaaacggaggcaatgggtgggtggtcagaaaggagcagggacaagtgctcccttggaacattgaagagaaaatcgatatgaaggccaccagcgaaacctttatctctcgcatggttcggagatgcacatacctgtccgacgagatggtgctgcccaaagctagccttgaatatgagtctttctgtgtcctcaatgagctgaacaatctgcggattcgcggcgtgaagctccctatcacggttaaacaggatatttacaaggacctgtttgaaagagggaagcgggtgaccagaaaacagatcgtcaactatcttaagggagtgggcattctgcaggagggcgaagaggatgagctcacagggatgatggacaccttcaatagctccctggcctcttacggaaaatttaagagcatcctgggcgaaaagatccaagaggattcctgcaaacgcatggtggaacagattatcttctggtgtacaatttatggggacgccaagaaatttcttaaggagcagctcgaagagaaatacggagatgttctgacccgggagcagatcaagcgcattctgggcttcaaactcaaggactgggggaacctgagcaagaaatttcttgaactgaatggctgcgacagaaacacgggagaggtcatgtctctcatcagaatgctgtgggaatccgatgacaatctgatggagcttctcaaggatagctcttacacatatcgggctgaactggaggagcaacaggaaaaactgaccaagaccctcacagagatttgtcccgaagacctggagggctactatttctccgcgccggtgaaacgcatgatctggcagacccttctgatcctcaaggaagtggagaaggtcatgggggagcctcccaaaagagtgttcgttgaaatgacacgggagcacgatgaacgcagagagatgaaggacagccggggcaaaaagtttcaggagctgtacaaaaacattaaggatgaagaacacaactggaaagccgaaatcgaggacgctgaaaaggatggacgcattagatccaagaaaatgtatctgtaccttacgcaacgggggcgctgcatgtataccggaaatcctatcgacctcgaggagctgttcacaaccaagtacgatattgaccatatctaccccagacactttgtgaaagatgacaacctggacaataacctcgtcctggtggaaaaggagaaaaatgcccataagtctgatcagtatccccttggcgacgatatctacacagggcggctgagctggtggaaggaactccacagagagaaactgattaacgacgaaaagtataaacgcctgaccggccgggcccctttctccgatgagcagaaggctggatttatcgccagacaacttgttgagacgtctcagggcaccaaaggggtggcgagcattctgaaggaagtcctcccggagacaaccacaatcgtgtacgctaaggcccgcaatgtttccgacttccggaacaccaatgaactgctcaaagccagaagcgtgaacgattttcatcacgctcaggacgcctatctgaatattgtcgtgggaaacgtgtactatgtcaagttcacgaataacccccttaattttgttcgctctggcgaggggtacaacctggatggagtgttccggaaaaacgtgatcagaggccaggaaaatgcttggatcgtcaagcctgagaaaggggagaagatgacactcgaaaccgtgaagcgcgttatggccaaaaacacacccctgctgacccggctttcctttgagggcagaggaggcctggcgaatcaaaccctctacagcgccaaggaagctgccggggagggatatgtgcctctgaaatcttccgacagccggctccaggatgtcacaaagtacggcgggttcacgtctgtgaccacagcttattttattctggttgagcacgacatgaaaaagaagcgcgtgagaaccatcgaaagcgtccccattctttggaaagagcggatcgaaaaggagtccggacagctggaaatttactgccgcgaggccctcggcctggtgaacccggacatcagagttcggaaaatcctgattcagagccttgtgaagaaagatgggttctatatgcatctgtctggcaagacaggaaatagattcatcatgcgcaacgcggtcgagctctgtctgaaacaagaatggattaattactccaagaagctcgagaaagaaggctgcgacgagagcatcaccaaggagaaaaacgaggagctgtatgaaattcttaaggagaaacacatcaatgggatttaccggaagagacctaaccccatgggagaaaagctgcatatccgccaggagacgtttcggatgctgacactcgaagaacagaaaaaggtgctgctttccctgctcaatctgaccaaaatcggccctgtggaggccaacctcgaactgattggggagtctgctcacaccggaaagatgcttatcagcaaaaatattacagaagtcaaggagttctacctgatccaccagtccgttaccggcatttatgagaagcaagtgaacctgctcacagtgtga

SEQ ID NO: 4154 - RNA, 4032 nt, synthetic construct
  misc_feature 1..4032: note = Cas9 variant
  source 1..4032: mol_type = other RNA
atggccaccaagaaagagtacaacatcggcctggacattgggacaacgagcgtgggatggtccgtcgttgaaaccgataatcagaaggtgatgagaaaaggcaacaaggctctctggggagtgcggctgttcgaggaagccacaaccgcggagtctcgcagaatgcaacggagcacacgcagacggtatgaccgcagacgggaacgcatcaaacttctgcaggaggagttttccgaagagattaataaggtcgataagaacttctttcagaaactcaaggaatctaaatacgtggagaatgacaagatcaacaaaaagattgttctgaccaaggaggaaaaacaggagcttaaggattatcaaaataaatacaagacaatctatcacctgagagacgaactcatcaacaatcccgagaaaaaggatattcggctggtgtacctggctatccatcacattatcaaatatcgcgggaacttcctctaccagaatgccaactttaatattgacaacctggatatcaaggacaaacttaatgaactgttcagcattctctccaacaacatccaggagctggagatccctgaagattacattaatatcattgactttgatgagcttgaagccgacctgctcaaggacaccaagaacgatgtcaaagctctgctgatcgacaatctcacggagctgaccaacaagtctagcgccacagagttcggcaaacttatggtggggaataagggaaacattaataagctgctcatgctggagaccgataacaaaatcgagatctcctttagcggcacagactatgatgacaagtacgaagagtatcaggaagctcttggcgagaatattgaaatcctggatattctcaaacaaatctacgactgcattttcctgaagaaaatctttaaggggaacaagaatacctctatctccagcctgatggttaaatctttcgagcagcataagaaagatctcaactttctgaaggagcttttcaaagacaatagagaactgtataacgagattttccggacgaagaaggatctctgtctgtacgaaaaatatatcacaaataagattgactgcgacgagtttcgcaaagagatcaacaaacttctggaatccctcttcagcgatgagaacattaagcagaatctgctggacgaatacaacctcgaggtgaaggaaagaatcgagaatggaacctttctgccgcggattacaaccaccgataacggcaaatacccctatcagcttaataagtctgagctgatcaagatcattgaaaaccaagggaaatactatcctttcctcctgaataagctgaacgacaataaaacatacaagatcgtcaaacttctcgagtttcgcattccctattacgtgggacctctggtgtccgaaaagagaagcgagaactcctggctggaacggaagatcaataacgtcaaaattacgccctataatttcgatgacgttgtggataaggagaaaaccgccgagaagtttatcaaaagaatgatctctcactgtacatacctcctggacgaatacgcgcttgccaacaatagcattctgtattccgagttcaaggtgatgaacgaactcaagcagatccgcgtcaacgatcggaaactggagctgaagtttcagcaacagattcttgaagacttctttaaaaagaccagcggcacaatcaccgagagaaaattcaagaattacctcatttctacgggggagtattccatggaaggaggcaactttcgcatcacaggctacagcgctgatgggaagttcgccaataacatgcagtcttatgtggacttctttggagagaatggcatcttcgctgataccgactacaacctggaaaatgccgaggagattatcgaatggattaccatctttgaggacaaagatattctggaaaagaaagttcgggacaactatagcaagctcaatgagaaccagatcaaaaaggtgctggcgaaaaagtactccgggtggggatctcttagcaagaaactgctcaagacaaaatactataaggataaagccaccgaactgtacaagtccatcctggaccttatgtatgagacagataagaatttcatgcaaattatcaacgacgataaatacaattttcaggagatgattaagaaattcaacaataaggaagagaacaaaaagctcaactatagcatcgtcgaagaactggctacgtctcctgccaccaagagaggcatttaccaggctctgaaagtggttgaggaactcgtggactatatcgggtacgagccgaagaatatttccatcgaaatggcccgcagcgaggaagagaaagtccggaaggattctagaaaagactacatcaacaatctgtataagggatgcaaggattccattgaaaactacaaaaagctgaaacatgagcttgacagccacgagatcacatcccagcgcctctttctgtatttcattcaagaaggcaagtgtctgtacaccggcacaccccttaatatcgaggatattgaaaaccagtctctctatgagatcgaccacatcattcctcggagcctgatcaaagacgattccattgacaataaggccctggtgctcaaggagtgcaaccaggataaaaaggcttcttacgtcctgcccagcaaatttagaaattccaagcagaaaacctggtggaagcatcttaaagacaacgggctgatgagcgcgaagaagttccacaatctcatccgggaaaaatataacgaggaagatattaatggatttatcaaccgccaactggtggagacgagacagatcaccaagcatgttgccaatattctgaacaatctttacaaagacacaaacgtgatctacctgaaggctgatctctctcacaactatcgggaaaaatacgacctgttcaagtttagagatattaatgactatcaccatgcccacgatgcctacctcgctgccgtcctgggcgagtataaggagcgcttcatgaaacggaagatcaacttcgacatggtgaaagaacttaattccaagattgttgagatggacgaagggaaaagacgcaacctgagatttggatacgtgatcaatagcctcgatgagaacctgaatgacattgtcctgaagatctctgaaaaccttgtggataatgagaccggcgaggtgctgttcgacgcgcatgaatttaacaagcgggttgaggatacactctatcgcaatgacatcctgatttccagaaaaaccgaaatccggacggggcagttctacaaggagacaatttacaaaaagggcaaaggaaccatccctattaagtttggcatgcccacagatatctatgggggatacagcaacaccaatgctcgcaagctcatgctgatcgaatataacgagtctaaaatgaagattatcggccttccgatggccctggccgtcagaaataacgacgctgagattaacgattacatcaaaacccagattaatctcaagaaaaacagcacattcaagatcaaaaagtgttccatcccttttgaaacggagattatctataataaccaaaatgtgttcattaaggggtacagcatcggacacaaaaactgcgaaatttctaatgccatccagctgaagattgctaaagacaagatgaaacattggaagtatgccctgcagtaccttctgaacgataagaaacaatacatcgactttgcggagaagtatgtgaatgagatctacgatttcctcattaacctggacctctttcccctgttcaataaagaacttgacaagatcaaaaacaaggtcaatttcgaggatctggccctggaccagcagaagaaaattaccaaggaactctttaaaatgctgcactgtaactccgtgaatgctaaccttagcgagttcggcctgggggatcggatgggccgcctctccggatataacatcacagacggcattatcatctctaagagcgttaccgggattagagaatcccggtacgagttttga

SEQ ID NO: 4155 - RNA, 4035 nt, synthetic construct
  misc_feature 1..4035: note = Cas9 variant
  source 1..4035: mol_type = other RNA
atgagccagaacaataacaagatctacaatattggcctggacatcggggatgcctccgtgggatgggctgtcgttgacgagcactataacctcctgaaaagacatggcaagcacatgtgggggtctcggcttttcacccaagccaatacagcggtggaacgcagaagctcccggtctacgcgcagacggtacaacaaacgcagagagcggattcgcctgctcagagaaatcatggaggatatggtgctggacgtcgatcccacctttttcattcggcttgctaatgtgagctttctggaccaggaagataagaaagactatctcaaggagaactaccattccaattataacctgttcatcgataaggactttaatgataaaacatactatgacaagtaccctaccatctaccatctgcgcaaacacctctgcgagtctaaggaaaaagaggatccgagactgatttatcttgccctgcaccacatcgttaagtaccggggaaacttcctctatgaaggccagaagtttagcatggacgtgtccaatattgaggacaaaatgatcgatgtcctgcgccagttcaacgagattaatctttttgaatacgtggaggacagaaagaaaatcgatgaagttctgaacgtgctcaaggagcccctgagcaaaaagcataaagccgaaaaggctttcgccctgtttgacacaaccaaggataacaaagctgcctataaggagctctgtgcggccctggctgggaataaattcaacgtcacaaagatgcttaaagaggccgaactgcacgacgaggatgaaaaggacatttcttttaagttctccgatgctaccttcgacgatgcctttgtggagaaacaacctctcctgggagactgcgtggagttcatcgaccttctgcatgatatctacagctgggtcgaactccagaatattctgggctctgcgcacacgtccgagcccagcatctctgccgctatgattcagcggtatgaagaccacaagaacgatctgaaactcctgaaggacgttatcagaaaataccttcctaagaagtactttgaggtgttccgcgatgaaaaatccaagaaaaataactattgtaattacattaaccatcccagcaagacccctgtggacgagttttataaatacatcaagaagctgatcgaaaagattgatgacccggatgtcaagacaatcctcaataaaattgagctggagtccttcatgcttaagcagaactctcggaccaatggcgccgtgccctatcaaatgcagctggacgaactcaacaaaatcctggagaatcagagcgtttactattccgatctgaaggacaacgaagataaaattagaagcatcctcacatttcgcatcccttactacttcgggcccctgaatattaccaaggaccggcagtttgactggatcattaagaaagagggaaaggagaacgaaagaatccttccttggaacgctaatgagattgtggatgtcgacaaaacggccgatgagttcatcaagcgcatgcggaacttttgcacatatttccccgacgaaccggtgatggccaaaaattctctgaccgtttccaagtacgaagtgctcaacgagattaataagctgagaatcaacgatcacctgatcaaacgcgacatgaaggataaaatgcttcatacactctttatggaccacaagagcatttctgctaatgcgatgaaaaagtggctggtcaagaaccaatatttcagcaataccgatgacatcaaaattgagggcttccagaaggaaaacgcctgttccacctctctgacaccttggatcgattttacgaaaattttcgggaagatcaatgagagcaactacgactttatcgagaaaattatctatgatgtgaccgtcttcgaagacaagaagattctccggagacgcctgaaaaaggaatacgaccttgatgaggagaaaatcaagaaaattctgaagctcaaatattccggatggagccggctgtctaagaagctgctttccggcatcaaaacaaagtacaaagacagcaccagaacacccgaaaccgtgctcgaggttatggaacggacgaatatgaacctgatgcaagtgatcaatgatgagaagctggggtttaaaaagacaattgacgatgctaactctacctccgtcagcggaaagttctcctacgccgaagtgcaggagctcgccggctctcctgctatcaaacgcggcatttggcaggccctgcttatcgttgacgagattaagaaaatcatgaagcatgaacccgcgcacgtgtatatcgagtttgctagaaacgaagatgagaaagagcggaaggacagcttcgtcaatcagatgctgaagctctacaaagattatgactttgaagatgagaccgaaaaggaggccaacaaacacctgaagggggaagacgccaaatccaagattagatctgagcgcctgaaactttactatacacagatgggaaaatgcatgtacaccggcaagagcctcgacatcgatcggctggacacatatcaagtggatcatattgtgccccagtccctgctcaaagacgatagcatcgacaataaggttctggtcctttcttccgagaaccagagaaaactggatgacctcgtgattcctagctctatccgcaataagatgtacgggttctgggaaaagctgtttaacaataaaattatctccccgaagaaattctacagcctgatcaagacggagtttaacgaaaaagatcaggagagattcattaatcggcaaatcgtggaaacccgccagattacaaagcacgtcgctcagatcattgacaaccattatgagaataccaaagtggttacagtgagagccgatctttctcaccagttccgggagcgctaccacatctataagaacagagacatcaatgattttcatcacgctcatgacgcctacattgcgaccatcctcggaacgtatattggccaccggttcgaaagcctggacgccaagtacatctatggggagtacaaacgcatttttagaaaccaaaagaataaaggaaaggaaatgaaaaagaacaacgatggcttcatcctcaattccatgcggaacatctacgctgacaaggataccggcgagattgtctgggaccccaattatatcgatcgcattaaaaagtgtttttactataaagactgcttcgtgacaaagaaactggaagagaacaatgggacctttttcaacgttacagtgctgcctaatgataccaacagcgacaaggataatacgcttgccacagtccccgtgaacaagtacagatctaatgttaacaaatatggaggcttttccggggtgaatagcttcatcgtcgctattaagggcaaaaagaaaaagggaaagaaagtgatcgaggtgaacaagctgaccgggattcctctcatgtacaaaaatgccgacgaagagatcaagatcaactatctgaaacaggcggaagatctggaggaggtccagattggcaaggaaatccttaaaaatcagctgattgagaaggacggaggcctctactacatcgttgcccccacagaaattatcaacgctaagcaactgatcctcaacgagtcccagaccaaactggtgtgtgaaatttataaggccatgaaatacaagaattatgataaccttgactctgagaaaatcattgacctgtaccggctcctgatcaataagatggagctgtattacccggaatatagaaagcagcttgtgaaaaagtttgaggatcgctacgaacaactgaaagtcattagcatcgaggaaaagtgcaacatcattaaacagatcctcgctaccctgcattgtaattcctctattgggaagatcatgtacagcgacttcaagatttccacaacgatcggacggctcaacggcagaaccatttctctggatgacatcagcttcatcgccgagtcccctacagggatgtatagcaaaaagtacaaactttga

SEQ ID NO: 4156 - RNA, 4035 nt, synthetic construct
  misc_feature 1..4035: note = Cas9 variant
  source 1..4035: mol_type = other RNA
atgaagaaaaccaacccctacatcctgagcctcgacattggcacagcctccatcgggtatgcttgcatggatctggacttcaatattcttaagtaccacgataaagacgccatcggagtgctgacgtttgagggcgcggataccgctgccgaaagacgggggttccgcacatctagacggcgcaagaacagacggattaaacgcctcggactgcttcaggaggtcctggcccctctcgttaagaatccgaactattaccaactgctgaatctccataagtggaaaaacagcaatgaagactttaagcacagatccctgtctgaggtgcttaaaatcctgggcaagaaccccaaaacctatcctacaatctaccatctccagcaggatattcagaatcaccccgaaaagaagttcgagcctgagctgatctttcttgctctgtatcatctcgtgaaataccgggggcacttcctgtttaacaatctgagcttcgacaagggaaaaaccgtcgataacgaagcccaactctccgagctgcttgaacagtaccagtctattaatccctatgaggacagcatctccaacaaggatattaatgtgatcgttgacacactgaaagatgaccagctcacccgcaacgacaagagcaaagagctgaagagaaacgtgtctaagacgcacgctgaactttttaaaatgctggtcggcctcaagttcaaacaatccattctgtttgagaatatggaaaacgccgaggatatcaaggaaagcgcgaccggctctgacgccatctccctgagcgatgactactatgagaatctctctgagttcctgacagatgaacagcttaactttattgagtccgctaataccttcttcatggggatcatgctggaccggattctcaaaggagccacaagcatctccgctgccaaggtgcgcgattacaagatttttaaaaaccagctgaagatcatcaaagacattgtttatcagaataagtacgataaatatcatgagttctttgtgacctctaaggaggacatgagagcgtaccaagaaaaccctgatgccaagacgttcggcaaacttagcaagtttgaccagtacctgatccacccgaaagaccagtatgctaagctcatgaaagatctgaaggggattgtccccaagaaatacacagaggtgctgaatctcatcgacgagcaaaagttcctggtggtccagaacaccacagataatgcctccattccttatcagaacaatgtttttgaagctgagaacatccttcggaatcagcaaaaatactatcccgaaatcaccgaggaaatgattggaaaggtgatcaacctgattagcttccgcatcccttactatgtgggccccctcaccaacaaaaatgggcagtctgactttgcctggatgattagaaagtccgatgagcagacactgccgtggaacttcgacaaagtcatcgataagagcaagtctgccgagaaatttattcggagaatgacgagcaagtgtacctacctgcttgaagaggacgtgctccctaaacattccctgctgtaccaggaaatggaggttctcaatgagctgaacaatgtgcaacttcgcggagaaaacgagcccaagcaccggatccacagactggatcctaaagtcaagcagttcatctatcataatctctttcagaagaaaaagaacgtgacacacaaagacctgattaccctgcttcaaaattctgaacatcgcaacacactcaataagaccagcggccaaaaactgaaggttttcggcacgcagaacgattccaagttcgctagcaaactgtctacatacaatgacatgaaggcgatctttgggtccgtggagaacaaacggcagatgattgaagaactcgtcctgtggatcaccattttcgaggataaggccatccttaaacagaagatcggagaaaagtatcccaatattaccgagaaacaactgaaccagatcgtgaagctcaactacagcggctgggggagactgtctgaaaaactgcttacaaaggaggtcaatggacgctccctcattgacctgatgtatagcaccgaaaacaattttatggagatcattacagacaaaacgctgggcttcgattgctttatcaagaactccaataaagtgaagaacgctaagatctcttacaaagacgttgccgagctccggaccagccccgccctgaagaaagggatttggaatgctatcaagatggtgagagaaatttccgatcttttcggagcccctgagaaaatcattatcgaatttgcgacagaggaccaggtcaagggcaagcgccaaaaatctcggagcgaactgtgggatgacctcgtgaagaaaaacaatctgaagagaaacaaaaagttcaagggcctgtttgaggagcttaaggcttatccggatctcgacttctccaatcccaagctgtggctgtacatccaccagaacgggaaatgtatgtacaccaagaaacctattgatctcgaacgcctgatgagcgacacaaataaccagctttatgagatcgatcatattctgccccggacctttgttaaggacgattctatcaataacaaggtgctcgtcattcagtccgccaaccagaaaaagagcggagacaaaatgcctctggaaatcttcgacaatcacgtgctggtgcccttttggaagatgctttacgagaacgatctgatttcttccagcaaactctctaagctgatgaagaaagagttcaatgacctcgataaggaaggcttcatccagagacagctggttgagacgcggcagatcattagccacgtctccgactttcttaccgaagagtatccgagcacaaccgtggtgcctatgaaagccaacgtcgtgtctgaactgcgcagaaagttcgatatccccaaaattcggcaactcaatgactggcatcacgctgttgatgcctacctgaacgggtttgtgtatcaggctgccagagtcttctaccctaaggtgaatctgtttgagttcaactttaaatgggagaaggttcgcgaaaagtggcggcagcttggagagttcacagaaaataacaaaaagagagagtttttcctgtttaaacgcatggaaaattatgtgaacgagcatggcgaggggatgatctccaagctcattttcgacctggataatttcaaatttaactacagcagaaaggtcgaatccaccgagtctgcgttctacaagcagagcgccttttcccccaaaaatacgacagctcaatatgactctgataagaacaaaaccgccatctacaaggaaatgaaaaataagcggggcatcgtggttagctatacatacgtgaagaaagaccaggagctcattggatatggcgtcttcaacgaaaccgtgtttgagtacgtgaacaatgctgacgtcgatatgaacacccgcgccctgaagatcgttagaaaagcgttccctaaacttgacattaaaaaggcccagtatctgttttccatcaataagggggatgctctcctggtgaacggacaccccttcctgtttgtgtctgccaaagagcggattaatggcaagcaacttgagttcgacatcaacatgcagcgcagactgaaaaaggctctccggccgtacaataaaatgacagaacaggaaaaggtcggggtgtacaaccagtttgccgagaaagttgtgcaagagtatgaaaatagcctgggagccaagacgcgcaacgagaagctcgaactgatcagaaatcagttcaacgagtccgataaaagcaatgaagctcttattcagtgcatcctggaggtcctgaagatgaccaaagtgtctgcggagcggtccgttaagctcaaaattcgctggggcagccagacacctaacaccctgatcgacattaataacaaggccaagatcatgtacaactctattacagggcttaaacaaaccagactgaagtccatctataaactcgctgaaagcaagaatgagctgtga

SEQ ID NO: 4157 - RNA, 4035 nt, synthetic construct
  misc_feature 1..4035: note = Cas9 variant
  source 1..4035: mol_type = other RNA
atgaacaagaattactatatcggcctggacatggggaccaacagcgtgggatgggccgtcacagatcaggagtacaatctcattaaactgaagggcacgcacgcttggggagccagaatcttccaagaagcgaaagacaagaaagggacccgggctattcgctcctctagacggcgcatggatagacggaagtatcgcatccatcttctgaaccagctctttgcccaggagattcaggccatcgacagcacattctttatcagactggcttactccgcctattgggaagttgataagaaagacaagggcattgggcggaatatccttttcaaaaccaagcaagaggaatctcagttttacaaaaagtatcccacaatttggcatctgcgcaagagcctcctggagaaccagcctgatgctttctccgacctgagatacgtgtacctcgcctttcaccacatcatgaaatatcggggaaatttcctgcatgagggcgaaattaagaccaacgagcttcaggtgcaacagatcgaacagctgaatcagtttctcattaacaaatacaaggagatctatgataatgacgtcgaggaacgcacattcatcgcgaaccaccaaattgatgccctgaaagagatccttctgaataagaacaccaataaaacgaccaaggaaaaggagattaaaaagctctttgactacgctgattgcgaatctctggagccgtatatcagctgtttctccaaactggccgtgggcgggaagtttgacctcagcaaactgggatacgagggcaacattcagttctctgacccctccttcgaagagaaggctagcatccttcaggatgactttagactgatcgccattgcgaaggaaatgtatgatttcgttatcctcaacgacctgcttaaagatcaacctaatctgtctacagccatggtgcacgtctacgagacccatcggcaggacctcaagaaactgaaggatattatcattgacatcgatgctaacaaagggctgcagaataacgaccgctggtactttaaactcttcaaggataaaaatgcccccaagaactattccgcttttatccacaaaaatagcaaccagaagagaccttctattgacgagttcaatgacgagatcaaaaagattctgatcgagcatcggaacgatgtgtcccttgaaaagcaagacgatctgaaaatgctctttgagaaggttgaaaataaaacactgcttaagaccattgccatccagagcacgtccgtgattccccaccagctgcacctcgacgagctggaaaagatcatcgataacgcctctacaaagtaccctttcctgagcaatattagagacaaactcgtcctgctttttaccttccgcgtgccgtattactatggacccctgaacgataagtccccttacagcaatgtggagcggaagcagtttgctacagtcaccccctggaacttcgacgagatctttgatgaaaacaaaaccagagagaagttcatgaaaaagctcacaaataactgcacgtatctgtctggcgaaaccgttatgcctaaaaaggcgctggcctacgaggactaccttatttatgatcgcctcaatgtgctgctggtgaacggggagtacctctccctgcaagaaaaggagaaaatctatcattaccttattagccggcccaagacaaccctggaccagctcaaaaaggaactggctaaatggcacaatcagtctccgatcgatatcattttcagcaacatccatgaggaaattccttttgaggcctcctctcacgcccatctgatgaagtccttcgaccttgagaagcagaaagaagaactcgaaagatatatcacactggctaccatttacgccgacgataagaaaagcctgaaggagctcctgaaaaatgaaagccttctggacgagaaccaaaagaatgtcatcctcacgctgcccacaaagaaatgggcgcctctgtcttataaacttctccagaacatcgtgtacaccgatgactacggagttgtgcactccattctggatatcatgaaagagaccaatcagaactttcagatggtcctgcacaatgaacaatatcatttcaaggagctcattgaacaggagaaccagaaatttacacaagaaaagaccatcgaggacctgattgaggaaaaacttgagagcatcccctctctgacacagcgctccatccggcagacgctcctgattatcgatgacattatcaaggctagccaccagaaggtgcccgaaaagattttcatcgaggttaccagaaataacgatgacaagcgcaaaggccaagatggcaaccagctggcccgggacaaggagcttaatagatttctcacaaacctgctgaaagatgaaaaggccaatcagttctgtgacgtgtcccagctcctgaaggaccttgaggaagtcgataaagtgaagctgaaagggaagcatatttacctctattttaaacaactgggaatcgacctgtacaccggcaagaagatcgtccttaaccagctgctcacatctaccaaatatgatacggaccacattatccctcagagcctgattaaggatgactccctcgataatctggtgcttgttgagcgcgaagtgaacctgaaagtcaaggggaatcactacccggtgccctctcggatccaggacgagcagaaaaagctctggcatttcctgctgcaaaagaaagctattagcgagaagaaatatggaaaccttaccagaacatccaagatcaaactggaagaggttgaagattttgtggcccggcagatcaatgtcattaactacagcaatgtgatcattcgcgacatcctcaagctgaagtaccctcacaccgatattatcttctctaaatcccaatatcccagctttatcagaaagcatctcaaaattgtgaagaaccgggacgttaatgacgctcaccatgccgtcgatgcgtacctgaacgtggtgtctggcaatcttctgtccacaaccttcagcaaagcctatatcagaaagaaatacattcagatccaggacggggagaaggaaacgttcaacatggagacaattctcgagaactattttaagaataacgaaaatcagctgaaaatcaagaccaactgcctgcgccgggatgctcttattacattcaaagtcgactacttttctggagagttctatggccaaaccagactgcctaagggcaatgaaaacctcatccccatcaccctgaatgaggataacccgatgagcgacacatccaaatacgggggatacacgaatctcgcccaggcttatctgtttgccgtgagctaccaggaagatggcgagatgaagaaggcgattcttcgcgttccttatctgtacgacaccctgtataaaaacgattctgacaagctcctgtccaaagtgcttgataatcccaaggccacaaacatccagattctgagaaaaatccacctcaatcaaaagattcggttcaacgacgggatctacctgctctataccaatgagaaggatcgcaacaaatacaagatggcttaccagaattatatcgacaacgactacctgtattaccttcactgggccaacaaacatctggaggaactgctcgataatcaggaaaagcagacatttatttataacagcaaaaatgaccaattcgaggtctccaaggctaagaacaaagagatctttcagtacctgcttcagaagaccaaagccaaggtgtatgatacgtgtaattacattgttaaagccagagaaacaaacatcgagattttcgaacagctgaccctcaaggagcaaatcaccatgatcaatcagtggattaaaatgatgtctcgggactgcgaaaaggtgaagtttgatgctcgcttcacaaacttcagcaattgtctgctcagactgtccaacaatatcaaccctaaagactctattaccatcatttacgagagccccacaggactttttaagcacgaggtcaaaatctga

SEQ ID NO: 4158 - RNA, 4035 nt, synthetic construct
  misc_feature 1..4035: note = Cas9 variant
  source 1..4035: mol_type = other RNA
atgaagaaaaccaacccctacatcctgagcctcgacattggcacagcctccatcgggtatgcttgcatggatctggacttcaatattcttaagtaccacgataaagacgccatcggagtgctgacgtttgagggcgcggataccgctgccgaaagacgggggttccgcacatctagacggcgcaagaacagacggattaaacgcctcggactgcttcaggaggtcctggcccctctcgttaagaatccgaactattaccaactgctgaatctccataagtggaaaaacagcaatgaagactttaagcacagatccctgtctgaggtgcttaaaaccctgggcaagaaccccaaaacatatcctaccatctaccatctccagcaggatatccagaatcaccccgaaaagaagttcgagcctgagctgatttttcttgctctgtatcatctcgtgaaataccgggggcacttcctgtttaacaatctgagcttcgacaagggaaaaacagtcgataacgaagcccaactctccgagctgcttgaacagtaccagtctatcaatccctatgagggcagcatttttaacaaggacatcaaagtgattgttgataccctgaaggacgatcagctcacgcgcaatgacaaatccaaggagctgaagagaaacgtgagcaaaacccacgctgaacttttcaagatgctggtcggcctcaaatttaagcaatctatcctgttcgagaacatggaaaatgtggaggacattaaagaatccgccacagggagcgatgcgatctctctgtccgacgattactatgagaacctcagcgagtttctgaccgacgaacagcttaatttcatcgagtctgccaacacattctttatgggaattatgctggatcggatcctcaagggcgctacctccattagcgccgctaaggttcgcgactacaaaatcttcaagaatcagctgaaacttattaaggatatcgtgtatcagaacaaatacgacaagtatcatgaatttttcgtcacgtccaaggaggatatgagagcctaccaagaaaatcctgacgcgaaaacatttgggaagctgtctaaattcgatcagtacctcatccacccgaaggaccagtatgccaaactgatgaaggacctgaagggaattgtgcccaaaaagtacaccgaggtgctcaacctgatcgatgagcaaaaatttcttgtcgttcagaatacaaccgacaacgctagcattccttatcagaataacgtgttcgaagccgagaatatcctgcggaaccagcaaaagtactatcccgaaattaccgaggaaatgatcggcaaagtgatcaatctcatttcctttcgcatcccttactatgtcgggcccctgacaaacaagaacggacagagcgatttcgcttggatgattagaaaatctgacgagcaggccctgccgtggaattttgataaggtgatcgacaagtccaaaagcgccgagaagttcattcggagaatgacgtctaaatgtacctaccttctcgaagaggatgttctgcctaagcatagcctgctctaccaggaaatggaggtgctgaacgagcttaataacgtccaactgcgcggcgaaaatgagcccaaacaccggatccacagactcgaccctaaggtgaagcagtttatttatcataacctgttccagaaaaagaaaaatgttacacacaaggatctgatcacccttctccagaactccgaacatcgcaatacactgaacaaaacctctggccaaaagctgaaggtgttcgggacgcagaatgacagcaaatttgcttccaagctcagcacatacaacgatatgaaagcgatcttcggatctgtcgagaataagcggcagatgattgaggagctggtgctttgggtcaccatctttgaggacaaagccattctgaagcagaagatcggcgaaaaatatcccaacattaccgagaagcaactcaatcagatcgtgaaactgaactactccgggtggggaagactgagcgaaaaacttctcacaaaagaggttaacggccgctctctgatcgatctgatgtattccaccgaaaataacttcatggagattatcacagacaagacgctcgggtttgactgcttcattaaaaatagcaacaaggtgaagaatgctaaaatctcctacaaggatgtcgccgagctgcggacctctcccgcccttaaaaagggaatttggaacgctatcaaaatggtgagagaaatcagcaatctgtttggcgcccctgagaagattatcattgaatttgcgacagaggaccaggttaagggcaaacgccaaaagtcccggtctgaactctgggatgacctggtgaaaaagaacaatctgaaaagaaacaaggagtttaaggggcttttcgaggaaatcaaggcttatccggatctcgactttagcaatcccaagctgtggctgtacattcaccagaacggaaaatgtatgtacaccaagaaacctatcgatctcgagcgcctgctttccgacacaaataaccagctgtatgaaatcgatcatattctcccccggaccttcgtcaaggacgatagcatcaataacaaggtgctggtgattcagtctgccaaccagaaaaagtccggcgacaaaatgcctctggagatctttgataatcacgttcttgtccccttctggaagatgctgtacgagaacgacctcatttctagctccaaactgagcaagctcatgaagaaagagttcaatgacctggataaggaagggtttatccaaagacagcttgtggaaacgcggcagattatctctcacgtgagcgacttcctgaccgaggaatatccgtccacaaccgtcgtgcctatgaaagccaacgttgtgagcgagctccgcagaaagtttgatatccccaaaattcggcaactgaatgactggcatcacgctgtcgatgcctacctgaacggattcgtgtatcaggctgccagagttttctaccctaaggtgaatcttttcgagtttaacttcaaatgggaaaaggtccgcgagaagtggcggcagctgggcgaatttacagagaataacaaaaagagagagttctttctcttcaaacgcatggaaaattatgtgaacgagcatggggaaggcatgatctctaagctgattttcgacctcgataattttaaattcaactactccagaaaggttgagagcaccgaatccgcgttttacaagcagtctgccttcagccccaaaaatacgacagctcaatatgactccgataagaacaaaaccgccatctacaaggagatgaaaaataagcggggaattgtggtctcttatacatacgtgaagaaagaccaggaactgatcggctatggggtgtttaacgagaccgtcttcgagtacgttaacaatgctgatgtggacatgaacacccgcgcccttaagatcgtgagaaaagcgtttcctaagctggacattaaaaaggtccagtatctcttcagcatcaataagggagatacactgctggtgaacggccacccctttcttttcgtttccgcctacgaacggattaatgggaaacaactggagtttgacatcgctatgcagcgcaagattaaacaggccctctctccgtacaacaatatgacggaacaggagaaggtggagttctataaccaatttgctgaaaaagtcatcgaggagttcagaaatagcatcggactgcagtcccgggatcgcaaggtgaacctcattaaaaatctgttcaacaataccgaaaagagcaacgactctatgacacagtccatccttgaagttctgaagatgaccaaagtgagcgccgaaagatctaaggagctgaaaattcggtggaatggccagacacctaacacctttatcgatacgaagaacaatgccgaaattcaatacaaatccatcacagggctcaagaccaccaagcccaaaagcattttcaagctggctgagtctaaaaacgaactttga

SEQ ID NO: 4159 - RNA, 4038 nt, synthetic construct
  misc_feature 1..4038: note = Cas9 variant
  source 1..4038: mol_type = other RNA
atgaagaaaccctacagcatcggcctggacattgggaccaactccgtgggatgggccgtcgttacagatgactataaggtgcctgctaaaaagatgaaagtgctcggcaatacggataagtctcacatcaagaaaaacctgcttggggccctcctgttcgacagcggaaataccgcggaggatagacggctgaagcgcacagctagacggcgctacaccagacggcgcaaccggattctttatctgcaggaaatcttttccgaggaaatgggcaaagtcgacgattctttctttcatagactcgaggacagcttcctggtgacagaagataagcgcggggagagacacccgatttttggaaatctggaggaagaggttaaataccatgaaaacttccccaccatctatcacctccggcaatacctggccgacaatcctgagaagacagatcttcgcctggtgtatctcgccctggctcatatcattaagtttggcggccacttccttatcgaggggaaatttgacaccagaaacaatgatgtccagcggctgttccaggaatttctcgccgtgtacgacaacacgttcgaaaattcctctctgcaggaacaaaacgttcaggtggaggaaattctgaccgacaagatcagcaaatccgctaagaaagatcgcgtcctcaagctgtttcccaatgagaaaagcaacggaagattcgccgagttccttaagctgattgtgggcaatcaggcggactttaagaaacacttcgaactcgaggaaaaggcccctctgcagttttctaaagatatctacgaggaggagcttgaggtgctgctcgctcaaattggggacaactatgccgaactgttcctgtccgctaagaaactctacgatagcatcctgctttctggaatcctgacagtcaccgacgtttccacaaaggctcccctcagcgcgtctatgattcagcggtataacgagcatcagatggatctggcccagcttaagcaatttatcagacagaaactgtccgacaagtacaatgaagtgttcagcgatgtgtccaaagacggctatgctgggtacattgatggaaagaccaaccaggaggccttttataaatacctcaagggcctgctgaataagatcgaaggctctgggtacttcctcgacaaaattgagcgcgaggactttctgcggaagcaaagaacgttcgataacggaagcatccctcaccagatccatcttcaggaaatgcgcgctattatccggagacaggccgagttttatccgttcctggccgacaatcaagatcgcattgaaaagatcctcacatttcggattccctactatgtcggccctctggctagagggaagtccgacttcgcgtggctgagccgcaaatctgccgataagatcaccccctggaacttcgacgagatcgtggataaggagtccagcgttgaagcctttattaatcggatgacaaactacgacctttatctccctaatcagaaagtgctgcccaagcactctctgctctacgagaaattcaccgtctataacgaactgaccaaggtgaaatacaagacagagcagggaaaaacggcctttttcgatgccaatatgaagcaggaaatctttgacggcgttttcaaggtgtacagaaaagtcaccaaggataaacttatggactttctggagaaggagttcgatgaatttcgcattgtggacctcacagggctggacaaagagaacaaggctttcaatgccagctatggaacctaccacgatctgcggaagatccttgacaaagattttctcgacaactccaagaatgagaaaattctggaagatatcgtcctgacactcaccctgttcgaagacagagagatgattcggaagcgccttaaaaactattctgatctgctcacgaaggagcaactgaagaaactggaaagacggcattacacaggctggggcagacttagcgcggagctcatccacgggatccgcaacaaggaatcccggaaaaccattctggactatctgatcgatgacggaaatagcaacagaaattttatgcagctcattaacgatgacgctctgtctttcaaggaggaaatcgccaaagcccaggtgattggcgagaccgataatcttaaccaggttgtgtccgacatcgctgggagcccggccatcaagaagggcattctgcaatctctcaaaatcgtcgacgagctggtgaagattatgggacatcagcctgaaaatatcgttgtggagatggctcgcgaaaaccagttcacaaatcaggggagacggaactcccaacagcgcctgaaaggccttaccgatagcattaaggagtttggatcccagatcctcaaagagcaccccgtcgaaaattctcaactgcagaacgacagactgttcctctactatctgcagaatggccgggatatgtacacaggggaggaacttgacatcgattacctgagccagtatgacattgatcatatcattcctcaagcctttatcaaggacaactccattgataatcgcgtgctcacgtctagcaaagagaacagaggaaagtccgacgatgtgcccagcaagaacgttgtccggaaaatgaagtcttactggtccaaactgctgagcgcgaaacttatcacccagcgcaaattcgacaatctgacaaaggccgaaagaggcgggctcaccgacgatgacaaggctggatttatcaaacggcagctggtggagacacgccagattaccaagcacgtggccagaatcctcgatgagcggttccacacggaaaccgacgagaacaataaaaagattagacaagtcaaaatcgtgacactgaagtctaaccttgtttccaattttcgcaaggagttcgaactgtataaagtgcgggaaattaacgattaccatcacgctcatgacgcctatctcaatgcggtcatcggcaaggccctgctgggggtgtacccccagcttgagcctgagtttgtttatggcgattacccgcacttccacggacataaagaaaacaaggctaccgccaaaaagtttttctacagcaatattatgaacttctttaagaaagacgatgtgagaacagacaagaatggcgagatcatctggaaaaaggatgaacacatttctaacatcaaaaaggtcctgagctatccccaggtgaatattgttaagaaagtggaggaacagaccgggggattctccaaggagagcatcctccctaaaggcaactctgacaagctgattccccgcaaaacgaagaaattttactgggatacaaagaagtatgggggattcgactcccctatcgtcgcttacagcatcctcgtgattgccgacatcgagaaaggcaagtccaaaaagctgaaaaccgtgaaggcccttgtcggggttacaattatggaaaagatgacctttgagcgggatcccgtggctttcctggaaagaaaaggctatcgcaatgtgcaagaggagaacatcattaagctcccgaaatactctctgtttaagctggaaaacggacggaaaagacttctggcgagcgcccgcgagctccagaagggcaatgaaatcgtcctgcctaaccatctcgggaccctgctttatcacgctaagaatatccataaagtggacgagcccaagcacctggattacgttgacaaacacaaggatgagttcaaagaactgctcgacgtggtctccaacttttctaagaagtacacactggccgagggaaatcttgagaaaattaaggaactgtatgcccagaacaatggcgaagatctcaaagagctggctagctccttcatcaacctcctgacgtttaccgccattggggcgcctgctacattcaagtttttcgacaaaaatatcgatcggaagagatacacctctacaaccgaaattcttaacgccacgctgatccatcaaagcattacaggactgtatgagacccggatcgacctctccaaactgggcggggattga

SEQ ID NO: 4160 - RNA, 4038 nt, synthetic construct
  misc_feature 1..4038: note = Cas9 variant
  source 1..4038: mol_type = other RNA
atggagaactacaatatcggcctggacattgggaccacaagcgtgggatgggccgtcgttaacgatgctacgaataaggtgatgagaaaaggcgggaaggccctctggggagtgcggctgttcgaccccgcggtcaccgctgaagatcgcagagccaaacggggcacacgcagacggtatgaccgcagacgggagcgcatcaaacttctgcaggatgaatttaaagacgagattaacaaggtggattccaatttctttctcaagctggaagagtctaaatacaccagcaaggacatcaaaaacaagacagttcttatttccatggaggaagagaaagccatcaagaagtataatcaagaataccctaccatctatcacctgagacagaaactcatgaactctaatgagcagatggatattcggctggtgtacctggctatccatcacattatcaagtatcgcgggaacttcatttacgagggaaatagcttttccgtcaacaatctcaacatcgacaataaactgaaggaaattttcctttctctgagcgaggatgtggacgaactcgatatctccgaggaatgcatcaacaacattaattacaaacagctggccaacatctttaatgagcaaagcaagaacgaccttaaagttaagctgacatctgagctcacctcctatagcctgaataagaacttcatttctgaattttgtaaactgatcattggcaataagttctccgctaaaaagctctttaacctggagacggacaatgatgtgagcctttctttcgacggcaccgattttgaagacaaagccggggatctggagtccctcctgaacgactaccttgaagtcctggagcagctcaaggagctgtatgatatggtgttcctgaagaaaatcttcggaggcagcaaggaaacaaccatctccgggctcatggtggagagatacaatcagcataaaaaggacctgaaacttctgaaggatacattttctagcgaccggaagatttataacaaaatcttccgctccaagaaagatattaaggacgacaaagatatgtgcctctacgacctgtatatccacaataaacttgaaaccacggattttctgaaggagattaaaaagtacgtcaacacagacaatttcatcatcaccgatgaagactttctcaaaagactggagaacaacgaggttctgccgcggattacaagcaaggaaaatggaaaatacccctatcagctcaacaaggatgagctggtgtctatcattgaacatcaaggcaaacactaccctttccttctgaataagaccgacgatgggatctataagctcgtgagactgctggagtttcgcattccctacttcgtcggacctcttgtgtccaaagacatgagcgagaacgcgtggatgctccggaatgaaggcatgcagggcgttcacatcaccccctataactttaagaaagtgattaatctggataagacagccgagatcttcatcaaaagaatgatttctcattgtacgtacctgctcgacgaagaggctctgcctaacaatagcatcctttattccgaatttaaggtcctgaacgagctcaagcagattaaagtgaatggggagcacctgaccaaggatgaacagcataaaatcattgaggaactgttcatgaagacatctggaaccatcacagagaacaaatttcgcgagttccttctcaataccctggactacaacttctacgaaaatgagctgaagatcacgggctatagcgccgactgcaagtttgctaacaacatgcaatcctacattgatttctttggggaaaatggaatcttcgagggcacaagctataacaccaatgacgccgaaaagattatcgagtggattaccatctttgatgacaaggatatcctcaaacggaaggttgaaaacgagtacccggagctgaaatctaatcaggtgaagaacattcttaataagaaatattccgggtggggaagactgagccgcaagctcctgctggaccttcgggtcctcgataaagaaacagacatccccaagtctattatggatctgatgtacgagaccgacgaaaacttcatgcagatcattaataacgataaatataattttcaaaagctgatcgcgaaagagaacaagatcgagaatacatccaacgacctcagctacgatgtggtcgaaaatctggccacgtcccctgctaccaagagaggcatttaccaggcccttaaagtggttaaggagatcacaacctatatgggctacgaacccaaaaacattatggtggagatggctcgcggggacgaaaagaaaatccggaaggacgatagaaagaaatatctgcagaagctctacgacaacattaaagatgaggtcgactctaattataagaacctgaaaaaggagctggccaaggaagagaaaatcgatacagacaaactttacctctattacctgcaggaaggaaagtgtctgtactgcggcaagcctattaatgtggatgacctcaacaccaaaaatagcctgtatgagatcgatcacatccttccccgcacgctgattaaggacaactcctgggataatcgggttctcgtgtgtagagggtgcaaccaaaagaaagccgcttctctggtcctgccgaaggagttccggaatgactacaccaaaagcatctggattcgccttaagaacaataaactgatgtccaacaagaagttttataatctcacaagaaaaagctactctgaagaggacatcaagggattcattaaccggcagctggtggaaaccagacagatcacaaaacacgtggcgaatatcctcaactgtttttatcctaagaccaaaattgtttacctgaaggccaatatctcccatagctatcgcgataaatacgaccttttcaagtttcgggatattaacgactaccaccatgctcacgatgcctatctggccgctacgctcggctcttaccaggagaagtatctgcattacgacctggattataacaaaatcaatgagttcaacgaaaaacttattaagaatgaagactacaagagactgcactatgggatcgtcgtgaactccctcgatgaggagttccaaagcgcctttgcggaaatcgctccccgcctgattaatgaggaaacaggcgagctcctgttcaacgccaaaaagtttaatgaccttgtggaggataccctgtacagaaacgacatcctcatttctcggaagacagaaatccgcaccggaaaactgtacaaggagaccatttataaaagaggcaaggggaatatcaaaattaaggaaaacatgcctacagagacgtacggaggctatagcaatatggaaacctcctacctgacacttgtcaagtatgggaacaaaaccaagctgatcggaatccccatgagcattgccaataacaaagatgtgaaggttaaactcgacttcatcaaggagcacctggacctcaagtctctggataatattgtgatccttaaagacaacattccctacgatgtctccatcaactataagaatcaggacgtgtacgttaaaggctacagcacagctaacaagaattgcgagctgtccaacgcccatcagctgaaaatcaagaaagatatgatgaagaagtgtaaatatgtgctcaataaggtctacaaaaacaagtatgacgatattaccaatatggacatcgaaaacgctattacgtttatcaattacctgttcgagattaaaatcgaatttcctcttttctctaaggagatcacaaagattcaggataacatcaatctgaccgaatgcagctttgagcaactcgccaacattatcaaacagctgctcattatctatcactgcaattccaagaacgggaatctgaaagagttcggcctttctgaccggattggacgcctgagcggcgcgaacgtgaccgggggagattttatcttcacatccgttaccggcctgaaggaaaagacagcctcttacgacggggagtga

SEQ ID NO: 4161 - RNA, 4038 nt, synthetic construct
  misc_feature 1..4038: note = Cas9 variant
  source 1..4038: mol_type = other RNA
atggtggagaagtacggcatcgggctggacattggaaccagcacactcggctggacgtccgtcgatgaaaacgggaaaatccagagactgaagggacaaaccgcccttggcacacggctgttcaatgaggggcagaccgctgaagaacgcagaggatttcggacaacccgcagacggattcagcgcagacggtggcgcctcagactgcttcgggaaatcttcgacgagcccattggctctgttgatgccggctttttcgcgcgccagaaaatgagctccctgtctcctcaagacgatagatttgaggacacatatcggcttttcaacaatcagaccgataaggcttttcacgacgaatacccgacgacctatcatctgcgccaggccctgatgaacagcgatagacagttcgacatccgggagatctacctcgccattcaccatatcgtgaaatatagagggaattttctgcgctccggaaagcccgctgatttcaagacaggcaaacttgacctgaaggaaaaatttgaggagattaacgccgattggcaaaccctcatctctgaagacgctcctcagctgcccgtggacgatcttacaaccattaaggccgtcctggtggacgggagccggtccagaagcgatcgccagcggggactcgttaaactgtggatggcgaatgagacggtggaaaagaactggaagcctgtcatgacagagctggccaaagctatcctcggcctgaagaccaaactttacctgctcacagggctggaccttcccaaggaagatcagaaagcctggaccttctctctggacaccctcgaggatcaccaaggagacattgattcctttttcgacgatcatgctcagcagctgatcgacagactggccgagctccgcgcgatgatccaactgacagaaattatccctagcggccttaatttctctcagtccatggtgcagcggtatgaggcccacagaagccacctggaaatgtacaagcagtacgctctcgaccaaacggatccgaaacgcaccaaggccctgcgggctgcctataacgcctacattgaccagcatgagatcgctgatgacttttatacagcggttaagagagtgaccaaagatgaccagtctgaaacagccgaggagattaatcgccttatcggcctggaacagttcatgcccaagcaacggaccaaagagaacggggtcatcccttaccaggtgcaccagcaggaactcgatcaaattatcgctcatcagaagaaatattacccctttctgggaacggagaatcctgtgattgaccacagagaatcccagccctatatgctggatgagctcgtcagcttccgggttccgtactacgtgggccctatggtggccgccaaccccgagctgaagacaaccgaaaatccttttgcttggatgatccgcaaggcccagggggagattaccccctggaacttcgacgaaaaagtcgatagaaagggatccgcgacagcttttatcgagcggatgaaaaccacagacacgtatcttctgggcgaggatgtgctcccccaacagtctctgctgtaccagagattcatggttcttaacgaactcaataacatccgcattgacgacgagctgctgaccacaaatcaaaagcagtgggtgtttgatcgggtcttcaaagggaagggaaccatcagcgccaagcacctccaggacgccctgaaacatcacggcgaaacagatggccttcctaagatttccgggctggctgacccgaccaaatttaacagcgccctcacgtcttatagagatttccagaagtggctgcccaatgacatcgatcgcaaagacagaaccgctgatattgagacaatcattaactggtccaccgtgtttgaagacacacatatcttcgttgagaagctgaaggagatcgaatggcttaccgccgatcaacggcgcagaattgcgagcaatcggtaccgcggatggggcagactctctaaacatctgctgacggagatcaaggacgaacaggggctcagcattatggatcagctgtggcggacacagcacaacttcatgcaaatcgtgcacgagcctgactatgccaaacagattgaagctgccaataccgtcggaatggctaagcaggacatcggcacagtgatcaacgatctttacacctctccccagaataaaaaggccattcgccaagtcctggcggtggttaaagacatccagaacgcccaccatggggtggctccttcctggatttttatggaggccgctagaggcgccgatcagaatccccaacggagccgccagagacagcggcagctccaagacctgtatgccaagaccgctgcggatctggtcgacacagaggtgcagcaggaacttacggataagatcaaagacaaggccaacttcaccgatagactcatgctgtactttctgcagaatggacaagacatgtactccaaagagaagctcaacattgatcgcctgagcgaatatgacatcgaccacatccttccgcaggctctgattaaagatgactctctcgataaccgggttctggtgcatcagtccatcaatagaaacaagagcgacacattcgcctctgagaagtacggcgccaaaatgcagggggcttggcaccaatggcgcgccgcgggactgatttccgctcggaagctcagaaatctcgaaatgcgccctgatgagatcagcaaatatgccaccggctttattcggagacagctggtcgagacacgccaggtgatcaagctggtgaccgaaatcctctcccaccagtacaaccccgaggaaacgaaactggtttctgtcaaggccgggcttagccatgagctgcggagagaggctggactccctaagctgcgggacctgaatgattatcaccatgccattgacgcgtaccttgctgcccgcatcggcacatatctgctcaaaagatacccccggctggaacgcttctttgtgtacgggcaattccagacctccagactcgatctgcggagatttaacttcattcacgaccttgtgaagtctaaacagggcgtcatcgtggatagcgacaccggagagattctgtgggatcgccaaaaggacatcgactatattaaacatctcatgggcctgaagcatctgcttgttacacacgaagtgtacgattccgccgctgagatgtatgcccagaccatctttaaggctagcgacaatgattctaaagtcctgatccctacaaagaacgaccggcccacggccatttacgggggatataccaaaagacgcaatggctacctcgcgatcctgaagattacagagaaaaaggccgagacctatcgggtggttggggtgccgacactctacatgtcccagctggctaccgccagaagccactctgtcgaggctgaaaaagcccttctgaagtccctcatggcccctgagatcctgagcgaatctaaggtggttagcttcgaggtggtcgtgtcccacgtgcatctgaaccagcttgtccgcgatacggtttttggacccgctcactacttcggcctggggcccttccggtatgtgagaaattttcatcaactcgtgctgcctttcaaagaccaggaaattctcgtcaagcgcaccccgacagatgaggagctgaacaccgtgtttgaagacatctgctggcaggttgagaattacttcgcggtgtttgatatcaacggcttcagaaatgcccttaaaaagagcattgacaaatttgaacagctgcccatcgagaacgtcttcaaggataagaaactggtgacacaaggaaagaaagaagttctcgcttttgtgatgcagggcctgcacgccaacgcctcttatcggaatcttaaggtctccctggggattaaaacccctctcggacagctgcagctcacaaagttcatgctgagccgcgacgctgagcttatcgatgagtcccccaccggcctgtttagacggattcgcagactgaaggacctctga

SEQ ID NO: 4162 - RNA, 4038 nt, synthetic construct
  misc_feature 1..4038: note = Cas9 variant
  source 1..4038: mol_type = other RNA
atgggcaacaagctgagaaatgtggacgattactatctcgggctggacatcggaaccgagagcgtcggctgggccgttacagataaatactatgtgattcccaagttcaaagggaacgctatgtggggagtgcacctttttgacgaaggcgagacgtccgtcaagcggcgcgggttcagatctgcccggcgcagaacccagcggaaacgcgaaagactggcgctcctggaggctctttttgatgaagagatctgcaagaaggactgtacattctttcggcgcctgcatgagagcgatctctggcctgaagacaaatccggagatgacaagtacgccgtgttcgccgatgagaattataccgacaaagattttcacaaggaatacccgacaatttatcatctgagatacgagctgatcaaaaacaaggagccccacgacgttaagctcgtgttcctggctctccatcacattatcaaaaatcggggccactttctgttcgactctctcagctccgccgaagattttaactctgcttacgagaccatgtgcagctatctgtccgacaatgaaatccaacttaactgtagcgatattgagcagttcaaggccatcctgaaagaccgcagacagggcaagattgaaaagacaaagaatctcgcgtctctgtttgggatcaccaaaaagtccgatcctgtcagctacgccgtgatggctgttctgtctggatccacggtgaagatgtgcgacctcttcggcgatgacgagctgaaaaccgtcgagaagaacaatattagcttcgcctctgggtatgaagagaacgaagagatctacgcttccgtgcttggagatcggtttgaactggtgaaaattctcaaggccgtctatgactgggcggttctggccgatatccttgacggcaaaaagtacatcagcgaggctaaggtggccgtgtatgagaaacataagaatgacctgaaaacactcaagaaatacgtcaagacctacctgcccgaaaagtataacgagattttcaaaatctccgatgggaagaaagacaattacgtggcttattctggacacattaaggaaagcggcaaaacaggcgagctgaagaagacctgtaactccgaaaacttttgcgcctacctcaaaaagacgctggggaaaaatgccgatcttagctataaggagatgttcgacgagatcgaaaacaaaacatttatgcctaagcaggttaccaaatctaatggagtggtccccatgcaagtgaacgaggaggaactgaaggctattctcgataatgcgaaggactacctgtccttccttaacagctgtgatgagaatggcgtttctgtgtatgacaaaatcatcaagatttttgaataccgcatcccttactatgtcgggccgctgaacacacataccgagaatagctggctcaaaagaaaggatggagtgaaaatttacccctggaacttcgacgatgtcgtggacatcgattcctctgccgaaaagtttattaataacctgaccagcaagtgcacatatctgcctgagtgtgacgttatccccaaatgctccctcctgtacagcaagttcacggtgcttaatgaaatcaacaatctgaaactcaacggcgaggacattcctgtcgagctgaagcaggggatctataaagatctgtttatgacccggagaaaggtgacagttaagcagattaaagactaccttaaggctcgcggatgttatgataacaatgacgtgctctctggcatcgataccacagtcaaatccagcctgaagtcttacttcgactttaaaggcttcgaatccctgaccttcgatgacaaggagagcattatcgcctcctctgtgatttttggggatgacaagaaactcctgaagaaacggcttaagaaactgttccccgaaaagctcacggatgaggacatcaaaaagatctgcaagctgaaatacacaggatggagcagactgtccaaggaatttctttgcgatgtggagttcacctataaaaagaccggcgaggttatgaacgtcattacagccctctgggaaaccaattacaacctgatgcagatcctgtattctgaggacttttgttgcgacggggatgagaaaaagaatctcaacgacaagctggatgaacttagctacacaggagaccaacactccctgcgcaaagctgtggatgccctctatgtgagcccgaaggtcaaacggcctattctgagagcgctgcttatcgctaaggaaattgagaaaatccaggagagaccccctaagaagatcttcgtggaagttgcccggggcattgacaatagagaggaacgccaccgggattctcgcaaaaaccgcctcatggagctgtacaagaattgtaaaaaggaggccgaaaaattttgcccctatttcgacgctctgtccaagaagctcagcgatgaggacgaatctaaactgcggagagataaactttacttttactatatccagctggggaaatgtatgtacacgggcgaggaaatttccctcggagagctgatgaacggcaatgggcggttcgacatcgaccatatttatccccgcagcaagatcaaagatgactctctgaccaacaaggtgcttgtcaataagacagtgaacaataacaaaaccaacgtttaccctatcgatgccgctattcagagcaagatgtccccgtattggcaaatgctcagaagctctggactgatctccgaggaaacatacaaacggctgaccagaaagacgcccctcaccgacgatgagctgagcgcctttgtgtcccgccagcttacagaaacccagcaatctacaaaagcggtcgcccacattctggagcagctctatcctaagcccaaaaccgaaatcgtgtacgttaaggctgccctggtgcatgctttccggcagagcaatgacatgctgaagtgcagagaggtcaacgatcttcaccatgccaaagacgcgtacctgaatattgtggtgggcaacgcctataatgtcaaggttacgcacaacaaagtgaattttatcaaggggctccagaacaatgataaaggatacacagtgaaccctgagaagttcttctcccacgacatccccggcgcttggtctgtcaaggatagcatgaataccgtgcgcagatttatgaacaaaaataacattcggtatacacgcttcccgagaaagaaacaagggggcctgtttaagatcaatcctctcaaaaagggaaacggccaggttcccctgaaggcctccggggctcggtcttgtattgaaaaatacggaggctatgacaaggccaccagcgcctacttctcctatgtggagtacaccgataaaaaggggaaagctgtccgccagatgtttcctgtgaacctttacgaagttaaggagtatgaagcggacatgcagggattcgtgacaagcagaatcgccgaggcttctaatgtcaagattctgatcccctgcgtgaaatacgacgcctgtatttcctttgatggctgccggatgttcatcacgaagaaaaccgggaaccgcatcggctataagcctggaatgcaactcgttctgggctacaaatatgagaagtacattagaaatatcgaaaactatctgacaaaacataaggaccgggagattatcccccgcgataatattagcgccgaagagaacatcgagctttacgacatcctgaccgggaagatgctcaatacagtgctgtctgtcaaattttccggaattggcaagaaactcgaaaagagacgggagaaattcgtgctgtgtagcccggaggaacagtgctgcgtgcttaacgaaatcctgaagattctccacgctaatgtcctgtctggggatctgtcccttatcggagagagccctaacaccggcacgatgaagacaaatgccaaattttccgagattaaggacgttcatagcatcaaactgatcaaccagtctgtgaccgggcttttcgaacaggagattgatctgctcaagtga

SEQ ID NO: 4163 - RNA, 4038 nt, synthetic construct
  misc_feature 1..4038: note = Cas9 variant
  source 1..4038: mol_type = other RNA
atgggcaagccctacagcatcgggctggacattggaaccaactccgtgggctgggccgtcgttacagatgactataaagtgcctgctaagaaaatgaaggtgctcgggaatacggataaacagtctatcaagaagaacctgcttggagccctcctgttcgacagcggcgagaccgcggaagctacaagactgaaacggaccgcccgcagacggtacacacgcagaaagaatcggcttcgctatctgcaagagatttttaccggggaaatgaacaaagtcgatgagaatttctttcagagactcgacgattccttcctggtggacgaagataagcggggagagcaccatccgatctttggcaacattgccgctgaggttaaataccacgacgatttccccacaatctatcatctgcgcagacacctcgccgacacctctaagaaggctgatctgcggcttgtgtacctggccctcgcgcatatgatcaaatttcgcggccacttcctgtatgaaggggaccttaaggccgagaatacggacgtccaggctctgtttaaagatttcgtggaagagtacgacaagaccattgaggaaagccacctctccgagatcacagttgatgccctgtctattctgaccgaaaaagtgagcaagtccagcagactcgagaacctgatcgctcattaccctacagagaaaaagaataccctttttggaaacctgattgccctctctctggaccttcaccccaatttcaagacgaactttcagctgtccgaagatgcgaaactccaattcagcaaggacacatatgaggaagatctggagggcttcctgggggaagtcggagacgagtacgccgatctctttgcttctgccaaaaatctgtatgacgctatccttctgtccggcattctcaccgtggatgacaacagcacaaaggcccctctgtctgcctccatggtgaaacggtacgaggaacatcagaaggaccttaagaaactgaaggatttcatcaaagtcaatgctcccgaccagtataacgcgatctttaaggataaaaacaagaaggggtacgccagctatattgagtccggagttaaacaggacgagttctacaagtacctcaaaggcatcctgctgaagattaatggctctggggattttctcgacaaaatcgatcgcgaagacttcctgagaaagcaacggacctttgataacggaagcattcctcaccagatccaccttcaggaaatgcatgctatcctgagacgccagggcgagcactatccgttcctcaaggaaaatcaagacaaaattgagaagatcctgacctttcggattccctactatgtggggcctctggccagaaaaggatcccgcttcgcctgggctgagtacaaggccgatgaaaagatcacaccctggaactttgacgatattcttgacaaggagaaaagcgcggaaaagttcatcacgcggatgaccctcaatgacctgtatctgcctgaggagaaggtgctccccaaacattctccgctgtacgaggcttttacagtctataacgaacttaccaaggtgaaatacgttaatgaacagggcgaggccaagttcttcgatacaaacatgaaacaggaaatctttgaccacgtgttcaaggagaatagaaaggtcaccaaagataagctgctcaactacctgaataaagagtttgaagagttccgcattgtgaacctgacggggcttgacaaggaaaataaagcctttaactccagcctcggaacatatcatgatctgcggaagatcctggacaagtctttcctcgatgacaaagctaatgagaagaccattgaagatatcattcaaaccctgacactttttgaggacagagagatgatccgccagcggctgcagaaatacagcgatattttcaccaaggcccagctcaaaaagctggaaagacgccactatacaggctggggccggctgtcctacaaacttatcaacgggatcagaaacaaagagaataagaaaacgattctcgactatctgatcgatgacggatacgctaaccggaattttatgcaactgattaacgacgatgccctctctttcaaggaagagatcgcgcgcgcccagattatcgacgatgttgacgatatcgctaatgtggtccacgacctgcctggcagccccgccattaaaaaggggatccttcagtccgtgaaaattgtcgatgaactggtgaaggttatgggacataaccctgctaatatcattatcgagatggccagagagaaccagaccacagacaagggccggagaaatagccaacagcgcctcaaactgctgcaggattctcttaagaacctcgacaatcccgtgaacatcaaaaatgtcgaaaaccagcaactgcagaatgatcggctgtttctctattacattcagaacgggaaggacatgtacaccggcgagacactggacatcaacaatctttcccagtatgatattgaccacatcattccccaagcgttcatcaaagataacagcctggacaatagagtgctcacccgctctgataagaacagaggaaagtccgacgatgttcctagcatcgaagtggtccatgagatgaaatccttttggtctaagctgctgagcgtgaaacttattacgcagcggaagttcgacaatctgaccaaagccgagcgcggcgggctcacagaagaggataaggctggattcatcaagagacagctggtggaaacccggcaaattacaaaacacgttgcccagatcctcgacgagcgctttaacaccgaatttgatggcaataagagacggattcgcaacgtcaaaatcattacgctgaagtccaatcttgtgtctaactttagaaaagagttcgagctgtacaaggtgcgggaaatcaatgactatcaccatgctcacgatgcctacctcaacgccgtcgtggggaatgctctgctgcttaagtatccgcagctggagcccgaatttgtttacggagagtatcctaaatacaacagctaccgctccagaaagagcgcgacagaaaaattcctcttttattctaatatcctgcggttctttaagaaagaggacattcagaccaacgaggacggcgaaatcgcctggaacaaggagaagcatattaaaatcctcagaaaggtgctgtcctacccccaagtcaatattgtgaaaaagacagaggaacagaccgggggcttcagcaaagaatctatccttcctaagggagagtccgataaactgatcccccgcaagaccaagaacagctattgggacccgaaaaagtacggcgggtttgattctcctgttgtggcttatagcattctcgtcttcgccgacgtggagaaaggaaagtccaaaaagctgcggaaggttcaggatatggtgggcatcacaattatggaaaagaagagattcgagaaaaatcccgtcgactttctggaacagcgcgggtaccggaacgtgagacttgagaagatcattaaactgcctaagtatagcctcttcgagctggaaaataagcgccggagactcctggcctctgctaaagagcttcaaaagggaaacgaactggtgatcccccagcgctttacgaccctgctctaccactcctaccggatcgagaaagattatgaacctgagcatagagagtacgtcgaaaagcacaaagacgagttcaaggaactgcttgagtatattagcgttttctcccggaagtacgtgctggccgataataacctcacaaaaatcgaaatgctgttctctaagaataaagacgcggaggtgagctccctcgctaagtcttttattagcctgcttaccttcacagcctttggcgcccccgctgccttcaactttttcggggagaatatcgatcgcaaaagatatacctccgtcacggaatgcctgaacgcgacactgattcaccagtctatcaccggcctctacgagacccggattgacctgagcaaacttggagaagattga

SEQ ID NO: 4164 - RNA, 4038 nt, synthetic construct
  misc_feature 1..4038: note = Cas9 variant
  source 1..4038: mol_type = other RNA
atggaccagaagtacagcatcggcctggatattgggaccaactccgtgggatgggccgtcgttacagacgattataaagtgcccgctaagaaaatgaaggtgctcggcaatacggacaaacaatctatcaagaagaacctgcttggggcccttctcttcgatagcggagagaccgcggaagctacaagactgaaacggaccgcccgcagacggtacacacgcagacggaatcgccttagatatctgcaggagatttttgccgaagagatgaacaaggtcgacgaaaatttctttcagcggctcgatgactccttcctggtggatgaggacaaacgcggcgagagacaccctatctttgggaacattgctgccgaagttaagtaccatgatgacttcccgaccatctatcatctgcggaaacacctcgctgatatctctcagaaggccgacctgcgccttgtgtacctggcgctcgcccacatgattaagtttagaggacatttcctgatcgagggccaacttaaagctgaaaatacaaacgtccaggccctgtttaaggacttcgtggaggtttatgataaaaccgtggaggaaagccacctctccgagatgacggtcgacgctctgtctattctgaccgaaaaggtgagcaaatcccggcgcctcgagaatctgatcgcccactaccccgcggaaaagaaaaacacactttttggcaatctgattgccctcagcctggggcttcagcctaacttcaagaccaattttcagctgtctgaggatgctaagctccaattctccaaagacacatacgaggaagatctggagggactgctcggcgaaatcggggacgagtatgccgatctgttcgctagcgccaagaacctttacgacgccattctgctctctggaatcctgaccgtggatgacaattccacgaaagctccccttagcgcgtctatggtcaagagatatgaagaacatcagaaagatctgaagaagctcaaagactttatcaaggttaacgcccctgaccagtacaacgctattttcaaagataagaataaaaagggctatgccgggtacatcgagaacggagtgaagcaggacgaattttataaatacctgaagggcattctgctccaaatcaatggctccggggatttcctggacaaaattgatcgggaggactttcttagaaagcagcgcacattcgataacggaagcatcccccaccagatccatctgcaagaaatgcacgccattctccggagacaggaggaacactacccttttctgaaagagaatcaggacaagatcgagaagattctgaccttccgcatcccgtattacgtgggcccccttgctcggaaagggtccagatttgcctgggcggaatataaggctgatgagaaaattacaccttggaacttcgacgatatcctcgacaaggaaaaatctgccgagaagtttatcacccgcatgaccctgaatgatctgtacctccccgaggaaaaagtcctgcctaagcatagccttctgtatgagacattcacggtgtacaacgaactcaccaaggttaaatatgtgaatgagcagggagaagccaagtttttcgacgctaacatgaaacaagagattttcgaccacgtctttaaggagaatcggaaagtgacaaaggataagctgctgaactaccttaataaagagttcgaggaatttagaatcgttaacctcaccggcctggacaaggagaataaagccttcaactccagcctggggacataccatgatctccgcaagattctggacaaatcttttcttgatgacaaggctaacgaaaagaccatcgaggatattatccagacgctgacactcttcgaggaccgggaaatgattagacagcgcctgcagaaatattccgatatctttaccaaggcccaactgaaaaagctggagcggagacactacaccggatggggccggctcagctataaactgatcaatggcattcgcaacaaggaaaataagaaaacaatcctggactacctcattgatgacgggtatgcgaacagaaatttcatgcagctgatcaacgatgacgccctttcttttaaggaggaaattgctcgggcccagatcatcggagacgtggatgacattgctaatgtcgtgcatgatctgcccggcagcccggccatcaaaaaggggattctccagtccgtcaaaatcgtggacgagctggttaaggtgatgggacacaaccctgcgaatattatcatcgagatggccagagaaaaccaaatgaccgataaaggccgcagaaattctcagcagcggctgaaacttctccaggacagcctgaagaacctggataatcccgtcaacattaagaatgtggagaaccaacagctccagaacgaccgcctgttcctttactatatccaaaatgggaaggatatgtacacaggcgaaacgctggacattaacaatctctcccagtacgatatcgaccacattatccctcaggcttttatcaaagacaacagcctggataatagagttctgacccggtctgacaagaaccgcggaaaatccgatgacgtgcccagcattgaggtcgtgcatgagatgaagtctttctggtccaaacttctgagcgtgaagctcatcacacagagaaagtttgataatctgaccaaagccgaacggggcgggctcacagaggaagacaaggctggattcattaaacgccaactggttgagaccagacagatcacgaagcacgtcgcccagattcttgatgaacggttcaacaccgagtttgacggcaataagcgcagaatccggaacgtgaaaattatcacactgaagtccaatctcgtgtctaacttccgcaaagagtttgaactgtataaggtcagagagatcaatgattaccatcacgcccacgacgcttatctgaacgcggtggttgggaatgcccttctgctcaaatacccccagctggaacctgagttcgtgtatggagaatacccgaagtataacagctaccggtccagaaagtctgctaccgagaaatttctcttctacagcaacattctgcgctttttcaagaaagaggatatccaaacaaatgaagacggcgagattgcctggaacaaggaaaaacatatcaagattcttcggaaggtcctgtcctatccccaggtgaatatcgttaaaaagaccgaggaacagacagggggctttagcaaagagtctatcctccctaagggagagtccgataaactgattcccagaaagacgaaaaacagctactggaatcctaagaagtatggcgggttcgactctcccgtggtcgcctactccatcctggtgtttgctgacgttgaaaaaggaaagagcaaaaagctgcgcaaagtgcaggatatggtcggcattaccatcatggagaagaagcggttcgaaaaacacccggtggacttccttgagcaaagagggtatcgcaacgtgcggctcgagaagattatcaaactgcctaagtactctctctttgaactggagaataaaagacgccggcttctggccagcgcgagagaactgcagaagggaaacgagctcgtcatcccccagcggttcacaaccctgctttatcattcctaccaaattgaaaagaattacgagcctgagcaccgcgaatatgttgagaaacataaggatgaatttaaagagctgctcgaatacatcagcgtgttctctagaaagtatgtgctggctgacaacaatctcaccaaaattgagatgctgttttccaagaacaaggatgccgaggtcagctcccttgccaaatctttcatcagcctgctgacatttacggctttcggcgcccccgcggcttttaatttctttggggaaaacattgaccggaagcgctacacctccgtgacagagtgcctcaatgccaccctgatccaccagtctattacaggcctttatgaaaccagaatcgatctgagcaaactcggagaggactga

SEQ ID NO: 4165 - RNA, 4038 nt, synthetic construct
  misc_feature 1..4038: note = Cas9 variant
  source 1..4038: mol_type = other RNA
atgaagaaagagtacagcatcggcctggacattgggaccaactccgtgggatgggccgtcatcacagatgactataaggttcccgctaaaaagatgaaagtgctcggcaatacggataagcagtctattaagaaaaacctgcttggggccctgctctttgacagcggagaaaccgcggaggctacaagactgaagcggaccgcccgcagacggtacacacgccggaaaaatagacttcgctatctgcaagaaatctttaccgaggaaatgaacaaggtggatgagaatttctttcagagactcgacgattccttcctggtcgaggaagacaaacagggctctaagtaccctatttttgggacactgaaggaggaaaaagagtatcacaagaaattcaagaccatctaccatctccgggaggaactggccaacagcaaagagaaggctgatcttcgcctggtgtatctcgccctggctcacatgatcaaatttagaggacatttcctttacgaaggcgacctgaaggccgagaatacggatgttcaggcgctctttaaggacttcgtggaagagtacgataaaaccattgaggaatcccacctgtctgagatcacagtcgacgccctgagcattctcaccgaaaaggtgtccaaaagctctcggctggagaaccttatcgctcattatccgacagaaaagaaaaataccctgtttggcaacctcattgccctgtcccttgggctgcaacccaatttcaagacgaactttcagctcagcgaggacgctaagctgcagttctctaaagatacatacgaggaagacctggaggaactcctgggagagatcggcgatgaatatgccgaccttttcgcgtccgccaagaatctgtacgatgctattctcctgagcgggatccttgccgttgacgataacaccacaaaagctcctctgtctgcctccatggtgaagcgctatgaggagcaccagaaagacctcaagaagctgaaagattttatcaaggtcaatgcccccgaccaatacaacgctattttcaaagataagaacaaaaagggatatgcgggctacatcgaaagcggggtggagcaggacgaattttacaagtatctgaaaggcattctcctgaagatcaatggctccggcgacttccttgataaaattgactgcgaggattttctgagaaagcagcggaccttcgacaacgggtctatccctcaccagatccatctccaagagatgcacgccattctgcgcagacagggagaacattacccctttctgaaagagaatcaggataagatcgagaaaattcttaccttccggatcccttattacgtgggaccgctcgctagaaaggggagccgcttcgcctgggccgaatataaggctgacgagaaaattacaccctggaacttcgatgacatcctggataaggaaaaatccgccgagaagtttatcacgcggatgaccctgaatgacctctacctgcctgaagagaaagtccttcccaagcacagccctctgtatgaaacattcaccgtttacaacgagctcacaaaggtgaaatacgtgaatgaacaaggagaggcgaagtttttcgataccaacatgaaacaggagattttcgaccacgtctttaaggaaaatagaaaagtgacgaaggataagctgctgaactatcttaataaagagttcgaagagtttcgcatcgttaacctcacaggcctggacaaggaaaataaagccttcaactcttccctggggacctaccatgacctccggaagattctggataaatcttttcttgacgataaggctaatgagaagaccatcgaggacattatccagacactgaccctcttcgaagatagagagatgattcgccagcggctgcaaaaatatagcgacatctttacaaaggcccagctgaagaaacttgaaagacgccactacacgggatggggccggctcagctataaactgatcaacggcattagaaacaaggagaataaaaagaccatcctggattacctcattgacgatgggtatgctaaccgcaatttcatgcagctgatcaacgacgatgccctttcctttaaggaggaaattgctcgggcccagatcatcggagacgtggatgacattgcgaatgtcgtgcatgacctgcccggctctccggccatcaaaaaggggattctccaaagcgttaaaatcgtggatgagctggtcaaggtgatgggacacaaccctgctaatattatcatcgaaatggccagagagaaccagacaaccgacaaaggccggcgcaattcccagcagagactgaaacttctccaagatagcctgaagaacctggacaatcccgtcaacattaagaatgtggaaaaccagcagctccagaatgatcggctgttcctttactacatccaaaacgggaaggacatgtatacaggcgagaccctggatattaacaatctctctcagtacgacatcgatcatattatccctcaggcttttatcaaagacaactccctggataatagagttctgacgcgcagcgacaagaaccggggaaaatctgacgatgtgccctccattgaggtcgtgcacgaaatgaaatccttctggagcaagctgctttctgttaagctcatcacccaaagaaagtttgacaatctgacaaaagccgagcgcggcgggctcaccgaagaggataaggcgggattcattaaaagacagctggtggaaacacggcagatcaccaagcacgtcgcccagattcttgacgagcgcttcaacacggagtttgatggcgctcaaagacggatccgcaatgtgaagattatcacactgaaaagcaacctcgtgtccaatttcagaaaggaatttgagctgtataaagttcgggaaatcaacgactaccatcacgcccatgatgcttatctgaatgccgtcgtggggaacgcccttctgctcaagtacccccagctggagcctgagttcgtgtatggagaatacccgaaatacaattcttatcgcagcagaaagtccgctaccgagaagtttctcttctacagcaacattctgcggtttttcaaaaaggaagacatccagacaaatgaggatggcgaaattgcgtggaacaaagagaagcacatcaaaattcttcgcaaggtcctgtcttatccccaggtgaacatcgttaaaaagaccgaggaacaaaccgggggcttttccaaggagagcatcctccctaaaggagaatctgacaagctgattcccagaaaaacgaaaaattcctactggaaccctaagaagtatggcgggttcgatagccccgtggtcgcctactctatcctggtgtttgctgacgttgagaagggaaaaagcaagaaacttcggaaggtgcaggatatggtcggcattacaatcatggagaaaaagagattcgaaaagaatccggtggacttcctggagcagcgcgggtatcggaacgttagactcgagaaaattatcaagctgcctaaatactccctctttgaactggaaaataagcgccggagacttctggccagcgcccgcgagctgcagaaaggaaacgaactcgtgatcccccaacggttcaccacactgctttaccactcttatcagattgagaagaattacgagcctgaacatagagagtatgtcgaaaagcacaaagacgagtttaaggaactgctcgagtacatctccgtgttcagccgcaaatatgtgctggctgataacaatctcaccaagattgagatgctgttttccaaaaacaaggacgccgaagtctctagccttgcgaaatccttcatctctctgctgacatttaccgctttcggcgcccccgccgcttttaatttctttggggagaacattgatcggaagagatacacgagcgttacagaatgtctcaatgccaccctgatccatcagtccattaccggcctttatgagacacggatcgacctgtctaagctcggagaggattga

SEQ ID NO: 4166 - RNA, 4041 nt, synthetic construct
  misc_feature 1..4041: note = Cas9 variant
  source 1..4041: mol_type = other RNA
atgaaccagaccaagaattacgacatcggcctggatattggggtgggaagcgtcggctggacaatcacggactcccaatctcagaaagttctcaaggtgaaagggaagcagggaattggcgtgcacctgttcaacgaggggcagaccgccgaagagagacggcaatttcgcacaaatagacggcgccttaaaagacggaagtggcgcctgagactcctgcgggaacttttcgatgagcccatcagctccattgaccctgaatttttcgctcgcctgaagtattttaacgagtctagcaaagatccgaagaataaaggataccagccccagctccatgacgatctgaaggacgtcgatttctatagacagtaccctaccatctatcatctgcggcacgccctcatgacacaaaaagagaagtttgacatccgcgatatttacctggcgatccaccatattgtgaagtatagaggccacttccttatgaacggccactcctctagcttttccgttgctcagaccgactggaaagccgatctgacaaaactcttcgaactgatccaggagacccggacgaatcttgactttagcttcgacctgaccgaaattgatacaatcaaatctctcctgtttgacaagaacctgtcccgcaatgatagacagaaagagattgtggggctcatcaacaataacagccaactggacaagaaagataaggcccttaccaagcagctggtcgagtctgtggttaaaggaatcgtgggcatgaagacacggaccgacattctcctggggtacgaagtcgataataaagagcagtccaaggcttggaacttcagcatcgacgaacttgatgaccaaatggccacgattgatcccgctctgtctcaaaattcccaggcccatgacatcattacactcatccagaaactgtacatgaccgtgcagctggcgcagatcgtgcctgagggacagagcgtctccgaaatgatgattaacagatataacctctacgccgagcagctgcaacagcttaaggactataagaaaatcaatctggagacaggcctcctgcttcgcgaagcctacgatgagctgatgaccaaggccctcaccgctgcccccgggaaaacaattcacgacacgttctataacaaggttaaaaagatcctgaaggatcaggacaataaacaggcgctgtctattaagcaagccatcgaagatagcaactacctcatccctctgcggattaaatccaatggagtgatcccgtatcagcttcatcagagagagctggacgctattatcgaaaaccagaaggagttttaccccttcctcgccacccctaatcccgtggatggccaccaagaggctctgccttacaaactggacgaacttattggctttaaggtcccctattacgtggggccgatggttgatcctgaggtggacagcgatcagaacttcgcctggatggtccgcaaggaaaaaggagagatcacaccctggaattttcacaacaaggtggacattacccagtctgccgataatttcatcaaacggatgaagacaaccgacacgtatctcatcggcaaagacgttctgcctcaaaactccctgctctaccagagatatacagtgctgaatgaacttaacgggattaaggtcgctaataaaaagctgaccatcgagcagaagcagcgcctctacgatcaactgtttaaaaagaaaaagaccgtgaaaaagcaggacattctgaacaaccttgtcgcggccggagagatccatgaagatgacaatctcacaggcctgagcaacgggaccacattcaataacaatctgggatcttatattgattactgcaagatcatcggccaggacaaactcgaggatgctagcaagcaggccgacattgaacggatcattgagtggtccacgacctttgaggatgccaacatcttcctgacaaaacttgctgaaattaattggctgaccgaggaccaaagacagaagctctctcagatccgctaccggggctgggggcagtttagcaaaacactgctgaccgatatcaaggacaacaaggataattccattatcgacaaccttatgagcacgaaaaaggtgttcatgcaaattatcaatgacaccacaattaaacagaagatcgatgactataaccagtaccacctcaatcatgccgatctgaaagacaccatcgcgaacctgtttacatctccccaaaataagagagctattaaccagaccctcctggttatcgaagatattatcaacgccgtgggacacaagcccaatcgcattttcatcgagtccgccaaagacaaccggaatgctaagaaccagcttacgcagagcagactgaaacggattgtcaagcaattcgaagataataaacagcatgtggaccagtctgtttatgaggagctcaagcagctggatgacggctcccacgccagcatcgatgaccgcctgcttctctactttctgcaaaacgggaaagacatgtatacaggacagcctatcgatatttcccagctgtctaccagccagtaccacatcgaccatattctcccgcaagctaaggtgatggataatgccctggacaacagagtccttgtgtcctctaaggcgaatacagaaaagagcgatcggttcctgtccgagatcccccagtttcagcagagaagcctctgggccgaactggagcgcatgggcttcctgaccaaggctaaaaaggaacggcttctgatgacctctgacgagtttaaacaaaactccgtgagattcattgcccgccagctcgttgagacaagacagatcatcaagctggtcaatcaactcattatccaggaacaccctgaggtgaagctggtgaacattaaagctgatcttacgaatgcctttcggaagaaattcaactttgtcaagaatcgcaacgcgaacgactatcatcacgccttcgatgcttacctgaccagcctcatcgggtctcatctgctgaaatcccaccccaagtgggaacctctttttgtgtacagcgactatgataagattaaattcgacaatgctccccagggcgttaacatcatgaaggagtttgaacagtctaaactggctgatgagaatggagagatcatttggaacaaggacgaaatgatggcctacctcgagagactgtataatagccggcaaatcctcattacaaagaaggtgtacgcccgccacggcaacctgttcaagcagaccatcttcaaagctggggaatccgacaatcttattccggtcaagaacaatagaagcgatatcgcgatttatggaggctacaaatctaaacaggtgtcctattacgccctgatcagcctccataacaaaaagcggcagaagcgcctggttgctgtgtacctgatcgacattcaaaaacttcagaatctgaacgagtccgattattttaagacactccacaccatcattaaagagagacataatatcaagcctgagttcgacattctggccgataaaatctaccagaaccagctcatcattgacaataagaacgggtctaatcggccctttcgcatcgaaggagatttcaaaaacgacagacaactgtatcttcctctgcagtaccagcggtggctggccagcaaggaacccacggatgagaagctcaacagaatttttgaccacatctgtgaacaactggctgattatttccctctttttgccggcaatgcgtgcgacaaactgctcgataaccgcgacaagttctaccagctgtccattaaatctgagtttaatgacaaggggaaactcatcgctgagggcaagctgagcgtcatcgataaacttctggtggccatgcacgccgactcccggaactctaatctggctgttattggactcagctccagctggggcagattcaagctgcatgggggaaacgaagccatcggcacatctgtgcagcttattcaccagtcccccaccgggctgtttaagcgcatccaacggttcaattga

SEQ ID NO: 4167 - RNA, 4041 nt, synthetic construct
  misc_feature 1..4041: note = Cas9 variant
  source 1..4041: mol_type = other RNA
atgctgagcgccggcgtgatgctcggggacgtctccgctctgaagtctagcagaaactcccttttccagaaatctaagaaactgatcgagaatagctcctctgatctcaccaaggttgactacagcaaaatgcgggaaattctgctttccatccgcaacattgccatcagatttttcaataacgaggattttaaggaaagcgactattacaaggagttccccacaatttggcatctgcggaaaaatctcatggaatctgataagaaagcggacatccgcctggtgtatctggctctccacaacatcgtgaagtacagaggaaattttctgcaagagaacaataaagatcttcgggccgccaacgctaatgccggcgctgccgcgattgacctgtccaacgccctcgaggaatatttcagcctgcacgaggatgaatctgctcttacgtgcgtccctaatgtggccgacctgcagatgaccctcgagcagccggggctgcgcaacggagagagactggatcggatcgttgctgccctcaatatgcccgaccgcgcgagagccaagctgtttgctaaggcctgtattggccagaaagtggagttctccaagctggctctggggatggagaaacaagaaggaacaaacgcctacatctgggatgacgacaagtatgatgagctcgtcgccctgtgccctgaagactttttccccgtgcttgagaccctgaaaaacgcttacagcgcgtacgttctctctgatctgctggccggcaagctctccattagcgcttccctgatcgactcttatgagcagcatcagaatgatcttaaaattgtgaaggaactggtccgggagtacctcggccagaaggaatatgggcgcctgtttagaggacctaaattcgccaacggcgactacaattttaacaaggtggccaaacccagctatacatcctacatccttggggagagcctgtgtaataagcaaggaaccacacgggaagaactcgtgaaagagctgaagcgcgtcttcgatgactgctctgctatccaggccgataagagatatcagaaaattaagcagcggctggaagacgatcctaaattcctcatcaagcaaaagaccagagcgaacggcgctattccgtaccagctgcaccttgaggaaatgcatcagatcattgagaagcaagggaagtactatccctttctggttgaacagcaggacctcatcgagaaactggtgtccagccgcatcccttactatgtgggacccctgaatggcggccacgaccctaaccacccctacccgacgaatcctattgatcccaagcggaaattcgcctggtctgtcagaaagcctgggatggagcatgaaaaagcctatccctggaacgtggacgaggttatcgatagcgaagagaccgctgagcgctttattcggagaatgacaggaacctgtacatacctttatggcgaacccgtggtccctcgctgctccctcctgtacgaggagttctgtgtgctgaatgaactcaacggggcccggtggggagaaggcaatggggacacccacagatttgattctagcgaccgcacggagatcctggagcagcttttcaagaagcggaaaagagttacacataaggctattgccacctggctggaaatcaaccacggagtgacaaatgtcaaaatctccggcacccaagcggagaacgcctttgaaagcaagctctcttcctacaacgatttctgcaatctgctgggcgtggacgggcttgaggatgtctgtccgctcaccaaagacgatattgaacagatcattctgtgggtgacagtttttgaggacaagaaactgctcctgcagaaacttcagcgcgctttcggagataagctgagcgagaaacaaatcgcctctattatgcggaagccctatgctggctgggggagactctccagcaaactgctgacgggaatcaagcgggaaaccccttttggccgcatttccatccttgacgtgatgagagacggggatccccggcctggccaccatctcgacgccatgaacttcatggagatcctgagagaaaaagattttggattccaggaccgcattgatgagatcaataaggaacggacaaaggagtctggcctgctcctgagcgtcgaggaccttcccgggtccccggcgctgagacgctctgtgaaccaggccatgcacattctcaaagaaatcgttagcattgctggaaaggagccttccagaatcgtgatcgaagtcacccgggatcccgacgaggagaaacgcggccatagaacagatacccggtacaagcagctgagcgaagccctggctgccattaaaacggacatcgtgcaattcgattcttcccttctcgccgagctgaaggaacgcaaggacagcctggattctgagagactcatgctgtattttcagcagtgcgggaaatccctttacagcggaaagcctctggacattaatcggctctctgaatatcaggtggaccacatcattccccaatgttacatcaaagatgacagcctggataacaaggctctggttttcgcgtccgagaatcagatcaaacttgacagcctgctcctggataagtctattatccgctcccagaagggcagatggcaagagctccatcgggccgggctgattagcaacaaaaagtttcgcaatcttacatgcaccgaaatctccgacagaatgatgaaaggcttcattaaccggcagctggtcgagacctctcagatcgtgaagtttgtgagacagatgtgcgaacaacgctatgagagctccgaagtcatctctctccgggctagcctgtcccacaatctgagagatcgctgtggattcattaaatgccgggagcttaacgactaccaccatgcccacgatgcctacctggcttgtcagatcgccagatttattggcatccgctatcctcggtggcaggacgggatttctagagagttcatcaataagtacattaaacagctcgtgaagaagggaaaaagctccggcaagtttttcgcggggaaaagcggatttatcatcgattctttcatgcatgacggctttgaccgcgaaacaggggagattttccgggatggctgggacgctaccttcgaaatcacaagaatgcggcgcgttctgggatataaggattgctttattacgagaatgcccgaggaacaaaccggcgcctactgggaggagacaatctattccccgctcgacgccaaaaacgggaagaatctgcagattcctcttaagcagagcggaaaagaaggctacctggatcccaagaaatatgggggaaccaacacagctttcaacgcctactttttcgcgtttgtggctaaggacgcccggggccgcgataaatacttctttgagggggtccccgtgtatctcgccaagcagctgaatgaacaacctcagatcctggttgacttcgctaactctatcgccgctaccaagaaatgttccacggccaagattcttagaagcaaagtgccgctgcggcagaagtttctcctggatggcacctctttctacctcggaggcagaacagggaataaaaacgtcatcctgtccggagtggagtttgcgtgcggcattgacatggccaagatgatcgataccgctattaagcaccccgaggaacttagccaaaaagagctgatctccatcattcagatgctggccgacacaatcgaacgcaatagcgatcggcaggcttctctcattaacttcagacgcttcgacgacaagctgcggaatatcgatgccattgccgctagcagaatcattaaaaaccttcttaattccatgaacggggttaagcagtcttgtgacctcagcgatctgggaggctccaaacaatctggctttatgcagagcaatatcgcgaccctcttcgagcgcatcacgtggtgctattcctctattacagggatgtttgaacagcgggtgagcttcgaggacctgaagaacggaatctga

SEQ ID NO: 4168 - RNA, 4041 nt, synthetic construct
  misc_feature 1..4041: note = Cas9 variant
  source 1..4041: mol_type = other RNA
atgaagaaaagaaaccgggaggaatactatgtgggcctggacatcgggaccagctccgtcggatgggccgttgctacacccgattaccgcattcctaagttcagaggccacaaaatgtgggggtctcggctctttgccgagggaaagcgcgcggctgaaagacggcagttccgcacgaatagacggcgcctggccagacggcgcgacagacttcaaatcctggaggaactctttgccgaggagatggctaaagtggataacaccttctttatgcggctgaaggaaagcaagttctttcttgaggacaaaacagtgaaggaaaaacatattctgttctccaccgataagtttgacgccgatcgcttctataaagacaatccgacaatctaccacgtcagaaagcggctcatggaggaggaaccccaggatattagagagctgtttctggctgtgcatcacatcctcaagtatcgcggccatttcctgtttgccgggtctcttgaacagaacggagacagcatcgaggaactggttcggaccctcttcggcaaacagggcctggcgattcttgatgacacaatcgattccaatgagatggtgaacattctgaagaataacgagaaaaccaagtctgacagaaagaaggccgtccaagaactctggaatcctctgaaagacaaggtgaagaaagctcaggccgctgagatggccggggttgtgctgggactcaacagcgatatctccaagctgttcgacaatagcgattacaaagaccttaagattaacttttcttccggcgattatgacgaaaaacgcgatgactacgcgaatagcatcggggatgacattgtcctgctcgatacgatgaaggccctgtacgacacccttatcctgtctcagatcctccagggaaagcaatccattagcgaggctaaagtggaagactataacacacacaaggagcagctgcgggccctgaaagctatcctcaagccccacaaaagactgtacaatgagatgttccgcgaaaacaacaagaaggatctttctaattatgtggcctacatttccagctattccgagggcaaacgggtcaacagagaagggttttacaagtatgttcaggccgtgctgaaacaggtggacgattctgacagcaagcaagctatcctcgaggcgattcgcctggaaaccttccttcctctgctccgggtcaaagataatgccgtgatcccccatcagatccaccaggctgagctggaggccattctggaaacagccagaaagaagtacaaatttctcaacgacgtttccgagggagtgagcgtcaaggataaaatcattcaactgttcacctttcgcatcccttactatgtgggcccgcttaatccccattctggcgaaacggttgctgaccggaagcaggggacaggatgggtggtcagaaaacagcggggcaaggtgtacccttggaacttcgccgatatggtcgacgtgaaagcgtccgctgaggcctttattaccaatctgacaaacaagtgcacctatctcatcggggaggatgttctgcccaagcgcagcctgctttactctgagttcatgctcctgaatgagctgaacatgatcaaatatgacggacacgaactccctgtggagattaagagactgtacatcgaacaggtctttaaacaagagcacaagaaacagaccaagggccgggtgcttgatttcctgaagagaaatgggctcattacaggaagcgccacggctgttatcaccggcatggacgactccattaaaggcgatctgcagtcttatcgcgacatggtgcggatctttgggacaggattcgatcatagcatggccgagagaattatccgctgggtcaccctgttcggcgaagctaaggacatccttgagaacaaaattagagaagtgtacggaaattccatcagcgattctcagatgcgggccattaagaaactcaagtacgcggactgggggcgcctgtcccaagcctttttcatcaagattatcggctgtgataaaagcggggtggagagaaacatcattacatgcctgcgggaatcttcccagaatctcatggagatcctgagcgaccagggcacctatattaagcagatcaaggcttggaaccaccaacatacgacaaacatgatggatacccttgactaccagctggttgatgacctctatgtcgccccctccgtgaaacgctctatttggcagagcctgtgtatcgtggaggaactggtcaaaatcatgggacaggctccgaagaagatttttgtggaggttaccagaacaaatcaagccgagaaaaccaagaaagattcccggaagaaacgccttgtggaactctacacagcgatcggcaaggaaggggccgcttggaaaaaggagattgagaagcaccaggccggagacttcagacggaaaaagctgtatctgtactatacgcagatgggccgctgcatgtactctcatgaacctatcgctatggacgccctctttaccagcgagtacgatattgaccacatctatccccaatccctgacaaaagatgacagctgggataaccttgtcctggtgaagtctcagctcaataaagaaaagtccgaccagtaccctctgagacccgccatccgggagaagaacaaagcgtattggcagtacctgtgtagagctgggttcattagcgagaagaaatatgaacgccttatgcggaccacagagctcaccgccgaagaactgtctggatttatcgctagacaactggttgaaacgtcccaggccaccaaggccgtgattggcctcctggagcgcatctacaaacacacagatatttgcttcgtcaaggctgagaccgtgagccagtttcggcatcagcacaatttcatcaagattagagaacttaacaattatcatcacgccaaagacgcgtacctgaacatcgttgtggggaatgtctaccacgagaagtttaccaaaaacccccgcgagttcatcgctcggtctacagaaagacgcccttataatctcaaccggatgtacgattttgacctgctgaagcaaggcagagtgatttggcaagtgccgaaaagccttgaaacggtccaggccatgatgaagtccaatgatgttcggatcacaaagaaactgctcgtgcagaagggagagctgtatgacgccaccattacaaaagctcataagaccaaagagggcatgtacttccccctcaagggggccgacgcgcgcctgagagatgtgcaccggtatggaggctacgaaaagatcaaaattgcttattacagcgtcttctcttgttgcgagaaggcctccgacaccatccatacacttatcattcctatccccgtgtacgccgctgggctgctccagacggaagccgatctgaccgcttatgcctggcagacaaaacagaagaccaaacctattaaggacatctacagcatgattacacccatctataaaaagctgtgtatcaacaccgttgtgaagattgatggatttaaatacttccttggcgggcgcacggaggactatatctgcctgtacccggcgattcctgtcgtgctcgatgaacaagccgctgcctatctgaaggctgtttccaaagtgggcagagccgacgatgtcgagaatacagcccaggctatcgacctcattaccgcggaggccaacgaggctttttacgatgtgctgcttaagaaaatggaagccaagatcttcgttaaggcctaccaggaacgggtggagaaactggcttctgagaccgccagagaacgctttcggaagctcagcattggagcgcagtgttcctgcctgctggagatccttaacctgctcgctaataacaaaacaacctctaatctgaagaaatggctcggcgtcacaatgagcagacgcaagcaacccatggacctgacgaaacttgaagagtgcatcgtgtatgaaacctccattacagggctgtacgagaaagccgtgtctctgctctga

SEQ ID NO: 4169 - RNA, 4041 nt, synthetic construct
  misc_feature 1..4041: note = Cas9 variant
  source 1..4041: mol_type = other RNA
atggtggagcactacgccatcggcttcgacattgggaccggaagcacaggctttgctggggtcgatcccaacggaaagctggttagaatgcggggcaaaaatgtgtatggggtgtaccgcttcaagggaggcgaagccgcggctgacagacggggctttcgcacgaccagacggcgcatcaaaagacggaagtggcgcctcagattcctgaaatcctttttcgagccttatattgccccgatcgatcccgaatttttccttcggcagaagtactctgccgacagccctctggatcccaaggggattcgcgctgacaaaggactcctgtccgatatgtctgaccaagagtttcatgccaagtatcctacaatctaccaccttagatatcagctgatgcatgaaaaacggcagttcgatgtccgcgagatctacctcgctatgcaccatattatcaagtacagaggccactttctgattgaggacggggccgataacttcgacgcgaaacagatcgatttcttcgaccaattccagcggatggccgctgtgaccgccggactgcccgaactcgagacactggttgtgcctgacgaaacccagagcgatgcttttaagagagtccttttcgacgagtcccagacaaagtctgatcgccaaaaagtgctggccagccagctcctggacattcaggataatcagtccaaggcgatcaaagactttattgccgctcttaccaaggccgttgtgggcatgaaagctaacctggccacgctcaccagcacagccatcgagtctaccgataagaatgactggacaaaaccgctggggcaactggatgacttcctcctgaagcacgaagaggatcttgacgaagacggatatgctctgatcgatgcggccaaccagatgtactccgctgccgtcctcgccgctctggtgcccgagggcatgggctttagcgaagccatgatggcgcggtatgctcagcataagaaacaacttgccctgtacaaacaggtgattgcctctctccctgacaagacccagagacacgagctgaaggatgcttatgccgactacatcgagcatgctgcccagaatccccgcgatgcgttctataaacgggtcacgaaggttctggaaggggtggactccgccgatgctagaacagtgatgaccgccattagccacgacgagtttctcctgaagcaacgcacactttctaacggaaaaatcccttaccagatgcagcagcacgaatttgatgctattatcgagaatcaaaaggcctactatccctggctggcgaccccgaaccctgtcgaagccgacgctaaacggctcccctactatctggatgagcttatcggctttagagtgccttactatgttgggcccatggtgaccgagaagcagtcccagttcgcctggatgattcgcaaagctgacggagaactgacaccctggaatttcttcgatgtcgtggaccgggagaagacggccaacagatttatccagcgcatgcaaaccacagacaagtacattctcggcgaagatgttctgcctaaacatagcatcctgtatcagcagttcgaggtgctcaatgaactgaacaatattcgggtcgagaagcacccgcttaccacagagcagaaacaattcatctaccagagactgtttgtggaccagcaacggaagaccatcacgaaaaagaacctccaggatacactggtcgccatgggggaatttgacaaggctcccgatattggaggcctggcgaaagaggacgtgatgatgtcctctcttgccacctttgctgattacagcaagatcctccctgaagccatttccgaccccacccgccagaacgatatcgaggacattatcgcctggagcacaattttcgaggatacccagatctttttcgacaaactgaagacagttgattggctgacgacccaacagagaaaacggctcgcttctatcagatatacaggctgggggaagctgtccaaacgccttctgcagcagattcctaccagcaagcatacaaatgtgatggccgcgctctgggctacctctgacaactttatgcaaatcctgcaggacgaacagttccaggagggactgtacgatgccaatcggcttcccgaagagacgctcaccccggacgaacaagtcgagaagattctggatgaggcctatctgagccctgctgacaaaaagggcgccagaaaagtgatcaaggttatgaacgatattgtgcgcgcgaatcacggggtcctccccgaacaggtgtttctggagtccgctgacgatcctcagaaaaacaagagacggtctgtgagccgctccaagcaacttgaagagaaatacagacaggccgcccagagcttcatcgacgaagctgttaaggaggagctgaatgcccagatcgtcaactctgctgaatttaatgatcggctcgtgctgtatttcacacaaaacggacgcgacatgtacaccggcaaaagactggatattgagaatcttgggtcctatcagatcgaccatattctcccccagagcctggtgaaggacgattctctggacaaccgggccctcacagcgcgcgatatcaatgccgaaatgtccaaccagtttgtcagcgagagattcggcctgggacctcgggctttctggcaacagcttaaaaataacggcctgatttccgggcgcaagtttagaaacctcgtgatgcagcgggacgaaatcgataagtacgcccccggattcatcaatagacagctggttgagacccgccaaattatcaaaacggtggagcagattatccaccggctgtggccggacattcagatcgtcacaatcaaggctaaccttacccaccaggtgagatctgaactcggctttcctaaagttcgcgagctgaatgattaccatcacgccttcgacgccctgctcgctgcgcggattgggcaatatctgcttgaacattacgccggactgaagccctttttcacatatggcgagtttaaaagaggggataccaagaagtacggcaccacaaacttcctccgccggctgacgaaagacaataaggataaaaagggagagctgcttcccgaagtgagcgactggatcgattccattgactctatctataactacaaaaagattcctgtcgtgtgggagaataccacaaacatgagcgctctgtttgaccagaccatctatccgagacccgatcgcgacacaaccaaacggaagctcattcctacgaagctggataaacccacagacatctacggcgggtactccagcgccaagaccgcctatatggctgttatgagagtgcagaccaaaaagggaacagaataccctgtcttcaatatccccgtgtctattgcctcccaactcaaccggatcaccgatcagacaatgctgaaacaacaggtgaagcagtttattatcaatgcggagcagagcgcttctaagaaaaagctgtatgaatccggcgacgtcattcttagccgcgttgccctcgggcagagattcacggataaaaactacggagaggtgttcctgatctctaatatggaggtgcagaaccctcaaagcctgtggcttggccgggcctcccagcagcgcctgaccagagaacccgaggggaatgaaaagccggagacaagcctcgctgacatctatcagcaaattctgaaacaggtcgatcggtactttctcgccttcaacatcagacagcaacgccagaagctgcttggcaccctggaccagtttacatctctccctgtgggacgggttaacgaacagaccagaacggatcaaaatcagcgctccattatcgcgcgggtgatgattgtcctgggcaaggggagcagagaggagaaattccccgaatttggactgtccgctcttggccgcctggtgcggaccgggggaatcacactctctgaggacgcccagatcatttatcagagccctaccggcctgttcgaaagacgcgttgccctcaaggatctgtga

SEQ ID NO: 4170 - RNA, 4041 nt, synthetic construct
  misc_feature 1..4041: note = Cas9 variant
  source 1..4041: mol_type = other RNA
atggccaagatcctgggcctcgacctggggaccaacagcattggatgggctgtggtcgatatcgagaataacaatgagttcacacttattgagaaaggcgttagaatctttcaggaaggggtgaagattgagaaaggaatcgaaggctccaaggccgcggagcggacgacctaccgctctgctagacggatcaaatatcgcagaaagctgcggaagattcaactcctgggggtgcttagcgagaacggatactgccccttcctgtccaaagacgaactcgattcttggcgctataagaaagtctaccctacaaataagagctttctgaactggcagaaaaccaatgagatccagctggaaaacccgtatttctacagagccctcctggtggagaagaagctcaatctgaacattgaggaagaccggtttaaaatcggccgcgccttctatcacctcgctcagagacggggctttctgtccaatcgcatggaggggacaaaggaaaacgatggaaccgttattaaatctatcacagagattagcaccgccaagggcgacaaaacgcttgggcaatacttctacgaaagatataagaaaggagagaagatccgggatacctacacacatcgcgaggaacactatctggaggaatttgtgagaatctgtgagttccagcagctcgacaataagtttgctgaaaaagtccggaaggccattttctaccagagacccctgaaatcccaaaagggcctgatcgggaaatgcgtgtttgagcctaaaaagagccgctgttctgtttcccggcccgagttcgaagagtatagaatgctctgcttcctgaacaatattaaaatcaagacccctagcgatgaaaaccttcgctttctgacagacaacgagaaagaaaagctcaaaccccagttctttcggaagtctaaggatcatttcgactttgaggatctggtgaaacagcttgcgcctaagaatcagttcaaattttacaagtccagagacattctgccgggaaactggcttttcaattatagcatgaacaccacggtctctggctgtcccatctccgcccgcctgaaagacctgtttggcgagaatttcatggatatcaagtttgactacattcgggaaaaggatgggaaaaagagcgtgatcgacattcacgatatctggcatgtcctcttcacatacgactccgaggaaaaactgaaggagtttgctagaaaccgccttaatctggatgacattaaaatcaaggagttccaacggatccagctcaaaaaggaatatgccgctctgtctcttaaggccattagaaaaatcctgcctttcctccgcgagggactgatttacagccacgcggtgtttatcgccaacatggaaaccgctattccctccgagatctggaataactatacaaatcggaacattatcaagaatgaaatctacaacattatcagcaatcagaccgaggataaacaagttgtggacattgtgaacggcatcattaagtcttccagaatcgagaacagcgtctggtctaatgaagccgtggagttctttaaaaaggatctgaacagcaagatcaaaaattattacgggattaagacctataacgacttccctgaagagaaaaagatccggattgaaacatacgcttttaatctcttcaaacagcagatgatgaagaactttggacgcggcgagttcgccgccgttcagagaatcgacgagcggctgaaactttttctgacggataatttcaacattgaccccatcctcctgaagaagatctaccacccgtccgctattgaagtgtatcaacctcccgtcagaaagaatgatgggaagctgtaccttggatctcctatggtgagctccatccgcaaccccatggcgatgcgggccctccatcagctgagaaaactgattaatgagctcatccgcaaggaactgattgacagcaacaccaaggttaatatcgagatggctagagaacttatgaacgccaatgagcggaaagcctatcagaactggcagaacgatcgcgagaagatcagaaaagaatacgctctgaagattaaacaacacctcgacgtggataaggagccctctgacgtcgatatcctgaaatatcagctgtgggaggaacagaatcataagtgcatttacacaggcaaggagatcaacatttccgactttcttggcagcaatcctaaattcgatatcgaacacaccattccgcggtctatctcctttgacaacagccagtccaataagacactctgtgagaactatttcaatcgctctgtgaaaaagaacagaatccccgccgcgctgcctaatcacggggaaattatcgagcggctggaaaactggaaactcaagtacgaggagctggaaaagcaaattcagtacgctgtccgccaggccaaaggagccggcgataaggacagcaaagacagagctatccagaagcggcataaacttaagttcgagtatgattactggaagaataaatatgaccgctttgtgatggaagatgttcccgaggggttcaagaactcccaactggtggacaccggaattatcacgaaatactctagaatgtatctcaatacactgtttgataaggtctacaccgtgaaaggcaacaccgttgccgacttccggaagctgtgggggatccaggatgaatatgagaagaaagctagagtgaatcacagccatcactgcgtcgacgccattacaatcgcgtgtattaccaagtccaactacgagaaccttgccaaattttaccatgattgggaggaactccacgtgaagggcatcgaccagctgcctcccatgaataaaccgtggaagacattcacggaagatattaaggctatccaatatgagatcctggtgagccactacacccctgacaacctccccaaacagtctaagaaaattctgcgcaagaaaggacggatccagaagaatgaaaacggcaatcctatttatcttaaaggggatacagttagaggatccctgcatcagcaaaccttttacggcgccatcgagaagacagaggtcaacaagaaaggggaacccgagaaggtgattaaatatgtggtccgcaagagcctcgacgtgctggacgattcttccgttaaaaatatcgtggacgatattgtcaaggaaatcgtgcagaacgctcggatcaaggagaaagacttcattaaggagctggaaatccagaaaagaaaacttgccaaggcggaggaaaataaggttgtgcagattcaagccgagatcgataagctcaacaaacaggtcgctgacctgtacaccatgcctaataagaacggaaatcccattccgatcaaaaaggtgcgcatctttcagacgagcgttaccaaccctattcacctgaaacagcaacgggataagtctcagaagacaagcaaaccccataaggagttctattacgccgctaatgactccaactacatgatggccatctatgaaggcaaagatgagaaggggaaagtgaagagagactttaaactcctgaataaccttgaagccggcgagttcttcaagtacagcgtccacaaggatctgaaagaaaagaacctcgagaatattcgcaacgtgatccccgacaaagtgtctgctggaaagattgaaatccctctgaaagcgatcattaagaccggcacaatggtcatcctgtgggaaaattccccggacgaggtttgggatcttaccattagcgaagtggacaagcggctgtataaagtggtcgggatgtccgtgaacagaatcaagtctgatgttaaaacgtttgagttcggaaatattgtgctccggcacaacaaggaagccagccccgctacactgctcaaaatccaggacggcgagtttaagtccgatgaaaattacattgcccaacgcaagctgtctcataaccagttcaatgcccttgtcgagggggtggactttagcctgtccgttctcggagagatcaaaagactgaagtga

SEQ ID NO: 4171 - RNA, 4044 nt, synthetic construct
  misc_feature 1..4044: note = Cas9 variant
  source 1..4044: mol_type = other RNA
atgggcgaggacgggaagcccgtgagagtcaaaggaaagaccgccatcggcgctcggctgttccaggaagggcacgttgccgcggatcgcagaatgtttcggacaacgcgcagacggctcaaccgcagaaaatggcggctgaaacttctggacgagattttcgatccttacatcaccccggtggacagcacatttttcgctcgcctcaaacaatccaatctgtctcccaaggatagcagaaaggaatttaaaggatccatgcttttccctgacctgaccgataagcagtatcatgaggactaccccacaatttatcacctccggcgcgccctgatgaccgaagataaaaagtttgacatcagaatggtgtacctggccattcatcacatcgtcaaatatcggggcaacttcctcaattctgctacagtggatacctttaaggccagcaaggttgacttcaaaaagtcctttaaccagctgaatgagctttactctgctatcaaccctgaggatgccttccaggtggacatgaataaaagcgacgaaacggggcgcctgtttctcgattccagcattagaaagttcgacaaacaaaagcagatctctaaactgattcccgtcgtggttgaggataaggaagcgaagaaacttaacggaaagatcgccctggagattaccaaagctatcctcggctataagtccaaactgaatgtggtcacacagaccgagcctgaagacccgaagaagtgggccgtgaaattcgatgacgaggatattgacagcaagctgaacgatatcctccccgaaatggacgagaatcagcaatctatcgtggaaattatccaggatctgtactcccaggtcacacttaaccagattgttcctaatggcatgagcctgtctgactccatgatcaaaaagtacaacgaccatcacgagcacctcaaactgtataagaaacttattgataatatcagcgacaccaaaaagcggtccgctctgaaaacggcctacgataagtatgtgggggacgatggaaaaacaatcgagcaagacgaattttactctaacgtgaagaagaacctcgatgacagcgatctgtccaaacagattgcggacctgatcgaggccgaaaagttcatgcccaaacagagaaccagccaaaatggcgtcattcctcatcagctccaccagcgcgagctggatgaaatcattgagcatcagtctaagtattacccctggtttgctgaggccaacccgaataaacacgaccttcacctggctaagtataaaatcgaggagctcgtggccttccggatcccttactacgttgggcccatgattacacctgaagatcaagagaagtccagccagaccatctttgcctggatgaagagaaaagaacccggacagattaccccctggaacttcgacgagaaggtggaccgcatggagtctgctaatcggtttatcaaaagaatgacaacgaaggatacctatctgattggcgaagacgtccttcctgatcagagcctgctctacgagaaattcaaggtgctgaacgaactgaatatggttcgcgtgaacgaccatccgctcaaggtctccgagaaacaagcgatctatcgggatctgtttgagaatcagaagagaatttctgtgaaaaaccttcagaattacgtcaagagcaaatccgggctgcccacaggacctaagatcagcggcctctctgaccccgatcacttcaactccagcctgggcacctataatgactttaagaaaatgttcggggataaggtggacgatcctgacctgcaggatgactttgaaaagatgatcgagtggtctacaattttcgaagacaagaaaatccttcgcgccaagctcgatgaggttgcttggctgtccgacacccaaaagaacgagttcaaagaaattcggtaccagggatggggcagactgagcaagaaactcctgacggggatcgtggatggaaatggccagcgcattatcgacgagctttggaacacaaacaagaattttatgcagatccaatccgatgactctttcgccaaacggattcatgaagccaacgctaatcagatgaaggccaccgatgtcgaggacgtgctggcggatgcttataccagcccccagaacaaaaaggccatcagacaagttgtgaaggtcgtggacgatattcagaaagccatgggaggagtggctccgaagtttatctccattgagttcacacggtctgaagaccgcaatcctagacggaccatcagcagacagcgccagctcgaaaacacactgaaagacacggcccaagctctggttaagtccatcaatcccgatattcttagcgagctcgacaacgcctctaaatccaagaagggcctgaccgatcggctgtacctctactttacacagctgggcaaagacatgtataccgggaagcctatcaatattgatgagatcagcaactacgacattgatcacatcttcccccaggcgtttatcaaagacgattctcttaataacagagtcctggtgtccaaggccggaaataacggcaaaagcgctaatgtgcctctcaagctgttcggggccaagatgggaggctattggaaacagctggctgacgccgggcttattggccaacgcaagctcaaaaacctgcagacaaaccccgataccatctctaagtttgcgatgcatggattcattagacggcagctggtcgaaacgagccaggtgatcaaactcgttgccaatattctgggcgacaagtaccgcaacgatgacaccaagatcattgagatcacagctagaatgaatcaccaaatgcgggacgaatttgggttcatcaaaaaccgcgagattaatgattatcaccatgcctttgacgcttaccttaccgccttcctgggacactatctctaccatagatacatcaagctgcggccgtatttcgtgtacggcgattttaaaaagttccgcgaagacaaagtcacaatgagaaactttaatttcctgcacgatcttaccgacgataagcaggagcggattgccgacacggagacaggggaagtgatctgggatcgcaagagatccattcagcaactccgggacgtttatcactacaaatttatgctgatcagccaggaggtgttctctctgaacaaggaaatgtttaaacagaaactcttccctgctaccctggcgaagaagtccaaacttatccagattaagaaggataaacccgtcgacatctatggaggctacagcaataacacagatgcctatctgaccgtggttaagctcaaagggtccaaggaggacaaatacaagattgtgggcgtccccatgagagctctggacaatctgaagcatgccgagaaagaatctcctcaaagctacaccgccgagcttcgcaaggctctggaaccgcagtttacaaaaatcaagaaaaaccggaagacgggagaggtgtccaaggtggtcaccaatttcgatattgttctcggcagactgttttatcgccagatggtgatcgacgggtctgaaaagagcctcatcgcctcctctgtgtaccagtataacgcgaagcaactggtccttagcgatcaggctattcggacaatctccgaccaggagggaattgatgagttcgaactgagctctcagtacgacaaagtgtatgatgagatcgttcaaaaggtggaaaaactcctgcccattttccagcacagacattttcaggagcgcctgaataacggcaagtcccttttcgtcaacctgcctgtgcacgacgtttacgaagggaataagctcgaacaggtggggaaaaagcatatcattaacagcatcctgggcgggatccacgccaatgccgatcggcccgacattgatctctttggcatcaaaaacctgggacaattctcttccaccagcggcattaatctttcttccgacgctatcatttgctatcagagccctacagggctgtttgagagacgcgtcgtgctcaaggacctgtga

SEQ ID NO: 4172 - RNA, 4044 nt, synthetic construct
  misc_feature 1..4044: note = Cas9 variant
  source 1..4044: mol_type = other RNA
atgaccaagagagaggaaccctacaacgtgggcctggacatcgggagctcctctgtcggatgggccgttgtggataataactatcacctcctgaatattaaaaagaacaatctttggggcgctcggctgttcaaagaggccgaaacagctcaggtgacgcgcgggcatagaagcatgcggcgcagataccggcgcagacggaaccgcctcaattggctggacgagctttttgcggatgaactggccaagatcgacccttccttcctcctgagaatgaaaaactcttgggtcagcaagaaggagtccacccggaaacgcgatccgtataatctgtttattgacgagaagtacaacgatgtggactatttcaatcaataccccacaatctttcacctcagaaaagaactgattaccgaggataagaaagttgacatccggcttatctatctggccattcataacatcattaagtaccgcggaaatttcacactcgaaaaccagaattttgatatctctcagctgagctccaacttcagccagcaaatttctgactttttcgctctgttttccgatttcggcgtgatcatgcctgaggactttgaccccgataagattagcgacatcctgctcaaccctaatctgtctccctccgggaaagtcagcgaggccatcgctaccatttctcctaagacaaacgtgaaagccaagatcaaaattatcctgctcctgcttgttggaaataacggcgatctgaagaaactcttcgacctggaaaccacggagaagattgcggtgaaactttccagcagacacatcgattccgaactgccgatcattctctctgagctgaatgaacagcaggagaacatcattaccatcgccaatagcattttcggctccatcatcctgaaagactttctcggggatgagacaagcatttctgctgccaaggtcatctccttcgaagaccataaacaggatctgcaaaaacttaaaaccatgtggcgggagacaagcaacaaggaagctgtgaaggccggaaagaaggcgtacgaggactatattggccacgaagattctgagaccttttacaaaaagatcaaaaagttcctggagaaggcccagcccgtggacctcgctaataaagccctggctgaaattgagcttgaaaactatctgcctaagcagagaaatcgcaacaatacggtcatcccctaccagctcaacgagaatgaactgattgccatcctggaccaccaagagaaatattacccttttctcaaggagaaccgggataaaatcctgagccttctgacattccgcattccctattacgttgggccgctccaggactccaacaataacagattttcttggatgacccggaaggccagcggagctatcagaccttggaatttctccgaaaaggtgaacgtggagcagagctctaatgattttattaaacgcatgcggtccacagacacctacctgatcggcgaacccgtcctgcctaagaaaagccttatttatcaatgctacgaggtgctctctgagctgaacaataccagagttaaggatgggtccagcaaccccaaacgcctggacgtgacaatcaagcagcggatctataatgaaattttcaaaaaccagaagtccgtctctgtgaaggttctccagaattggctgatcaaagagagctactttaagtcccccgaaatttctggacttgcggataaaaagaaatatctgagctccctcagcacgtacatcgacttcaagaagatttttggccaaagattcgtggatgaccctgtcaactctccgcagctggaggaactggccgagtggcttaccctcttcgaggataaaaagatcctgctgatcaaactccaaaattccaagtatagctacgaccaggctacaattaacaaactgtctaccatgcgctaccagggcacagggaaactttccaagaagctgctcgtggatctgaagaccacgaaaaagagcatcggaaaatctggcgccgaaagcctgtccattcttgacctcatgtggagcacaaaggacaattttatgcagatcattcatgatgccgactataccttcgagcagcagatcaaggaatttaactacgataccgaggacgaactgacacccctggagaaagtcgctaacctccacgggtctcctgccctgaagcggggacttaatcaatccatcaaagtggttgcggatattgtgaagttcatgggccatgaccccgagaaaatctttattgagttcaccagaagcgatgacttttccaagctgacaatctctcggtatcgcagaattaaaaagcagtacctcgaaatcgctaaggccattaaaaagatccctgccgagttcaaagatatcaaggaatatcagacgcagctggaagagaacaaagggaagctggctagcgagcggcttatgctctactttctgcaatgtggacactccctgtattctaataagcccattgacctcaacatgatcaatagctccaaataccacgtcgatcatattctgccgcagtcttacatcaaggacgatagccttgaaaacaaagccctggtgctcgcttccgagaatgaaaacaagattgacaatatgctgatcagccacgacatcattgccaccaacctgcctagatggcaggcgcttaaagatcaaaatctgatgggctctaagaagttcgccgacctcacacgcaccacagttaccgagaaccagaaaaagggctttatccagcggcagctggtgcaaacgtcccagattgtcaaaaatatcaccctcattctgaacgatctttataagaatacaagctgcatcgagaccagagctacactgtcttccgagttccgcaaagcctttagcaacttcgacgaaaccacgtaccattatcagttccccgaatttgtgaagaacagagatgtgaatgacttccaccatgctcaggatgcctttctcgcgtgtgttatcggggagtaccaactgaagaaatatcctaaggacaacctgcggcttgtctacgatcagtattctaaattcctggactccctcaagaaagatacacgcaagaagaatggaagaatgccccggtacacccagaacggctttattatcgggagcatgttcaatggaaaaacatacgtggacgacaacggcgaaattatctgggatcagaagattaaagagtccatccgcaagacctttaattatcaccaattcaacgtggtcagacagaccattgagcagcacgggaaactgtttaatgacacaatccaacctcatagcgatcggtacaagctcatccccctgaaaacgaaccgcgacccggccatttatggcggatacaataacgataataacgcttattctgtggttcttgacgtggatggcaagaagaaaatcaatgggattcctatcagaattgccaaccagcttaagagcgacgaactcgatctgtcctcttggctggagaataacatcaaacacaagaaacccatgaccatccttattgacaaggtccccaagtaccagcggatcattaacgaagagacaggagatctgctcatcaccagcgctaatgaagtgattaacaatgttcagctgttcctcccttccatgtatacagccctgatctctcttctggacagcaccaaaacggagatgtactccaagctgctctctaactacgaggccaatatcctgattgatatctatgactaccttctgacaaaactcaagaacaattatccgctgtaccgcaaagaatgggctaagctcgcggagcatagagacgattttattgaaagcgacctggtgacccaagcctccacccttcagcagctgatcaagttcatgcacgctgatcccagcaacgtcaatctgaaattcggcaactttaaggggaatcggttcggaagaaagaacggcaatattaagctctctaaaacagactttatctatgagtcccctaccgggctgttcaagagcattaagcacatcgattga

SEQ ID NO: 4173 - RNA, 4044 nt, synthetic construct
  misc_feature 1..4044: note = Cas9 variant
  source 1..4044: mol_type = other RNA
atgaagtccgagaaaaagtactatatcggcctggacgtggggaccaactccgtcggatgggccgttacagatgagttctacaatattctcagagctaaaggcaaggacctgtggggagtgcggctttttgagaaagccaagacggcggctgatacccgcacattcagatctgggcggcgcagaaacgaccggaagggcatgcgcctgcagatcctcagagaaatttttgaggatgaaatcaaaaaggtggacaaagatttctatgaccggctggatgagagcaagttttgggccgaggacaaaaaggtctccgggaagtactctcttttcaatgataaaaactttagcgacaagcaatatttcgaaaaatttcccaccattttccatctgcgcaagtacctcatggaggaacatggaaaagtggatatcagatattactttctggccatcaatcagatgatgaagcggcgcggccacttcctgattgacggccagatctcccatgttacagacgataaacctctcaaggagcagctgattcttctgatcaacgacctcctgaagattgagcttgaagaggaactgatggattctatctttgagattctcgctgacgtgaatgagaaaagaaccgataagaaaaacaatctgaaggaactgatcaaagggcaagacttcaacaagcaggagggaaatatcctcaacagcattttcgaatccatcgtcacaggcaaggccaaaattaagaatatcattagcgatgaggacatcctggagaaaatcaaggaagataacaaagaagactttgtgcttaccggggattcttacgaggagaatctgcagtatttcgaagaggttctccaggaaaacattacgctgtttaacacccttaagtccacatacgacttcgtgatcctgcaaagcattctcaagggaaaatctaccctgtccgacgctcaggtcgagcggtatgatgaacacaagaaagacctggagatcctcaagaaagtgattaagaagtacgatgaggacggcaaactgtttaaacaggtgttcaaagaagataatgggaacggatatgtcagctacatcggctattaccttaataagaacaaaaagatcacagccaaaaagaagatttctaatatcgagtttaccaaatacgttaagggcattctggaaaaacagtgcgactgtgaggatgaggcggtgaagtatctcctggggaaaatcgaacaagagaacttccttctgaagcagatttccagcatcaattccgtgattccgcatcagatccacctctttgaactggacaagatcctggagaacctcgccaaaaattacccctctttcaacaataagaaggaagaatttacgaagattgagaaaatccgcaagacattcacctttcggattccttattacgtcggacccctgaacgattatcacaagaataacggcgggaatgcttggatcttcagaaacaaaggagaaaagattagaccttggaacttcgagaaaatcgtggaccttcacaagagcgaagaggaatttatcaaacgcatgctgaatcaatgcacatacctccccgaggagaccgttctgcctaagagcagcattctgtattctgaatacatggtgcttaacgagctcaataacctgcggatcaagggcaaaccgctggataccgacgtcaagctcaaactgattgaggaacttttcaagaaaaagacaaaagtgacgctgaagtccatcagagattacatgattcgcaataactttgccgacaaggaagacttcgataatagcgagaaaaacctcgagatcgtttctaatatgaaaagctatatcgactttaacaatattctgggggataagttcgaactggagatggtggaagaccttatcgagaagattaccatccacacaggaaacaaaaccctcctgaagaagtacattgaggaaacatatcccgatctgtcctctagccagatccagaaaatcattaatctcaagtacaaagactggggccggctgtccagaaaacttctggatggcatcaaggggcgcaacaagaccgacgatgtcaatacggtgattaactttatgcggaacagctctgacaatctcatgcagatcattgagggaaagaactattccttcaatgaatacatcgataacctgcgcaaaaagtatattcctcaagagatcagctacgaagtcgtggagaatctgtacgtttctccctccgtgaaaaagatgatctggcaggtcattagagtgacagaggaaatcaccaaagttatgggctatgaccctgataagatttttatcgagatggctaagagcgaagaggagaaaaagaccacaatttcccggaaaaacaaacttctcgacctgtacaaggccatcaagaaggacgaaagagattctcagtatgagaaactgctcaccgggctgaataaacttgacgaaagcgagctgcgctccaagaagctctacctgtattacacacagatgggacgggatatgtatacgggcgagaaaatcgacctggataaacttttcgactctacccattacgataaggaccacattatcccccaaagcatgaagaaggatgactccattatcaacaatctcgtgctggtcaacaaaaatgcgaaccagacaaccaaggggaatatttacccggtgcctagctctatcagaaacaatcccgatatctataactactggaaatatctgatggaaaaggaatttatttccaaagagaagtacaaccggctcatccgcaatacacctctgaccaacgaggaacttggcgtgttcattaatagacagctggttgagacgcggcagagcaccaaggccatcaaagaactctttgagaagttctatcaaaaatctaagattatccccgtcaaagcctccctggctagcgacctgagaaaggacatgaacacacttaagtctcgcgaggtgaatgatctgcaccatgctcacgacgccttcctcaacattgtggccggagatgtctggaatcgggaatttaccagcaaccccatcaattacgtgaacgagaatagagaaggcgacaaagttaagtattccctgagcaaatacttcacacgccctagaaagtctaaagggaaggtgatctggaccccggagaagggacggaaactcattgtcgatacgctgaacaagccctccgtgcttatcagcaatgaatcccatgttaaaaagggcgagctgtttaacgctacaatttctgggaaaaaggactacaaaaagggaaagatctatctccctctgaaaaaggatgaccgcctgaaagatgtgagcaagtacggcgggtataaagcgattaatggcgccttctttttccttgtcgagcacaccaagtccaagaaaagaatccggtctatcgaactgtttcccctccatctgctcagcaagttctacgaggacaaaaacacagtgctggattatgctattaatgttcttcagctgcaggaccctaagatcattatcgataaaattaactaccgcaccgaaatcatcattgacaacttttcctatctcatctctaccaagagcaatgacggatccattacagtgaagcccaacgagcagatgtactggagagtcgatgaaatcagcaatctgaaaaagattgagaacaaatacaagaaagacgccatcctgacggaggaagatcggaagattatggagtcttatatcgacaagatctaccaacagttcaaagccggcaagtataaaaatcgcagaaccacagataccattatcgaaaagtacgagattatcgaccttgatacactggacaacaaacagctctatcaactgctcgtggcttttatttccctgagctacaagacctctaataacgccgtggatttcacggtcatcgggcttggaacagaatgtggcaaaccgcggatcaccaatctgcctgacaacacctatctggtttacaagtccattacagggatctacgagaagcgcattagaatcaaatga

SEQ ID NO: 4174 - RNA, 4047 nt, synthetic construct
  misc_feature 1..4047: note = Cas9 variant
  source 1..4047: mol_type = other RNA
atgaagaaaccctacaccatcgccctggacattggcacaaacagcgtggggtgggtcgttgtgacggatgactatagagtgcctaccaagaaaatgaaggtcctcggaaatacagagcggaaaaccatcaagaagaacctgattggcgcccttctgttcgattccggggacacagccgaaggaacccgcctcaaaagaacagcgcggcgcagatacacccggcgcaagaatagactgcggtatcttaaagagatctttacggaagagatggctaaggtggatgacggcttctttcagcgcctggaagattctttctacgttctcgaggacaaagaggggaacaagcacccgatttttgccaatctggccgatgaagtggcttatcataagaaataccccaccatctatcacctgagaaaggagctcgtcgacaaccctcaaaaagccgatctgcggcttatctacctggctgtggcccatattatcaagttccgcggacactttctcattgaaggcacactgagctccaaaaataacaatcttcagaagtctttcgaccatctggttgatacctacaacctcctgtttgaggagcagagactgctcacagaaggcatcaatgcgaaagagctgcttagcgccgctctgtccaagtctaagcggctcgaaaacctgattagccttatccccgggcagaaaaagaccggaattttcggcaatatcatcgccctgtccctcgggctgacgcctaactttaaagctaatttcggactgagcaaggacgtgaaactccaactggccaaggacacatatgcggatgaccttgattctctgctcgcccagattggcgaccagtacgctgatctgtttcttgccgctaagaacctgtccgacgccatcctcctgagcgatattctgaccgagtctgacgaaatcacacgcgctcccctctccgctagcatggtcaaaagatatcgggagcaccacaaggatctggtgacccttaaaaccctgattaaggaccagctccctgagaaataccaagaaatcttcctggataagacaaagaacgggtatgcgggatacatcgagggccaggtgtctcaggaagagttctataaatacctgaagccgattcttgccagactcgacggctccgaacccctgctgctcaaaatcgaccgcgaggattttctgcggaagcagagaacgttcgacaatgggagcattcctcatcaaatccaccttgaggaactgcatgctattctccgccggcaggaggtcttttaccccttcctgaaagataacagaaagaagatcgaatccctgcttacctttcgcatcccttattacgttggacccctcgcccggggccactctagattcgcctgggtgaaacgcaagtttgacggggctattcggccgtggaatttcgaggaaatcgtggatgaggaggccagcgcgcagatttttatcgaaaagatgacaaagaacgacctgtatctgcctaatgagaaagtcctccccaagcactccctgctttacgaaaccttcacagtgtataacgagctgaccaaagttaagtacgctacggagggaatgacaagacctcaatttctcagcgccgatcagaagcaggccattgtggacctgctgttcaaaaccaatcgcaaggtcaccgtgaaacagcttaaggaaaactattttaaaaagatcgagtgctgggattctgttgaaattacaggcgtggaggactccttcaatgctagcctcgggacctaccatgatctgctgaagatcatccaagacaaagatttcctcgacaaccccgacaatcagaagattatcgaagatattatcctgacacttacgctgtttgaggacaaaaagatgatttctaaacggctcgatcagtacgcccacctgttcgacaaggtcgtgctgaacaaacttgagagacatcactataccggatggggccggctcagcggcaaactgatcaatgggatccgcgataagcagtccggaaaaacaattctggactttctcaaggctgatggcttcgccaacagaaattttatgcaactgatccatgactctgaacttagcttcattgatgagatcgcgaaagcccaggtcattgggaagaccgaatactccaaggacctggtgggaaacctcgctggcagccccgccatcaaaaaggggatctctcagacaattaaaatcgttgatgagctggtgaagattatgggctatctgcctcagcaaatcgtcattgaaatggctcgggagaaccagaccacggcccagggaatcaaaaatgcgagacagcgcatgcggaaacttgaggaaaccgccaagaagctgggctccaacatcctcaaggagcacccggtggacaatagccaactgcagaacgataaaagatacctctattacctgcagaatgggaaggacatgtatacaggagacgatcttgacattgattacctgtcttcctacgacatcgatcacattatcccccagagctttattaaaaacaattccatcgacaacaaggttctcacctctcaaggcgctaatcgcgggaaactggataacgtgcctagcgaagccattgtcagaaagatgaagggatattggcagtccctgcttcgggctggcgccatctctaaacagaagttcgacaatctgacaaaagccgagcgcgggggcctcacccaagtggataaggctggatttatccagagacagctggtggaaacgcggcagattacaaaacatgttgcgcaaatcctcgacagccgcttcaacaccgagtttgatgaccacaataagcggattagaaaggtccatatcattacactgaaatccaaacttgtgagcgacttccgcaaggagtttggcctgtacaagatcagagatatcaaccactatcaccatgcccacgacgcttacctcaatgccgtggtcgccaaagctattctggggaagtatccccagctggcccctgaatttgtgtacggagattatcccaagtacaactctttcaaagagcggcagaaggcgacccagaaaatgcttttctactccaacatcctgaagttctttaaagaccaagaaagcctccatgttaattctgatggcgaggagatttggaacgctaataagcatctgccgatcattaagaacgtgctctccatccctcaggtcaatatcgtgaaaaagaccgaagttcagacagggggattctataaagagagcattctgtctaagggcaacagcgacaaacttatcccccgcaagaataactgggatacgagaaaatacgggggctttgactcccctaccgtggcctatagcgtcctggtgattgccaagatggaaaagggaaaagctaaggttctgaaacccgtgaaggagatggtcggcatcacaattatggaacggaccgccttcgaggagaatcctgtggtgtttctcgaagcgagagggtaccgcgagatccaagaacacctgattatcaaacttcccaagtattctctgttcgagctcgaaaacggacggagacgcctgctcgcttccgccagcgagctgcagaagggcaatgagctttttctgccggtcgattacatgacattcctgtatctcgccgctcactaccacgaactgaccgggtcctctgaggacgttcttcggaaaaagtactttgtggatagacatctgcactatttcgacgatatcattcagatgatcaacgacttcgccgaacgccatattctcgctagctccaatctggagaaaatcaaccacacgtaccataataactctgacctccctgtgaacgaacgggccgagaatattatcaacgtctttacattcgtggcgctgggagcccccgctgcctttaagttctttgatgctaccatcgacagaaaacgctataccagcacaaaggaggttcttaatgccaccctgattcaccagtccgtgacaggcctgtacgaaacgcggatcgatctctctcaactgggggagaactga

SEQ ID NO: 4175 - RNA, 4047 nt, synthetic construct
  misc_feature 1..4047: note = Cas9 variant
  source 1..4047: mol_type = other RNA
atgaaaagcgagaaaaagtactatatcggcctggacgtggggaccaactccgtcggatgggccgttacagatgagttctacaatattctcagagctaaaggcaaggacctgtggggagtgcggctttttgaaaaagccaagacggcggctgatacccgcacattcagatctgggcggcgcagaaacgaccggaagggcgtgcgcctgcagatcctcagagaaatttttgaggatgaaatcaaaaaggtcgacaaagatttctatgaccggctggatgagagcaagttttgggccgaggacaaaaaggtgtccgggaagtactctcttttcaatgataaaaactttagcgacaagcaatatttcgaaaaatttcccaccattttccatctgcgcaagtacctcatggaggaacacggaaaagttgatatcagatattactttctggccatcaatcagatgatgaagcggcgcggccacttcctgattgacggccagatctcccatgtgacagacgataaacctctcaagcagcaactgattcttctgatcaacgacctcctgaagattgagcttgaggaagagtttatggattctatcttcgaaattctggctgacgtcaatgagaaaaagaccgaaaagaagaacatcctcaaagagctgatcaatgcccaggatttcaacaagcaggaggggaagattctgtacagcatctttgaatccattgtgacaggaaaagctaagatcaaaaatattatcagcgacgaggatatcctcgaaaagattaaagaggacaacaaggaagatttcgttctgaccggcgactcttatgaggagaatcttcagtactttgaagaggtgctgcaagaaaacatcaccctcttcaatacgctgaagtccgcctatgattttgtcattcttcagagcatcctgaaagggaagtctacactctccgacgcccaggtggagagatacgacgaacacaaaaaggatctggagattctgaaaaaggtgatcaagaaatatgacgaggatggaaaactcttcaaacaggtctttaaggaagacaacggcaacgggtacgttagctatatcggatactacctgaataaaaacaagaaaattaccgcgaagaagaaaatctctaatattgagttcacaaagtatgtgaaaggcatccttgaaaagcaatgcgattgtgaggacgaggatgtgaaatacctgctcggcaagattgaacaggagaactttctgcttaagcagatctccagcattaattccgtcatcccgcatcaaatccacctgttcgaactcgacaaaattctggagaacctggctaagtattacccctcttttaataacaaaaaggaagagttcaccaaaatcgagaagattcggaagacgtttacattccgcatcccttattacgtggggcccctcaatgattatcacaaaaacaatggaggcaacgcctggattttcagaaataagggggaaaagatccggccttggaactttgagaagatcgttgacctgcataaaagcgaagaggagttcattaagagaatgcttaatcagtgcacctacctgcccgaagagacagtgctccctaagtccagcatcctgtactctgaatatatggtcctgaacgagcttaacaatctccgcattaacggaaaaccgatcgataccgacgtgaagctgaaactgattgaggaactctttaagaaaaagaccaaagttacactgaagtccatccgggattacatgatcagaaataacttcgctgacaaggaagactttgataatagcgagaaaaaccttgagattgtgtctaatatgaaaagctatatcgacttcaacaatattctgggcgataagtttgaactcgagatggtcgaagacctgatcgagaagattacgatccacaccgggaacaaaaagctgcttaagaaatacatcgaggaaacatatcccgatctctcctctagccagattcagaagatcattaatctgaaatacaaggactggggacgcctgtcccggaaactcctggatggcatcaccggcacaaacattgagaccggggaaatcgacacggtgattaatttccttagaaacagctctgataatctgatgcaaatcatcggatcccagaactatagctttaacaatgacattgataagctccgcaagaaatacatccctcaggagatttcttacgaagtcgtggagaacctgtatgtttcccccagcgtgaagaaaatgatctggcaggtcattcggatcacagaggaaatcaccaaggtgatgggctacgaccctgataaaattttcatcgagatggccaagtccgaagaggggaagaaaaccacaatttctagaaagaataaactgcttgcgctctataaggccatcaaaaaggacgaacgcgacagccaatacgagaagctgctgaccggactcaacaaactggatgactccgatcttcggtctagaaagctgtatctctactatacacagatgggccgcgacatgtacacgggggagaaaattgatctggacaagctgtttgatagcacccattacgacaaagatcacatcatcccccagtccatgaagaaagacgatagcattatcaataaccttgttctcgtgaataagaacgctaatcagacaaccaagggcaacatttatccggtcccttcttccatccggaataaccccaaaatttacaattattggaagtacctgatggaaaaagagttcatcagcaaggaaaaatataacagactgattcggaatacacctctcaccaacgaggaactgggaggctttatcaaccgccaacttgtggagacgagacagtctaccaaggccatcaaggagctgttcgaaaaattctacaagaaatccaagattatccccgtgaaagctattctcgccagcgacctgcggaaggacatgaatacactgaagtctagagaggttaacgatcttcaccatgcccacgacgcttttctgaatatcgtcgcgggggatgtgtggaaccgcgagttcaccagcaatcccattaactatgtgaaagaaaatcgggagggagacaaggtcaaatactccctcagcaagtactttacaagacctcgcaaatctaagggcaaggtgatctggaccccggaaaaagggagaaagctgatcgttgatacgctcaacaaaccctccgtgctgattagcaatgagtcccatgtcaagaaaggagaacttttcaacgccacaatcgctggcaagaaagactataagaaggggaaaatttacctgcctctcaagaaagatgaccggctgcaggatgtgtctaagtatggcggatacaaagccatcaatggcgcctttttctttctggttgagcacaccaagagcaagaaacgcattagatccatcgaacttttccccctgcatctcctgtctaagttttatgaggacaaaaacacagtgctcgattacgctatcaatgtcctgcagcttcaagaccctaagattatcattgataaaatcaactatcggaccgagattatcattgacaatttcagctacctgatctccaccaagtctaacgacgggagcatcacagtgaagcccaatgaacagatgtactggcgcgttgatgagatttccaacctcaaaaagatcgaaaacaaatataagaaagacgccattctgacggaggaagatagaaagatcatggagagctacattgacaagatctatcagcaatttaaagcgggaaagtacaaaaatcggcgcaccacagataccatcattgagaagtatgaaatcattgacctggatacacttgacaacaaacagctgtaccagctcctggtggctttcatctctctctcctataagaccagcaataacgccgtcgatttcacggtgattggcctggggacagagtgtggaaaaccgagaatcaccaatcttcctgacaacacctacctggtgtacaagtctatcacaggcatttatgaaaagcggatccgcattaaatga

SEQ ID NO: 4176 - RNA, 4047 nt, synthetic construct
  misc_feature 1..4047: note = Cas9 variant
  source 1..4047: mol_type = other RNA
atgaaaagcgagaaaaagtactatatcggcctggacgtggggaccaactccgtcggatgggccgttacagatgagttctacaatattctcagagctaaaggcaaggacctgtggggagtgcggctttttgagaaagccgatacggcggctaacacccgcatcttcagatctgggcggcgcagaaatgaccggaagggcatgcgcctgcagattctcagagaaatctttgaggatgaaattaagaaagtggacaaggatttctatgaccggctggatgagagcaaattttgggccgaggacaagaaagtctccgggaagtactctcttttcaacgataagaattttagcgacaaacaatatttcgaaaagtttcccacaatcttccatctgcgcaaatacctcatggaggaacacggaaaggtggatatcagatattactttctggccattaaccagatgatgaaacggcgcggccacttcctgatcgacggccagatttcccatgttaccgacgataagcctctcaaagagcagctgatccttctgattaatgacctcctgaagatcgagcttgaagaggaactgatggattctatttttgagatcctcgctgacgtgaacgaaaagagaacagataaaaagaataacctgaaagagctgatcaaggggcaagacttcaataaacaggagggaaacattctcaatagcatcttcgaatccattgtcaccggcaaggccaagatcaaaaacattatcagcgatgaggacatcctggaaaagattaaagaggataataaggaagactttgtgcttacaggggattcttacgaggagaacctgcagtatttcgaagaggttctccaggaaaacatcaccctgtttaatacgcttaaatccacctacgacttcctgattctccaaagcatcctgaagggaaagtctacactgtccgacgctcaggtggagcggtatgatgaacacaaaaaggacctcgagattctgaaaaaggtcatcaaaaagtacgatgaggacggcaagctgtttaaacaggtgttcaaggaagataacgggaatggatatgtgagctacatcggctattacctgaacaaaaataagaaaattaccgccaagaaaaagatctctaacattgagtttacaaagtacgtcaaaggcatcctcgaaaagcagtgcgactgtgaggatgaggacgttaaatatctgcttgggaagattgaacaagagaatttcctgctcaaacagatctccagcattaactccgtgatcccgcatcagatccacctgtttgaactggataagattctcgagaatctggcgaagaactacccctctttcaataacaaaaaggaagagtttaccaaaatcgagaagattcgcaaaacgttcacatttagaatcccttattacgtgggaccccttaatgactatcacaagaacaatggcgggaacgcctggattttccggaacaagggagaaaagatcagaccttggaatttcgagaagatcgtcgatctgcataaaagcgaagaggaatttattaagcgcatgctcaaccaatgcacctacctgcccgaggagacagtgctgcctaaatccagcatcctttattctgaatacatggttctcaatgagctgaacaatctgcggattaacggcaagccgctcgacaccgatgtgaagctgaaacttatcgaagaactgttcaagaaaaagaccaaagtcacactcaagtccattagagactacatggtgcgcaataactttgctgacaaagaagatttcgacaatagcgagaagaacctggagatcgcctctaatatgaaaagctatatcgattttaacaatattctggaagacaagttcgatgttgagatggtggaagaccttatcgagaagattacgatccacaccgggaacaaaaagctcctgaaaaagtacattgaggaaacatatcccgatctgtcctctagccagatccagaagatcattaatctcaaatacaaggactggggacggctgtccagaaaacttctggatggcatcaagggcaccaaaaaggagacagaaaagaccgacacggtcattaactttctccgcaacagctctgataatctgatgcagatcattgggtcccaaaactatagcttcaatgagtacatcgacaaactgcggaagaaatatattcctcaggaaatctcttacgaggtggtcgagaacctttacgtgtcccccagcgttaagaaaatgatctggcaagtgattagagtcacagaagagatcaccaaggtgatgggatatgatcctgacaagatttttatcgaaatggctaaatccgaggaagagaagaaaaccacaatttctcgcaagaataaactcctggacctgtacaaggccatcaagaaagatgagcgggacagccagtatgaaaagctcctgaccggccttaacaaactggatgactccgatctcagatctcgcaagctgtacctgtattacacacagatggggcgggacatgtatacgggagagaaaatcgatcttgacaaactcttcgatagcacccattacgacaaggatcacattatcccccagtccatgaagaaggacgacagcattatcaataacctggttctggtgaataaaaacgcgaatcagacaaccaagggcaacatttacccggtcccttcttccatcagaaataaccccaaaatctataattactggaagtatctcatggaaaaagagtttattagcaaggaaaagtacaaccggctgatccgcaacacacctcttaccaatgaggagcttgggggcttcattaacagacagctcgtggaaacgcggcaatctaccaaagccatcaaggagctgtttgaaaaattctatcagaagtccaaaattatccccgtgaaggctagcctggcctctgatcttagaaaggacatgaatacactgaaaagccgcgaggttaacgatctccaccatgctcacgacgccttcctgaatattgtcgccggagatgtgtggaaccgggagtttacctccaatcccatcaactacgtgaaggaaaatagagagggcgacaaagtcaagtatagcctctctaaagatttcacacgccctagaaagtccaaggggaaagtgatctggaccccggaaaagggacggaaactgattgttgacacgcttaacaagcccagcgtgctgatctccaatgagtctcatgtcaaaaagggcgaactctttaacgctacaattgcggggaaaaaggattacaagaaaggaaagatctacctgcctctgaaaaaggacgatcgccttcaggacgtgagcaaatatggcgggtacaaggccattaatggcgctttctttttcctggttgagcacaccaagtccaaaaagagaatccggtctatcgagctctttcccctgcatctcctgagcaaattctatgaagataagaacacagtgcttgactacgccattaatgtcctgcagctccaagaccctaaaatcattatcgataagattaactatcgcaccgagatcatcattgacaatttttcctacctgatctctaccaagagcaacgatggatccattacagtgaaacccaacgaacagatgtattggagagttgacgagatcagcaatctgaagaaaattgaaaacaagtacaaaaaggatgccatccttacggaggaggaccggaagattatggaatcttacatcgataaaatctatcagcaattcaaggctggcaaatacaagaatcgcagaaccacagacaccattatcgagaaatatgaaattatcgatctggacacactcgataacaagcagctgtaccagctcctggtggcctttatttcccttagctataaaacctctaataacgcggtcgacttcacggtgatcgggctgggaacagagtgtggcaagccgcggatcaccaatctgcctgataacacctacctcgtgtataagtccattacagggatctacgaaaaacgcattagaatcaagtga

SEQ ID NO: 4177 - RNA, 4047 nt, synthetic construct
  misc_feature 1..4047: note = Cas9 variant
  source 1..4047: mol_type = other RNA
atggagaagaactactatctgggcctcgacctggggagcaattccgtgggatgggccgctaccgatgaagactacaacttccttagactgaaaggcaagacagcctggggagcgcggatcttttctgaggctaaagattgcaaggaacgcagaacgtatcggagcaataaacgcagactcgcccggcgcaagtacagactggtccttctgaagcagctctttgccgaggaaatgaccaaagttgacaagacatttttcctgcggctggctaactccacctattgggaggaggataaaacaaaggactctgatgggaatgaaattggcaaaaacctcatctttaagacccacgaggaagagaagcaatactatacaaaataccccaccatttggcatctgcgcaaggcccttatcgagaatgacgaagaggctctgagcaacctcagatacgtgtatctggccattcaccatatcgtgaaataccgggggaatttccttacggaaggagagatgggcaacgatatccctccgattaccacaatcgaagagattaatcagaccctgtccctcctggaggtcgactctagcgaagatgcgacagacaagaccacgtatatcaaacccgagtcctacaacgaactgtttacaattctcgagaataacaatctgaacaaggtgaaaaagcagcaggaaatcgataagctgttcattagctctaaagagcgctccgagaacatcaagaattatatcaacctgtttaaaaccattatcgttggcgggagcttctctctcaagaaaattaatgaagacacagaggacatctccgtggattttaccaaggacttcgaaaacagcgaggccgatatttctaaggctctgggagactcctttaatcttgtcctgatcgccaaaaagtactatgattacatcattctcaaagaactgctgggcaagaacaaagagatcagcgaggctatggtgcaaatttacgaagaacacaaggacgatctcaagtccctgaaaaccatccttaaggacctggataataaactcgggaacgacggaaaggatagaatttattactctgttttcaaacaggaacctacagagaagttcaaggagacgaattatctgagctttgtgcagggcgggaaacttgaagaactgaacaagtacatcaaaaagatcctcgaaaataacgagaaagacattgacgataaggaaacctataatgccctgtacgagaaagcgtgtaagggagacctgttcaagaaacaggccaacgcttgcacatccctcatcccccatcaatttcaccttcgggagcttaagaaaattctggaaaatgccggccgcaagtatagcttcctcaacgatatctctgacaaaattatcaagatttttaagttcagagtcccttactactatggccccctgaacaatgagtccaacgctcacagctgggtggtgaaaaaggaagggcaggagaaagccaagatcaccccttggaatatcaacgaaattatcgatacaccgaaaacccgggacaatttcttcaagaagctgacgaactcttgtacataccttgtcggagagaccgttctccccaaaaccagcctgtattacgagaagtatctggtgctcgatagactgaataaaatgcaagtgaacggcgactacctttccgcctctgaaaagaatgatgtcctgaaatttattctcagccgcaagacaaccacaatcgagcagattcggacgtatctgtccaagaacaaaagcaccaaggctaatgacatctctatctccaacattaaagcgacagatcctttcaatgccgtgagccatgctttttacgggaagcaccccgacctgaacatcaatctttgcgaggagctcattaaattcgccaccatctacgccgatgacaagaaagaactgaagaagtttgtttcttccaacttcaacctgacagacgagttcattaaagagtatctcaatacccctacgaacaagtggggaagactgagccgcaaatttctttgtggcggggatcagctggaaatgtactatgtggacgataatggaatcctccattccatcctgaacattctggaggaaaccaatgagaaccttcaggagatcctcaataacgaaaagtacggcttcaatcagaaaattgctgactttaacaatacactgaccgccgataagacaaccgaggaacaaatcgaggacattctggattctacgcccgcgctcatgcggagaagcatcatccagacactggctgtcgtggacgatgttattaaggccgccggcaaagctccgcagaagatcatgatggaagtgacccgcacagacgggaaaaaggaggagaccaaatcccggtatgtccagcttaagaagcaaattaccaacgataaagtgctgacatctgacgaaaagaaagagctcctgacgaatctggaaaacaagaaaatccagcttaagggaaagcacatttacctctatttcatgcagatgggcatcgatttttacaccgggaaaattatggacatcaatgacgtcatcaacggaaagtacgatattgaccacatcattcctcagagcatgatcaaagatgactccctggataacatggtgctggttagcaaggactataatcaaaaagtgaagaaggatatttaccccatctgcgacgagatcagaaacaatatgctcgataaatggaagggctattacgcccgcaaaattatctctgaagagaagtataaccggctgaaaagaacaaaggagcttaatgctgacgaaattaacgccttcatcaatcgccagattaacgtcgtgaattactccaacatccagatcaaacggatttttgagatcaagtatcctgaaaccaagattatcttcagcaaagcgtcttttccctccctgctcagaaaggagtacgaaattgccaaaatgcgggatctgaatgacgctcatcacgccgttgacgcttacctgaacatcgtgtgtgggaatattcttacaaccctgtatacggatatcttctacatgtttaaggagaaaaaggaggaccataagaacatcagcttcaatatggaaaaacgcctcattaactatatcgataagaataacctgaaagacaagattaaaacatcttgcctcagacacgatgccctgatcacctacaagcccgactatgatagcggcaagttttacaaagagaccattttcaagaaatccggagacaaggaaacaggccttatccctctgcataccaaagggccgatgagcgatacaaagaagtatggaggctactctcagctctcccaaagctacatcattgcggtcgagtataaactgaagaacaaaacggtgaagaaactgtgtcgggtgcccaccctttacctgaagcagtataaaaatgacctcaacacaatcgccaagattatgatcgatgacgagaaggctaccgatattaaagttctgagaaagatctacctcaatcagaaaatccgctataacgggtgctactatctgatttacacatccaaggaaaaacagaataagtacaagatggcctatcaaaactaccttgacaatgactatctgatctacctcaacaaatgtctgaagaaaattgatgagctggacgatggagaacttacctctcaggagttcatcgtcaataaggacggcgataaatttctgattgacaagaaccacaatctcgaaatcttcaagagcattaaagagcagtataacaagacgatctacgattataccccttacatcgtgcaatcccgggagatgaaagaagaggactttaataacctgtctctcaagaaacagattgatacactgcttaatatgatcaagattctgagcagatccaacgaacaggctaagttcgagaccgcctttttcgaaaactttacaaaagtgttcctgaagaccatgacaatcaccaatgagaaagtctacattgtgaacgagtctcccagcgggctctttaagggcaaagaggagctgatctga

SEQ ID NO: 4178 - RNA, 4047 nt, synthetic construct
  misc_feature 1..4047: note = Cas9 variant
  source 1..4047: mol_type = other RNA
atgaagaaattcgaggactactatctgggcctcgatctggggaccagctccatcggatgggccgtgacaaacgaaaagtacgacattcttagatttaataaaaagttcatgtggggcacgcacctgtttgatatggggaacaccgcttctgagcggcgcatcttcagaacaagccggcgcagactcaaacggaagaagaatcgcattgaactgcttcagaccctgttttccgccgagatgtctaaaaaggacttcggatttttccaaagactcaaagaaagccagtattttatcgaggataagacattcaaaaacaagaataccctgtttatggacgagaactacacagatcaggactatcatatggaataccccaccatttatcatctgcggaaggcgctcatcgataatgaggaatccgctttcgagatccgcaaactgtaccttgccatttctcacatcctgagccacagaggccattttctcttcgagggggaactgtccgacaaccttgatttcgacgatatttttaatgagttcgtcaagtacctgaacgaagaactcaatatcgactttaaaattaagagcgacgtttctctgcaggccatcaaagaaattctgacggataagatgctcaaccggaccaaaaagaaggagaaactgtccgagcttctggaagaggaaaagaataaaatctatcaagagatctggaagctcctggtgggaaacgaagctaaaatgagcacaattttcgacgataaggagtacgaggaagccaagatcgctttttctaaaggcaattatgacgagaaggaagaggaatacgagtccattcttggcgagaaaatcctgttcgtgcagaaggccaaagcgatttatgattggatgctcctgcagaacatcctgaaggaagacaagtacctcagctattctaaagtcaagctgtacaacgagcacaaaaaggatcttaaaatcctgaaggacgtgctcaagaatctggataaaaagatttacaaagaaatcttttccgagaacgggctttatgaggaatacctgcgcattgagaagaaaaagatcggaagcaaagaagagaagaccaaggacattctctataatagactgaaaaagatcttcgaaaaccgggataatatggccatcgaggacattctgaacaaaatcgagctcgactcctttctgcctaagcagaaaattaaggataatggcgttatcccgcgccaagtgcaccagaaggaacttgagattatcctgaaaaacgctgaaaagtacttcaaatggctcattgagaaggacgaaacagggctgtctgtcagcgagaaaatcatgaagatctttaagttcaaaattccctattacgtgggacctcttaattccaagagcccctttgcctggatcgagagaaaagaatatggcaagattcttccttggaacttcgagaatatggttgatatgtctaaaaccgctgaaaagttcatcaagcggatgacgaacaaatgcacatacctccccgagaaggacgtgattcctaaaaattccctgctgtacaccaagtatatggtcctcaacgaactgaataaccttaaaatcagaggggagaagatcaaagtggagctgaagcagaagatttacacagaactctttcagaaaaacaagaaaatcggaatgaagaccctgattgagttcctgaaaagccaaaatatcgtggtcaccaaggttgaaattacaggcatcgatggcacgtttaacacctctcttgggagctatatcgacatgaagaaaattttcggagaggagaagatcgtgaaagattcctacaagaaaatgattgaagacatcattctctggatcacactgtatggcgaggaaaagaagctgatcaaatctaagattgaggaaaaatacccggagaaggtgacccccgaggaaatgaaactcatcctgaaacttaagtatcgcgattggagccggctgtccaaagagtttctcacagaaattgagaccatggacgaagagacgggggagctgatcagcattatcgaaatgctgtggagaaagaatgagaacattatggaacttctctcttacaaatacgatttctccaatcgcatcaaggagtataacggaatcaatgaaaaagagaagaacattacatacgaggacctggtcaaggatctgcagatcagcccttctgtgaaaaagatgatttggcgggccctcgttatcgtgaaagaaattaagaaagtcaccaataagtcccccaaaaaggtgtttatcgagatggcgagagacacccagacagaaaagaaacgcaccgagaagcggaaagacaagctgcttgagctgtataaaaacatcaagaatgatgacagcattaaggaactcgagaaaaacctgaaggataaaacaaatgacgatctgaagtccaaaaagctgtacctctattacctgcaactgggcagatgtatgtattctggggaagttatccgcctcgaggacctgatgaacgataatctttacgacattgatcatatctaccctcagagcaagattaaagacgattccttcgacaacacggtgctggtcaagaaacagatcaacgccgataagaccaatgaatatcccatcgacaaatctattcagaacaagtgcaaggctttttggacaagcctcaaagagcggggactgatgtccaataccaagtacgagagactgacacgcaccgaaggcttcagcgacgatgagcttgccggctttatctctcggcaaattgtggaaacgagacaggctaccaaagtcctggccgacctcctgaaggtgatcttcgggtccgatacacggattgtttatgtgaaagccggactcaccagcgactttcgccagaagttcggcatctacaaattcagagagctgaacgattatcaccatgctcacgacgggtaccttaatattgtcacaggaaacatctataataccctgtttacggataacccgtacaatttcatcaaggaccggaagaaagataacagaacatacaatctcaacaaggtgtttgaacgcgagaatgacgtttggaaccctgatgtgatgctgtctaaaattgagcggtatatctacaagattagacccctgttcacccgcgcgtcctatgaacagaaaggcgggtttagcgaccaaaatatctctagcgagaaggacaaacttagacctctgaagtccagcggcgtcctctctaacattaagtacggaggctatgataaaatcaagaactcctacttctttatcgtggaatatacagagaaaaagaagcgggtgcgcagcattgaaaccctgcccatctacattaaaaagtccatctctaccaaagaggacctcgagaagtactgtaaagaggagctgaaacttcaggaacccaaggttctggtcagcaagctcaattataagtccctgatttactctaacgggcacgagtattacatcaatagcaaaacagccgattccatcacgattcagaacggaatccagattatcctgaccaaggagaattatgaaacatacagaaaaatttataagaaccttgagtacctgaaactcatctacaaggacgaaaagattcgggaggaaaagatcctggagaagatccctaaaattctcaagaataacaaaaatgatcgcgacctgtctgaggatgaaatcagcgagaagttctggaaactttataaggaaatttttgagaagatcaaaattggcatcttctccaagtttaaaagcaccctgccgatctacattgaagactgcaagaagctgaaagatttcacaaccctcaacaattatgctaagtctagattcatccaagagattctgaaatgtcttaactcccagcagggggagtttgacacgaagtacacacataattatagcaaaaagtacaacaccaagctgtctaaatccaagatcctcgaaaatgatttctatattatcaaccagagccccaccggactgtttgagaaaaaggtgttcctcgacaaatga

SEQ ID NO: 4179 - RNA, 4047 nt, synthetic construct
  misc_feature 1..4047: note = Cas9 variant
  source 1..4047: mol_type = other RNA
atgggcgaggacgggaagcccctgagagtgaaaggaaagaccgccatcggcgctagactcttccaggaagggaaccctgccgcggatcgcagaatgtttcggacaacgcgcagacggctgaatcgcagaaaatggcggcttaagctgctcgacgagattttcgatccgtacatcacccccgtcgacagcacatttttcgctcgcctgaaacaatccaacctttctcctaaggatagcagaaaggaatttaaaggatccatgctgttccccgacctcaccgataagcagtatcacctggactaccctacaatttatcatctgcggcacgccctcatgacccaggataaacagtttgacatccgcatggtttacctggccattcatcacatcgtgaagtatagaggcaatttccttaactctacacccgtggatagctttaaggcttccaaagtcaatttcgacgatcaatttaagaaactgaacgagctctacaccgccatcaatcctgaagagtctttccagattaacctggctaatagcgagaagatcgggcagcagtttcttgacccgtccattcggaaattcgacaagaaaaagcaaatccccaaaattgtgcctgttacgatggatgacaaggccgtggataagctgaacggaaaaatcgcgagcgaaattatcaatgccatcctcggctataagtctaaactggacgtcgctgtgcagtgcgatcccgaggactccaacccttgggccgttaagttcgatgacgaagatattgacgctaaactgcagaagatcctccccgagatggatgagaatcagcaaagcattatcggcattatccaggacctgtactctcaggtgacccttaaccaaatcgtcccgaatgggatgtccctgagcgaatctatgattaagaaatacaacgaccatcacgatcacctcaagctgtataaaaagctgatcggacagatttccgacagcaaaaagaagacagcccttaaaaaggcgtacgatcagtatgtgggcaacgacgggaaagtgatcgagcaggatgacttttactcctctgtcaagaaaaatctcgatgacagcgaactgtccaagcaaattatggatctgatcgacgccgataagttcatgcctaaacagcgcaccagccagaacggagttatcccccatcagctccaccaaagagagctggacgaaattatcgagcatcagtctaagtattacccttggcttgctgagtccaatcccaacaaacacgatctgcacctcgccaagtataaaattgaagaactggtggcttttcggatcccctactacgtgggccctatgattacaccggaagaccagaagaaaagcggggccgccgtcttctcttggatgaagagaaaggagcccggacagatcaccccttggaattttgacgaaaaagtggatcgcatggagagcgctaacaagttcattaaacggatgacgacaaaggacacctatcttatcggcgaggatgttctgcccgacgaatccctcctgtacgagaaatttaaggtgctgaatgaactcaacatggtcagagtgaatggcgattctctgaaggttgcggacaaacaagccatctatcaggatcttttcgagaactacaagcatattagcgtgaaaaagctgcagaattatatcaaagggaagacaggactccctaacaatcccgaaatttccggcctgagcgacccggatcagtttaacaattctctggggacctacaacgacttcaagaaactttttggagataaggtcgacgatcctgacctccaaaacgacttcgagaaaatcgtggagtggtccaccgtctttgaagataagaaaattctgcgcgctaagctgaatgagatcacatggctcacggacaagcagaaagatgacctggaaagctctcggtatcagggctgggggagactttccaagaaactgctcaccggaatcgtgaacgatcaaggcgagcgcattatcgacgagctgtggaatacaaacaagaatttcatgcagattcagagcgatgacgatttcgccaaacggatccacgaagccaacgctgaccagatgaagtccaccaatatggaggatgttctggccgacgcgtacacatctccccaaaacaaaaaggctattagacaggtggtcaaggtggttgacgatatccagaaagccatgggcggggtggcccctaagtttatcagcattgagttcacccgctccgaggaccggaatcccagacgcacgatctctcggcagagacaacttgaaaacacactcaaagataccgctaagagcctggtcaaatccatgaatcctaacattctgagcgagctcgacaatgcctctcggtccaagaagggactgaccgatcgcctttacctgtattttacacagctcggcaaagacatgtacaccggggagcccatcaacattgatgaaatcagcaattatgacatcgatcatattctgccgcaggctttcatcaaggacgattctctgtccaacagagtgcttgtgagcaaagccgttaacaatggaaagtctgcgaacgtccctctcaaactgtttggcgccaagatggggcacttctggaagcagctggctgaggccggcctcattaataaacataagctgaaaaaccttcaaacaaatcccgacacgatcagcaagtttgctatgcacggattcattcggagacagctggtggaaacctcccaggtgatcaaactcgtcgccaacattctgggcgataagtaccgcaatgacgacacaaagatcatcgagattaccgcgcggatgaaccaccaaatgagagatgaatttgggttcatcaaaaatcgcgagattaacgactatcatcacgcctttgatgcttacctgacagccttccttggaagatatctctaccatcggtacatcaagctgcgcccctattttgtgtacggcgacttcaaaaagttcagagaggataaagttaccatgcggaattttaacttcctgcacgacctcacggatgacacccaggctcgcattgccgatacagaaaccggggaggtgatctgggacagagaaacaagcatcaagcagctgcgggatgtctatcactacaagtttatgcttatttctcaggaggtgtataccctgcgcggagccatgttcaatcaaacgatctaccctgcttcccaggcgggccggaaaaagctcattccgatgaaagccgacaagcccgttgatgtgtatgggggctacagcggatccacagacgcttacatggccatcgtccggattcatgacaaaaagggcgataaatataaggtggttggggtgcctatgcgcgccctgaacagactgaataccgctaagaacgtctctgacgccaaatacgatcaggaacttaaggaggtgctgacaccccagtttaccaaaagcaagaaaaaccggaagaccggagagatcacacaaacggtggaagacttcgaggtcgttctcggcaaggtgatgtatagacagctggtgatcgatggggacaaaaagtttatgctcggatcctctacctaccagtataatgcgaaacagctggtccttagcgatgaatccattaagacactggcttctgagggcaaactcaacgaggcccaagaaagcgccgcttacgacaaggtgtatgatgagatcctggacaaggttaataaatacttcgccctgtacgataccaacaagtttcgccagaaactttccctggggaaggacaaattcgtgggcctccctaatcacaacgtctttgacggaagcaagaagatttcttccggcaaacgggaaatcctgaatgagattctcaacgggctgcatgcgaatgctacacttggaaccctgagcgatatcggcttctctacgcccttcgggaagatgcagcagcctagaggaattggcctctccagcaacacatctatcgaatatgagtcctttaccgggctgttcaaacgcaccatctttctgaaggacctttga

SEQ ID NO: 4180 - RNA, 4047 nt, synthetic construct
  misc_feature 1..4047: note = Cas9 variant
  source 1..4047: mol_type = other RNA
atgaagaaaccctacaccatcgccctggacattggcacaaacagcgtggggtgggtcgttgtgacggatgactatagagtgcctaccaagaaaatgaaggtcctcggaaatacagagcggaaaaccatcaagaagaacctgattggcgcccttctgttcgattccggggacacagctgaaggaacccgcctcaaaagaacagcgcggccgcgctacaccagacggaagaatcgcctgagatttcttaaagagatcttcacggaagagatggctaaggtggatgacggctttttccagcggctggaagattctttttatgttctcgaggacaaagaggggaacaagcaccccattttcgccaatctggccgatgaagtggcttaccataagaaatatcctaccatctaccatctgcgcaaggagctcgtcgacaacccccaaaaagccgatctgagacttatctatctggctgtggcccacattatcaagtttcggggacacttcctcattgaaggcacactgagctccaaaaataacaatcttcagaagtcttttgaccatctggttgatacctacaacctcctgttcgaggagcagcgcctgctcacagaaggcatcaatgcgaaagagctgcttagcgccgctctgtccaagtctaagagactcgaaaacctgattagccttatccctgggcagaaaaagaccggaatttttggcaatatcatcgccctgtccctcgggctgacgcccaacttcaaagctaattttggactgagcaaggacgtgaaactccaactggccaaggacacatacgcggatgaccttgattctctgctcgcccagattggcgaccagtatgctgatctgttccttgccgctaagaacctgtccgacgccatcctcctgagcgatattctgaccgagtctgacgaaatcacacgggcccctctctccgctagcatggtcaaacgctacagagagcaccacaaggatctggtgacccttaaaaccctgattaaggaccagctcccggagaaatatcaagaaatcttcctggataagacaaagaacgggtacgcgggatatatcgagggccaggtgtctcaggaagagttttacaaatatctgaagcccattcttgcccggctcgacggctccgaacctctgctgctcaaaatcgacagagaggatttcctgcgcaagcagcggacgtttgacaatgggagcattccccatcaaatccaccttgaggaactgcatgctattctcagacgccaggaggtcttctacccttttctgaaagataaccggaagaagatcgaatccctgcttaccttcagaatcccctactatgttggaccgctcgcccgcggccactctcggtttgcctgggtgaaaagaaagttcgacggggctattcgcccttggaattttgaggaaatcgtggatgaggaggccagcgcgcagattttcatcgaaaagatgacaaagaacgacctgtacctgcccaatgagaaagtcctccctaagcactccctgctttatgaaacctttacagtgtacaacgagctgaccaaagttaagtatgctacggagggaatgacacggccccaattcctcagcgccgatcagaagcaggccattgtggacctgctgtttaaaaccaatagaaaggtcaccgtgaaacagcttaaggaaaactacttcaaaaagatcgagtgctgggattctgttgaaattacaggcgtggaggactccttcaatgctagcctcgggacctatcatgatctgctgaagatcatccaagacaaagattttctcgacaaccccgacaatcagaagattatcgaagatattatcctgacacttacgctgttcgaggacaaaaagatgatttctaaacgcctcgatcagtacgcccacctgtttgacaaggtcgtgctgaacaaacttgagcggcatcactacaccggatggggcagactcagcggcaaactgatcaatgggatccgggataagcagtccggaaaaacaattctggacttcctcaaggctgatggctttgccaaccgcaatttcatgcaactgatccatgactctgaacttagctttattgatgagatcgcgaaagcccaggtcattgggaagaccgaatattccaaggacctggtgggaaacctcgctggcagccctgccatcaaaaaggggatctctcagacaattaaaatcgttgatgagctggtgaagattatgggctacctgccgcagcaaatcgtcattgaaatggctagagagaaccagaccacggcccagggaatcaaaaatgcgcggcagagaatgcgcaaacttgaggaaaccgccaagaagctgggctccaacatcctcaaggagcaccccgtggacaatagccaactgcagaacgataaacggtatctctactatctgcagaatgggaaggacatgtacacaggagacgatcttgacattgattatctgtcttcctacgacatcgatcacattatccctcagagcttcattaaaaacaattccatcgacaacaaggttctcacctctcaaggcgctaatagagggaaactggataacgtgcccagcgaagccattgtccgcaagatgaagggatactggcagtccctgcttagagctggcgccatctctaaacagaagtttgacaatctgacaaaagccgagcgcgggggcctcacccaagtggataaggctggattcatccagctgcagctcgtggaaacgcggcagattacaaaacatgttgcgcaaatcctggacagcagatttaacaccgagttcgatgaccacaataagcggattcgcaaggtccatatcattacacttaaatccaagctggtgagcgactttagaaaagagttcggcctctataagatccgggatatcaaccactaccaccatgcccacgacgcttatctgaatgccgtggtcgccaaagctattctggggaagtaccctcagcttgcccccgagttcgtgtatggagattacccgaagtataactcttttaaagaacgccagaaggcgacccagaaaaccctgttctactccaacatcctcaagtttttcaaagaccaagaaagcctgcatgttaattctgatggcgaggagatttggaacgctaataagcacctccctatcattaagaacgtgctgtccatcccccaggtcaatatcgtgaaaaagacagaagttcagaccgggggattttacaaagagagcattctttctaagggcaacagcgacaaactgatccctagaaagaataactgggatacgcggaaatatgggggcttcgactcccccacagtggcctacagcgtcctggtgattgccaagatggaaaagggaaaagctaaggttctcaaacctgtgaaggagatggtcggcatcaccattatggaacgcatcgcctttgaggagaatcccgtggtgttcctggaagcgaaagggtatagagagattcaagaacatcttatcatcaagctgccgaagtactctctctttgagctggaaaacggacggagacgcctcctggcttccgccagcgagcttcagaaaggcaatgagctgttcctgcctgtcgattatatgacatttctctacctggccgctcactatcacgaacttaccgggtcctctgaggacgttctgcggaagaaatacttcgtggaaagacatctccactacttcgatgacattatccagatgattaacgattttgccgagcgccatatcctggctagctccaatctcgaaaagattaaccacacgtatcataataactctgacctgcccgtgaacgagcgggccgagaatatcatcaacgtcttcacatttgtggcgcttggagcccccgctgccttcaaatttttcgacgctaccattgatagaaagcgctacaccagcacaaaggaagttctgaatgccaccctgatccaccagtccgtgacaggcctctatgagacgcggattgacctgtctcaacttggggaaaactga

SEQ ID NO: 4181 - RNA, 4050 nt, synthetic construct
  misc_feature 1..4050: note = Cas9 variant
  source 1..4050: mol_type = other RNA
atgaagcagaaattctacgtgggcctggacatggggaccgccagcgtcggatgggctgttacagatgacaagtataacatcattaaaagacacggcaaggccctctggggagtgcggctgtttaaaacggcgaataccgctgaggaacgcagaatcttccgggccgcccgcagacggacacaacgcagaaagcagcggatggagcttctgcaggaaatttttggagatgagatctccaagaccgacattggcttctaccagcgcatgaaagaatctaagtattggtttgaggataaaagagacatcaacgggaagcaacccgagctcccttacgctctgttcgtggatgacggatttacagataaagactatcatgaacagttcccgaccatctttcaccttcggaatgtcctggtgaacgagtggacacagaagtacgatattcgcctcgtttatctggccatccatcacattatcaagcatagaggccacttcctgtttgaaggcaaaaagatgagcgaggtgaccgacttcgggtccgcttttgaggccttctgcaaagtcgcgtctgataatgacattgaaatcacggtggacgaggaaaagctcaaagatattgaggacctgcttaagagccggcagaaatccaagaccgccaagaaacaagaactgggaaagatcatcgctggcgccgataaacagaagaaagctctcgccgcgctggttacagggtgtatggtgaaactttctgagattttcgccgacaagagcctggatgacggagagcgcaacaaaatctcctttgctgatagcaattacgacgaatacattgccaacgtcgaggaaaccctcgctgagagattcctgctgatcgccgccggcaaggctctctatgattgggcggtgctgtctgacattcttgaagggtccacatacatcagcgaggccaaagtgaagatctataaaaagcacggagatgacctgcggaagctcaaaggcctgcttaagaccagacccgacgagtacaaactgatttttggcctccctgaaaagcaggctaattattctgcctacatcgggatggtcaaaaagaacggaaagaaagttcccattgataagaaatgcacgaaggccgacttctattcctttctgaaaaagacactgaataaaatcaacttcgaggatgaaaaggagcgcgaaattgctgagagcatcatcaatgagattgaaaacgagacctttctccctaaacaggtgatctctgacaatggcgtgattccctaccaactgcatgaagccgagcttgatcggatcctgaagaacgcggctctctactatcctttcctgtccgagaaggacgatgaagggtacacaaacatggacaaaattaaggccatctttaaattccgcattccgtattacgtcggaccccttaatacctatcacagcgataagggcgggaactcctgggccgtgagaaagcaggacggaaaaatctacccttggaattttgagtctaagatcgatgctggcgaaagcgcccggaaattcattggcagaatgaccaacaagtgtacatatctgatcgggaaagacgttctccccaaggagtccctgctgtacagcaagtttatggtgctcaatgaactgaacaatcttcgcattgatggagagaaagtctctgtggagatcaagcaggctgtttacgaaaacgtgttcaaaaagtatcaacgggtcacgggcaaaaaggtgaaggacttcctgattagatccgggatcatcggacgcgagcaggaactcagcggctttgaccagaatttcaaatctagcctgaaggcctaccatgatattaaacagatcgcgggggacattaacctgtcccaaaatcagaaggaggatatcattaaagaaatcaccgtctttgccgactctcagaagatgcttaaaaagcggctcaagatcaaatatcctgagctgagcgataaacaggtgacaaagctggctgccaagaaatacaccggctggggaagactctcccgcgagttcctggaagaggttgaaagcgtgaacaaggagacaggcgaagtccttaatattatctctgctctgtgggagaccaacgagaatctcatgcaactgctgtccaacaagtatgactaccttagcgaaattaaacggctcaacgatgaggccgaagacaagtctgaggtggttacgtatgatgacgtgcagaaactgtacgtctcccccgcggtgaagagaccggtgtggcagacactgaaaatcgttgaggaaattagcaagatcatggggtccaagcctgagcggatctttgtcgaaatggcccgcgagcccggacagaaaggcgatgtgaaggtgtctagaaaaagccggctcctggaaaagtacaaatattgcaagaaggaggctcctgagatttacgaaaatcttgtcaaagaggacgataacaagctgagatccgacaaactcttcctgtattacacccaaatggggcgctgtatgtattctaatgaagtgatcgacattgaggatctgtttaccaaccggtacgacatcgatcacatttatccccagagcaaggttatggacgattcccttgacaatagagtgctcgtcaaacgcgaactgaacagcaataagacagatgtgttccccgttcctaaggagtacatggacaaagccaagaccctgtgggatatgctcaaaaagaaagacctgatctctaaggagaaataccacagacttacacggcgcgatggattttccgaaaacgagctgagcggcttcattgctagacagctcgtggaaacgcggcagtctaccaaggccgtcacacaactgctgaccaaggcctatccggagtccgaaatcgtgtacgctaaagcgaatgccgttagcgagtttcgccataagttcgggtttacaaaagtgagatctatcaacgactatcaccatgctaaggacgcctaccttaatattgtcgtgggcaacacctattacgtgaaattcacgaaggatgccgcttggttcatccggaataaccccggacgcacctataatctcaagaaaatgtttgagcagggcacagtcagcagagggggagaaaccgcctgggtttccggcgaggacgggacaattttcaccgtgaagcgggtgatggggaaaaacaacatcctgtttacgcgcaaggcgtacgaagtcagaggcgggctgttcgatcagcaaattatgaaaaagggcaagggacagatccctgtgaaaaataacagcgaggacgatcggctctgcgctacagagaagtacggcgcctataataaagcctctggggcttactttatgctggttgaatccgaggacaagaaaggaaacaagatcagaacccttgagttcgtgcccgtctatctggccaaggagctcgaaaagagcgaggatgcggctattcgctactgtgtggagaagctggaactgaaaaatcctgacgttcgggtgagaaagatcaaaatggattccctttttaacgtcgacggcttccgcatgcacctgtctgggcggacaggaaagcagctcatttttaaatgcgccgagcagctggtgctcgatgaagagagccaaaagatcctgaagaaaaccgccaaggttttcgctgactataaagaaaataagaacattaaaatctccgataagatcgagcttaccgacgagatgctgattaagctctacgaactgttttataaaaagctgaaagacacagtgtacaatatcagactttctacgcaggtcaagaccctggagagcggcaaagaaaagttcgagaagctctccctgctcgataaatgtctggtgattgaagagatccttcatctgttccagtgccagtctgtggccgctaacctcagctccattgggggcgccgcgacagccggaatcctggtcctgaataacgagattagccgctgtggcaaggttgaaatcatcaatcaatctattaccgggttttacgaacaggtgatcgaccttaaaaacatttga

SEQ ID NO: 4182 - RNA, 4050 nt, synthetic construct
  misc_feature 1..4050: note = Cas9 variant
  source 1..4050: mol_type = other RNA
atgcagaagtactatctgggcctcgacatcgggaccaacagcgtgggatgggccgtcacagatgagaattacaacctgtgcaaattcggcgggaagagaatgtggggcattcggctttttgacggagctcaaacggccgaagaacgcagaatgaatcggtccaaccgcagacggctgtctcgccagaaacagagaatcgatctcctgcaggaacttttcgcgaaggagattgctaaagttgaccccacctttttcatccggctgaatgaaagccgcctctatatggaggataagtccacagggaccaagtttcctctgttcgccgacccgggatacacagataaagagtattacaaggaatatcccaccatttaccacctgagacaagagctcatcaaaaaccctgaatctcatgacatccggctggtgtaccttgcctgtcaccatattctgaagaatcgcggccactttctcatcaacggcagcttctccgatctgaaaaatctttcttttgtgtgcagagagatgctggacgctttcaacgagctcagcaagtatcagctgatgatttccgatatcgacgccctggaaaagattctcagcgatcggaaacagcagaagtctgctaaagtcaaggagctggtgcaaatctttgaatgtgttccccgcgaggacaaatccgacgccaagatttgcaaagaaatccttagcaatctgtgtaagttcctcgtgggggcgaagggaaacatcacaagactgtttgataccgacttcgatgagatggagacgtcttccttcagctttggcgactctaaatacgaagattcccttctgcctagcctcgaggaaaattatcccgactacgccaacgtcattcagaagatcaaagctatgtatgattggtccgtgctggttgagattatggccggggaaaattacctgtctttcgctaaggtgaacgcctataaaaagcataaggagaacctcagcatcctgaaatcccttatgaagaaatactgcacccctgacgtctaccagcggtttttctatgagacagatgaaaagagctcttacggaaattatattggcgcgatccacaacaatgggcactcccataccatgaaaaagtgtgacgaggaaacattttacaagagcctgtctaaaatcctcgataagctggtggtgcagaaaaccgaccaagacacgcttgagattctgaagaaagaagccaagaaccagacactcctgccgctggctagaaccaaggccaatggagtcatccccaaccagattcacatccaagagctccgcgctattctggataatgccaaaacatatcttagcttcctgaacgaggccgacgaatacggcaccatcgctgagaagatcattcggatcgcgaaatttaagattccttattacgccggccccctctccaccagacataaagaacagggggctaatacatggatcgttcgcaagcaggagggacggatttacccttggaacttcgaggaaatggtggatctggagagatctaataacgaatttatccgccggatgacgaataaatgcacctatctgattggcgaggacgtgcttcccaagaacagcctcctgtactccaagttcatggtcctgaatgaactcaacaacctgaaaatcagagggcacaagatcagcgtggagcttaaacaggagctgtataaggaactcttttgtaaaaaggccaaggttacaggaaaagccctgctggtgtaccttaagaaaaaggatgctgagctcaccctggaagacatttctggcttcgatgccgactttaaatccagcctgtctatctatattgatttcaagaatcacatcctccgcgagcaaattgacgatgggaagtaccagtccatcgtcgaaaacatcattaaatggaagacaatcttcgacgtggatagcaaaatgattgagaagctgatcgcgcgggagtatccgaatatgttttcctctgaacagattaaaaagatctgcagacttaagtgtcgcggatggggcaacttcagctcccggtttctgaatggcatccagggggagaacaccgaaacgaaagagtgcttcacaattatcgaagctctctggaagaccaattacaacctgatgcaactgctttctaaacagtttaccttcaaggacgccattgactgcatcaatgccgataaagttggaaagattgacaaagtgacatacgagaacaccgtcaaggatctcgtggtcagccctgctaataagagagccatctggcagacagtgcagatcacggaggaaattaaaaaggttatgaaatgtgagcccgaaaagatctttgtggagatggctcggggcggggagaaagaaaagaagcgcaccatttccagaaaagagcggctgctgaagctctatatggactacaaagatgaaaacagagactggatcaaggagattgaaagccgcgatgagcaagacttcacaaatcggaaactgtatctttactatacccagatcggaagatgcatgtactctggcgaggaaatttccctggaggaactcatgcagaagaacagcaagtgggataaagaccatatctatcctcagtctaagatcaaagatgactccctggataatctggtccttgcccgcaaggacattaacaacaataaaagcaacaagctcctgcccacagggatccaagacaagatgaaaaagtactggaaaatgctgctcaagtacggctttatttctaaaaagaagtatgatagactgatgcggaccgaggacttcagcgatgaggagctttccggatttatcgcgcgccagattgtggagacgagacagagctctaaagccgttgctgaactgctcgagcacctgaatgaacataccgagatcgtgtacgtcaaggccgaactggtgtccgacttccggcacgataacaatatgcttaaaagccgcagaatcaacgactatcatcacgctaaggatgcctttctgaatattgtggttggcaacgtctacaatgcgaaattcacagccaacccccggaattggatcaagaaaaaccgcaataccaactattccattagacgggtgttcgactacacagtgaagcgcgggtctaccatcgtctggcaaggagtgaaggatggcgggcacagcattgacggaatcaaaaagacgatggctagaaatgatatcctctatacagagcggacctactgtgagcagggcgaactgtttaacgccacactcattaaaaaggggaaccctaatgctatcggcctgaaaaagggacttgacccgatgaagtacggcgggtattcctctcccaaaaccagcgccttcgcctttattgagttcgacggaaagaaaggcagacagaaccatctggttgaaatccctgtgtacattgctaatatcgcggcccgccagcccgagtatattaagaaccacctcgaggagaaaaaggggtaccaaaatgtcatcgtgaagaaatatcctatccagaagaacgctctgattaaactggatggataccccgcccggcttagaggcgccaatgaaaagtccatcaccctgaaaaacgctgttcagctcgtgctgaagccggaatatcatgagacaattcgcaatgtcgaaaagtacctcgagtacatcgacaaagatgagtctgtgagcaaggccgcgcggttttcccacacggaactggacaaactttatgatgagctgtgcttcaaggctgaaaacagcatttacaaaaagagacctgccaatcagtctgccaccctcaaaaacgggcaaaagacatttctggctatcaccaatctgaaggagaaagcccaggttatcaacaatattatcacaatgttccgctgtgacgcgaccacgacaaccaaccttaagaccattggcggatccgctaatgccggcgggatgcaagtgaacaaaaacacactgaccagccagaaggtcgtgctcgtgcaccagtctatcacaggactgtttggcacggaagaggagctcctgtga

SEQ ID NO: 4183 - RNA, 4053 nt, synthetic construct
  misc_feature 1..4053: note = Cas9 variant
  source 1..4053: mol_type = other RNA
atgaagaaaccctacagcatcggcctggacattgggaccaactccgtgggatgggccgtcgttacagatgactataaggtgcctgctaaaaagatgacggtgctcggcaataccgataaatctcacatcaagaagaacctgcttggggcccttctcttcgacagcggaaatacagcggctgatagacggctgaaacgcaccgccagacggcgctacacaagacggcgcaaccggattctttatctgcaggagatctttgccgaagagatgtccaaggtcgacgattctttctttcatagactcgaagacagcttcctggtgaccgaggataaacgcggcgaaagacacccgatttttgggaatctggaggaggaagttaagtaccatgagaacttccccacaatctatcacctccggcaatacctggctgacaatcctgaaaaagtggatcttcgcctggtctatctcgccctggctcatatcattaagtttagaggacacttccttatcgagggcaagtttgacacccggaacaatgatgtgcagcgcctgttccaggagtttctcgccgtttacgacaacacgttcgaaaattcctctctgcaggagcaaaacgtgcaggtcgaagagattctgaccgacaaaatcagcaagtccgcgaaaaaggatagagtgctcaaactgtttcccaatgaaaagagcaacggccggttcgccgagttccttaaactgattgtggggaatcaggctgactttaagaagcacttcgagctcgaagagaaaacacctctgcagttttctaaggatacctacgaagaggaacttgaggtcctgctcgcccaaatcggagacaactatgctgagctgttcctgtccgccaaaaagctctacgatagcattctgctttctggcatcctgacagttaccgacgtgtccacgaaagcgcccctcagcgcctctatgatccagagatataacgaacatcagatggatctggctcagcttaagcaatttattcgccagaagctgtccgacaaatacaatgaggtgttcagcgatgtctccaaggacgggtatgccggatacatcgatggcaaaacaaaccaggaggctttttataagtacctcaaagggctgctgaataagattgaaggatctggctacttcctcgacaagatcgaacgggaggactttctgagaaaacaacgcaccttcgataacggcagcattcctcaccagatccatcttcaggagatgcgggccatcattagacgccaggccgaattttatccgttcctggctgacaatcaagatcggatcgagaagattctcacatttagaatcccctactatgtggggcctctggcgcgcggaaaatccgacttcgcctggctgagccggaagtctgctgataaaattaccccctggaacttcgacgaaatcgttgataaggagtccagcgccgaggcctttatcaatagaatgaccaactacgacctttatctccctaatcagaaggtgctgcccaaacactctctgctctacgaaaagttcacagtctataacgagctgacgaaagtgaagtacaaaaccgaacagggcaagacagcctttttcgatgctaatatgaaacaggagatttttgacggggttttcaaggtgtaccgcaaggtcaccaaagataagctgatggactttctggaaaaagagttcgatgagtttcggatcgtggacctcacaggactggacaaggaaaacaaagcgttcaatgctagctatggcacctaccacgatctgagaaagattcttgacaaggattttctcgacaactccaaaaatgagaagatcctggaagatattgtcctgacgctcacactgttcgaggaccgggaaatgatccgcaaaagacttgagaactattctgatctgctcaccaaggagcaagtgaaaaagctggaacggagacattacaccgggtggggacgcctgagcgccgagcttattcacggcatccggaacaaggaatccagaaaaacaatcctcgactatctgattgatgacggcaatagcaaccgcaattttatgcagctgatcaacgatgacgccctctctttcaaggaggaaattgctaaagcccaggttatcggggagaccgataatctgaaccaggtggtctccgacattgctggaagcccggccatcaagaaaggcatccttcaatctctgaagattgtggacgagctcgttaagatcatggggcatcagcctgaaaatattgtggtcgagatggcgagagaaaaccagttcacaaatcagggacggcgcaactcccaacagagactgaaaggcctgacggatagcatcaaggagtttgggtcccagattcttaaagagcaccccgtggaaaattctcaactccagaacgaccggctgttcctgtactatctccagaatggccgcgatatgtacaccggagaggaactggacatcgattaccttagccagtatgacatcgatcatattatccctcaagcctttattaaggacaactccatcgataatagagtgctgacatctagcaaagagaaccggggcaagtccgacgatgttcccagcgaagacgtcgtgaaccgcatgagacccttctggaataaactcctgtcttccgggctgattagccagcggaagtacaacaatcttaccaagaaagagctgacacctgacgataaggctggatttatcaaacgccagctcgtggagaccagacagatcacgaagcacgtcgcccggatgctggacgaaagattcaacaaagagtttgatgacaataacaagcgcattcggagagtgaagatcgttaccctcaaatctaatctggtgtccagcttccgcaaggaatttgagctttataaagtccgggaaattaacgattaccaccatgctcacgacgcctatctgaatgcggtggttgtgaaggccctcctggtcaaatacccgaagctggagcccgagttcgtgtatggcgaataccctaagtacaactcttatagagagcgcaaaacagctacccaaaagatgtttttctacagcaatatcatgaacatgttcaaatccaaggttaaacttgccgatgaccagattgtggaacggcccatgatcgaggtcaatgatgaaacaggggagattgcttgggacaagaccaagcatatcacgacagtgaaaaaggtgctgagctatcctcaggtcaacatcgttaaaaaggtggaggaacagaccattggacaaaatggcgggctctttgatgacaaccccaaatctccgctggaggtgatcccttccaagctcgtccccctgaagaaagcccttaaccctgaaaagtacggcggatatcagaaacccacaaccgcctaccctattctgctcatcgtggataccaagcagctgattcccatcagcgttatggacaaaaagagattcgagcaaaatccggtgaaatttctgaaggacaagggctatcagcagatcgagaaaaacaatttcgtcaaacttcctaaatacacactggtggatattgggaacggaatcaagcgcctctgggcttcctctaaagaagttcacaagggcaatcagctggtggtcagcaagaaatcccaagacctcctgtaccacgcgcatcaccttgataacgactattctaatgagtacgtgaagaaccattatcagcagtttgatattctgttcaatgaaatcacgagcttttccaaaaagtgcaaactggggaaggagcacattcagaagatcgaagaggcctactctaaagagcgggacagcgcttccatcgaggaactcgccgatggattcattaagctgcttggctttacccaactgggggccacaagccccttctcttttctcggcatcaaactgaaccagaagcagtataccggaaagaaggactacctcctgccctgtatggaagctacacttattcatcagtccatcaccggcctgtatgagacgagaattgatctgagcaagctcgggggagactga

SEQ ID NO: 4184 - RNA, 4053 nt, synthetic construct
  misc_feature 1..4053: note = Cas9 variant
  source 1..4053: mol_type = other RNA
atgggcaagaactactatctggggctcgacatgggaaccagctccgtgggctgggccgtcacagatgagaaatacagaatcctgcgggctaaggggaaagacctttggggagttcgcctgttctctgaagccaagacggcggctgagagacggacccaccgcacaagcagacggcgcctcgatagagaaaaagcccggattgcctgcctgaaggagatgtttgctgaagagatcaataagattgaccccggcttctatcagcgccttaacgattccaaatactttctggaggacaagaaagaacatcaaccttatgccatcttcgctgataccgggtacacagacaaggagtattacgatgaatacccgaccatttttcacctcagaaaagccctgctgaatatcgagaacgacaagaagaaatatgatgtgcggctcgtgtacctggcgatccttaatatgttcaagcatcgcggacactttctgaacgccaatctcgacgataaatctggcggcaacctgaaggagtatattgaaatgcttcatcagagcatggtcaatatcctgaacattaatctcaaaaacgtggagatcgaaaagattgagaaaatcctgaagtccacacagtactctaatagcgaaagactggagaacctcctggagctttatgaactgtccaagaataaaaacaagattgagaccgaaatcttcaaatttatctgtgggctcaagggaacgattagcaaaatctacgttgaggacaagttcgaagacgagtttgctaagatgaccctgtctttccgggattccaactttgacgagaaaattatcgaaattgaggataatcttgacgatgacaagtatgatatgttcctgctcatcaaacagatccacgactggagcgtgctggccaacattatgaatggcgaagagtacctgtctgtcgctcgcgtgaagctctacgataaacacaagaaggacctggaagttcttaaaaagtattacaaacaaaactccatggaggagtataataagatgttcagacagatgaacgatgggaattacagcgcctatgtgggatctgtcatctacaaagacaactccgtgcggagaggctgcaagagcaagaaagaagacttttataagaatattctgaacacaatcaaatcctgggaggattgtgaagcgaaggagtacattacctctgagatcgacaaagggaatttcctccccaagcagatcacagccagcaacggagtgattcctaatcaggtccataaaaaggaactgaagaaaatccttaagaacgcttccgagtacctgaattttctcaacgaaaaagatgagagcggctataccatttctgaaaagatcgttaaactgttcgagtttcaaattccctactatgtgggccctatcgcctacaacattgggaatgacgagtccaagcaccgccataacatgtggagcgtgcggaaggaaaaaggacccatctatccttggaatttcgagcagaagatcgatattaaaaagtctagcgaaaaatttatcagaaacctgattaatcactgcacgtacctcaacgacgaggaagtcctgccgaaaaattcccttctgtatgagaagttcatggtgctcaacgagctgaataaactgaagatcaacggcgaaaagatttctgttgagcttaagcagaatatctttaacgatctcttcaaaaaggggaagaaagtgacaaagaaaggactgatcaagtacctgaaagaacagggcgagattgacaattgtgaagaggtcgagatcagcgggattgatggagactttaccaacaagctctccaattacaaaaagttcgctgatatctttggcgtgcaaagcctgacatatgaacagaccgacattgccgagaacatcatccgctactctaccatttatggcgattcccggaagttccttgaagagagaatccgcgaggaatacagcaacgttctggacgagaaacagattaagcggatcctcgggatgaaattcaaggactggggaagactgtctaaagaactgcttgagctctccggcgtggataaggaaacaggggagattgccagcgtcatctcccgcatgtggaatgacaactataatctgatggagctgatcgctacggaacggttttcttacgcgtatgagattgaacaaagaagcaagaaactcgagaagaccatctccacaattgaatacgaggatctggacgagctttacatgtctacccccgtgaaacgcatggtctggcagacaatcctggtgctcaaggaactggaggaagttctgggatgccctcccaaacggattttcgtggagatggccagagatgtcaacgctcctaaggaccggaaggatagccgcaaaaagaaacttctcgaactgtataagaattgtaaaaaggaggagggcgactggtccaaggaactgaacgccagagaggaaagcgagtttaaatctaagaaactctacctgtattacatgcagaaggggcggtgcatgtattccggcaaacccatcgatcttaagaatctgctcaacgacaatctgtacgatattgaccacatctatccgagacatttcgtgaaggatgacagcatcgagaacaatctggttcttgtggaaaagaactttaatgcccacaagtctgacaactaccctattgagaatgaaatccgccagaaaatgcattccatgtggaagatgctccgggatggaaacttcattaccgaggaaaaatacagcagactgatccgcaaggaggagtttacggacgatgaaaaagctaagttcatttctagacaaatcgtcgagacacggcagggcaccaaggtgatcaccgacctgtttgaacagacattccccgagagcgatattgtgtatgttaaagccgggaacgtctccgaatttcgccacaagttcaaactcatcaagtgtagaaatgtgaacgactttcatcacgcgaatgatgcttacctgaacattgtggtcggaaatgtgtattacaccaaattcacaaagagcgcccttaacttcatcaaggactataaaaagaatcctgagaaaaacaagtaccacatggatcatatgtttcagtatcccgtttctcggggcggggtggacgcctggattacgaaaggagctgagtccatcagcatggtccgcaagatgatggccaagaatacccccatggtgacaagaatgaactacgaaaaacactccggccaaaaagggggcatctctgatcagaatatttgcagcgctaaaatcgccaagaaaaacgtttacctgcctattaagatgggagacgagaagctcaaaaatgtggaaaagtatggcgggtacggatccctgaccgcgaaatatttctttctggtcgagcatacaatcaagaaaaagcggattcgcaccatcgaagcctacccgatgtatcttgacgctctgaacaaagagaataagctcctgaactactgtgtgcaggttctcgagtatgatgaacccaagattatcatggagaaaatcaaggtgaaatctctgttcaagattaatggctactactattaccttaacgccaaaagcgtcaacagaatcatttgggggaatgctacgcagctgtttctcgaaaacgacatcaatgagtatgtgcggaagatttccaagaacatcgagtgcatcgatattaattctgaaaacaatatcaaagtgtacgacattttcatcgagaagtatagcaacaaactgttttccaatcgcctgggaaaccttaaggaagccattatccaaaatagaaacaaattcatcgagctgaagattaatgaacagatcaacgtcattctcgagctggttcggtacagccaggatggcgtgtattctatcaatctctcccagctggggcttagctctacctacgcgattaacagaacatccaaggagatcagcaaaatgaaggaatgcaaactgattaaccaatctgtgaccggcctctacgagaatgaaatcgacctgctgacagtctga

SEQ ID NO: 4185 - RNA, 4053 nt, synthetic construct
  misc_feature 1..4053: note = Cas9 variant
  source 1..4053: mol_type = other RNA
atgcagcaatactatctgggcgtggacatggggagcgcctccgtcggatgggctgttaccgatgagaagtaccagctcgtgcggaaaaagggcaaagacctgtggggagtgagaacattcgatatcgcccagacggcggaagtccgcagagtgtctcggaccaaccgcagacggcagaatcgcagaaagcaacggattcagatccttcaggagctgctcggggaagaggttctgaaaattgacgctggctttttccaccgcatgaaggaaagcagatatgtggccgaggataagcggacacttgacgggaaacaggtcgagctgccctacgccctctttgtggatcaaggattcaccgacaaggatttttataaacagttccctacaatcaaccatctgattgtttacctgatgaccacatccgacaccccggatatccgcctcgtgtatctggcccttcactactacatgaagaatagaggcaactttctgcattctggcgacatcaatgatgtcaaagacattcagagcatcctcgaacagctggagaacgtgcttaaggaatatgtggacgattgggagctgtccctcaaggacaaagtcgatgctattaaggagatctacaataaagacctggggcggggagaacgcaagaaggctttcattaacacgctgggcgttaagaccaaatctgccaaggcgttttgcagcctcatctccgggggaagcacaaatctggccgagcttttcgatgactctggcctgaaggaatccgagtatgctaaaattgaatttgccaacgctaatttcgaggatagcgtggaggggatccaagccctcctggaagacagatttgcggtgatcgaggccgctaagcggctttacgattggaaaattctgaccgacatcctcggagataacgcctctctggctgaagccagagtcaagtcctatgagacacaccatgaacagctggtggagctcaagagcttcattaagaagtacctggaccgcaaaatctatcaggacattttcatcaatcccaacatcgccaataactaccctgcttacgttggccacaccaagattaacggcaaaaagcaagagcttgaagtgaaacgggcgaagagaaatgatttttatgcctacatcaagaaacaggtcattgaccccatcaagaaaaaggtgtctgataaagctgttctggcccgcctcgccgagattgaatccctgatcgaggtgaacaagtatcttcctctgcaggtcaatagcgacaacggggtgatcccctaccagattaagctcaatgaactgcggagaatcttcaacaatctggagaaccgcctccctgtcctgaaagagaatcgggataagattatcaaaacgttttcctatcgcattccgtactatgtgggaccccttaacggcgttaatagaaacgggaagtctacaaattggatggtgcggaaagaaggagaggaaggcaagatctacccttggaacttcgaggagaaagtcgacctggaagctagcgccgagaagtttattagacgcatgaccaataagtgtacatacctcgtgaacgaagatgttctgcccaaatattccctgctttacagcaagtatctcgtgctgtctgagctgaacaatctccggctggacgggagacctcttgaagtctccgtgaaacaagagatctacgagaacgtgttcaagcggaatcgcaaagttaccctgaagaagatcaaaaactatctcctgaaggaaggagtcattagcgagaaagatgaactgtctggccttgcggacgatgtgaaaagctccctcaccgcttaccacgactttaaagagaagctgggccatctgacactcacggaagatcagatggagaagatcattctgaatgtgacccttttcggggacgacaaaaagctgctcaaaaagagactggccgccctgtatcccaacatcgatgagaaatctcttagccggatggctacatttaattacagagactggggacgcctctccaagaagttcctgagcgaaattacctctgtcgatcaggagacaggcgaactgcggaccatcatccagtgcatgtacgagacgcaaaacaatctcatgcagctgctttccgaaccgtatcactttgtggaggccattgagaaagaaaaccctaaggttgacctggagagcatctcttacagaattgtgaatgatctctatgtctcccccgctgtgaaacgccagatctggcagacactgctggttattaaggacatcaaacaagtgatgaagcatgatcctaaaagaatcttcattgaaatggcccgggagaagcaggagagcaagaccaccaaatcccgcaagcaggtcctttctgaagtgtacaaaaacgcggagaagtataaaaatctctttgaaaagctgaacagcctgacagaggaacagctcagatccaagaaagtttacctgtatttcacccaacttgggaagtgtatgtacacaaatgacgccatcgatttcgagaacctggtgtctgctaacagcaattacgacattgatcacatctatccccagtccaaaacgattgacgatagctttaacaatctcgtcctggtgaagaaaggaatcaacaatgacaagtctgaccggtaccccatcgataagaacattcgcgacgatgagaaagtgaagaccctgtggaatacacttctgtccaaaggcctcatcaccaaggaaaaattcgagagactgattcggagcacacctttttctgacgaggaactcgccgggttcatcgctcgccagctggtcgaaaccagacaatccacgaaggccgttgcggagattcttagcaactggtttccggagtctgaaatcgtgtatagcaaggccaaacacattaccaatttccggcaggattttgagatcctgaaggtgcgcgaactcaacgactgccatcacgctcatgatgcctacctgaatatcgtcgtgggcaacgcttatcacacaaaattcaccaattccccctacagatttattcagaacaaggccaatcaggagtataacctgcggaaacttctgcaaaaggccaagaaaatcgaaagcaacggagttattgcttggatcggccagtctgagaataaccctgggacaattgcgaccgtgaagaaagtcatctccagaaatacggtgctcatcagccgcatggttaaggaggtggacggacagctgttcgatcagcaactcatgaaaaagggcaaagggcaggtccccattaagtcctctgacgatcggctgatcgacattagcaagtacggaggctacaacaaagccaagggggcttattttgtgttcatcaaatccgttagacgcggcaagacaattaaatcttttgaatacatccctgtgcatcttgccaagaagttcgactgtaatctggagctcctgaaagaatatctggagagcgagaaggatcttaacaatgtcgaaatcctgatgcccaaagtgatgattaactccctcttcaattacaacggatctctgatccggattccgggcagatatgacaagaaaagcctcctgatcaatgtggatgtccctcttctgctggagtcccagcacattaagcagctcaaggttatcgaaaaatacatgtataagaaacgcgtgagcaagaactctaatattctgcttaccaaatttgcctccgaccaactgaaggatctcgacgctctgttcgatgtgctcagctacaagctgaacgagaatatctacaacgtcatcaatgacaaatatgataaacttgtgatttgccgggacaaatttatctctctggatacagaagttaagtgtgagatgattttcgagctgctccacctgtttcagtgcaactcccagcttgccaacatcaccaaaattggggcgaccagcaagttcggatctatctccatgagcaaaaatctgaaggaaaacgacaagatgtccatcattcatcaaagcccctctggcatctttgagcacgaaattgagctcacagctctgtga

SEQ ID NO: 4186 - RNA, 4053 nt, synthetic construct
  misc_feature 1..4053: note = Cas9 variant
  source 1..4053: mol_type = other RNA
atgaagagaatcctgggcctcgacctggggaccgccagcattggatgggctcttgtgaacgagtccgaaaatgagaaagaaaagtctgagatcattaaactgggcgtccgggttaaccccctcacaacggatgaacagaccgacttcgagaaggggcgccctctgagcgtgaatgccgatagaacacttaaacggggagcgcgcagaaacctgcaacggtttaagcagcgcagaaagaatctcatcgagattctgatcaaaaagggcttcatcaccaacatttccctgctcacagaaatcgggtctaataccacataccagaccctggagcttcgggctaaaagcgtgaaggaaaagattgagaaggaggaatttgcccgcgtcctgctcacgatcaacaagaaaagaggatataagtcctctcggaaagccaagaatgacgaggaaggcagcctgattgatggcatgtccgtggctaaagagctttacgacaacaatctgaccgttgggcagtatgtgtaccaactcctggaaaagggaggcaaatatatcccggatttctaccgcagcgacctgcagaacgagtttgatgtcatttggaatttccagaaggagttttatcccaacatcctcacaggggaactgtacaagaaacttcagggacaaggccagcaaaattctagaaagctgttcctcgccatccaccagatttacaccgctgagaacaaagggaagcgggacacagtgaaaaagcagcattataagtggcgcaacgatgccatcaatacccagctgcttattgaagaggttgcgtacgtgctggtcgaaatcaacaataacctcaataaatccagcggatatctgggcgccatttctgacagatccaaggagctgtactttaacaaagagacggtgggcgaaaatctctataagcagatccaagagaaccctcagacaagcctgaaaaatcaggtgttctaccggcaggattatcttgacgaatttgagcaaatctgggaaacccaggctaagttctactctgagctgacaaaggagctcaaagaagaggtcagagacgttgtgatcttttaccagcgcaagctgaaatcccagaagcaccttattagcgaatgcgagttcgagaaacatcacaaggccattcccaagtcctctcctctgttccaagaatttaaaatctggcagattctcaacaatatcgagttcaagcataaaaagaccaaagaactgaagatcctgagcgaggaactcaaagagaccctgtttgaggaacttaacattcgggggaatttcacatccgatgctgtgctgaagtttgtcaagctcgacaaaaaggagtgggaactgaactataaaaagggaatcgagggcaatagaacgaacgaagtgctgtacaacgtttatcagaaaattgccgagtacgaggggtatggattcgattggagcaagaagtctgcggtggaaatcaaagaggaacttaataccatcttttccgagattggcattaacagcaagatcctcgacttcaatcccgaaatctctgggaacgattttgacaaacaggagagctaccaactgtggcatctgctctattccgccgaggaagatggattcctgaagcagaaacttcaggacaagtacggctttaagtctgagtacgctaatatgctggccaacgtcagcttccagtccgattatggcagcctctctgctcgcgccattaaaaagatcctgcctaatctgattgccgggcacgaattttccgaggcttgtagcctttctggatacaaccactccaatagcctcacaaaagaggaactggcgaaccggccgctgaagggcaaactcgagctgcttaagaaaaattccctgagaaaccccgtggttgaaaagatcctcaatcaaatggtgaacctggtcaatcaggtgattgagtcttatggggaaatcgacgaggtccgcatcgagctggcccgggaacttaagaaaagcgctcaggagagagccctcatgaccacaaacattaacgcctccaagaccaaatacgaatctttccgcaagctgctgcaaaaagatttcggaatcaagaatcctacgcggaacgacattatcaagtatagactctacgaggaactgaaagctaataagtatcacacaatttacaccaacaaatacatcccccgcgacaaactttttagcaaagagatcgatattgagcatatcattcctaaggccaagctgttcgacgattcctttagcaataaaaccctcgcgttccggaagcccaaccaggacaaaggcaatatgacagctatcgattatattctgtcttaccagtccaaggacatcgataactataaaagcagaatcgaaaatctgtttaagaacgggaagggcgacatttctaaagccaagcggaataaacttctcatggaggaaaaggatatcccggacggattcattgatcgcgacctgagaaactcccagtacatcgccaaaaaggctaagcaactgctcgaggaagtgattcggaccgttaatacaacgaccggcagcgtgacaaacaaactgagagatgactgggggcttatcaatgtcatgcaggagctgaacatgcctaagtttaaagccattgacgagtctctcatcgaacagatcgagaagaaagatggaaccttcaagacacgcattaaggactggagcaaacggaacgatcacagacaccatgctatggacgccctgaccgtggcgtttacgcgctataatcacatccagtacctgaacaatcttaacgccaagtccgataaaaagggcgctatttatgggatccaagaactggagacctacgttaatagcaaaggaaagagaaaattcattaagcccatgcataactttcgggaggaagccaagaaacacatcgaggacatcctcatttctttcaaggctaaaaataaggtggtcacaaagaacatcaataagattaagtccaaagatggctttatcaagaaagtgcagctgacccctcgcgggcagctccataaggaaacagtgtacggcaaaattaacgaggttgtcgtgaaggaagagaagatcaatgccaaattcgacctggagaagatcaacaaagtgaccaagcccatttatagaaatgcgcttctgaaacggctccaggagttcaacggagaacccaagaaggcctttacgggcaaaaatagcctgtccaagaaccctatctacctggatgtcgctcaaacaaaaacccttccggaatctgtgaaggttcagttctttgaggaaaattatacaattcgcaaagagatcagccccgacctgaagattgataaaatcattgacaaggggatccagagaatcctcctgaagcggctcgatgagttcaacggaaaacctaaggaagccttttccaacctggagaaaaatcccatttggcttaacaaggaaaaaggcatcgctattaagcgcgtgaagatcaaaggggtcaagaatgtggagtctctgcacaacaaaagagaccacctcggaaatgaaattctgcaaaagggcaaaagcgcccctaacgactacgtttccaccgggaataaccatcacgtggccatctatcaggataagaatggcaagctgcaggagaaagtcgtgtctttctacgaggctgttgcgcgggtgaacaataaacttcccatcattgaccaggattttaacaaagacctgggatggaagttcctctttaccatgaaacaaaatgaaatgttcgtctttccgagcgaggatttcaagcctctggaaacagacctcatggataagaaaaacaattccaagatcagcaaaaacctgttccgcgtgcagaaacttggcaacaaggactatacgtttagacatcacctggagaccaagattgaggatatcaaaaagctgcgggacttcacatacattagaaagcgcaatcccgaatctatcaaaaacatcattaaggtgcggatcaatcacctcgggaacattgtccatgttggagagtactga

SEQ ID NO: 4187 - RNA, 4056 nt, synthetic construct
  misc_feature 1..4056: note = Cas9 variant
  source 1..4056: mol_type = other RNA
atgagcaagaaatactatctgggcctcgacatcgggaccaactccgtgggatgggccgtcacagatgagaattacaacctgtgcaagtatgctggcaaaagaatgtgggggattcggcttttcgaaggaggcgagacggccgaacagcgcagaatctctcggagcaatcgcagacggctgtcccgcaagaaacaaagaattgacctcctgcaggagctttttgcggaagagatcgctaagatggatcccaccttctttattcggctgaacgagtctcgcctccacctggaagacaagagcacaggggagaaattccctctgtttagagataaggactacaccgatatccagtattacaaagaatatccgacaatgtaccatctccggaaggagctgatcgaaaattccaaagttcacgacattcgccttgtgtacctggcctgtcatcacatcctcaagaacagaggacatttcctgattaatggctcttttagcgatgtgaagaaactttccagcgtctgcgaatctatgctgaactccttcaatggcatcagcaagtatcagattgagatcaacgacattgaacggctcgaggaaatcctgtctgatcgcaaaaagcaaaaatccgtgaaggccaaagagctgatccagatttttgagtgtgggccctgcgaagacaagaccgatgagaagacatgtaaagctatcgttagcaatctctgcaagtggctgaccggacttaaaggcaacattaattctatcttcgacatgcagtttgaagagattgacacgtccagcttctcctttaccgaacctaagtacgaggatacaatctctgccgctctggaggaaaaatatcccgactacgccgatgtgatccagaagattaaggcggtctatgactggagcgtgctcgttgagatcatggccggggaagattacctgtccttcgctaaagtgaacgcctataataagcacaaagagaacctttgtattctgaaggaagtcatcagaaaatactgcgacagcgagatttaccacaagttctttaacggattcgatgagaagaatggctatgggaactacatcggatctatctataaaaatggccattcctacgctatgaagaaatgtagcaccgaagacttttataagacactcggcaaaattctggataagatccaacctgagaaggaagacgagaacgtgctggaggaactcaaagtggaggtcaagaatcagaccctgcttcccctggcccggacgacagcgaacgggaccattcctaatcaggttcacatccaggaactcagagccattctggataacgctaaaaagtaccttccgttcctgaatgaggaagacgagtatggaacagtggccgagaaaatcatttctatcgctaagtttcgcatcccctactacgtgggccctctcagcacccggcataaagaacaaggggccaactcctggattgtcagaaagcaggagggacgcatctatccctggaatttcgaagagatggtggacctggaacagtctaacaaggagtttattcaacggatgaccaataaatgcacatacctgatcggcgaggatgttctccctaagaacagcctgctttattccagatacatggtgctgaatgaactcaacaacctgcgcattcgggggaataaaatcagcgtcaagctgaaacaggagctttataaggaactcttctgtacgaaggccaaagtgaccggaaagggcctgtttaactacctgaaaaaggaggacgaggagctcgctctggaggatatctctggcttcgacattgattttaaatccagccttacatcttatctggacttcaagaagcagatcctcggggaagagattgaaaaagataagtacaaaggaatcgttgagaatattatcaagtggaaaaccatctacgacgatgactccaagatgatgaagaaaatgattgagagagaatatcccaacgtgtttagcaaggataaaatcaagaaaatttgccgcttcaagtactccggctgggggaatttctctctgagctttctgaacggaatccggggcgcggacagagagacaggggaatccttcaccattatcgaggccctttggaaaacgaattataacctcatgcagctgctgtctaagcaatttacattccgcgaagagatcgatctcattaatgctgagaaggtcggcaaaatcaacaaggtgagctacgacaataccgtcaaagacctgattgtgtccccggccaacaagcgggccatctggcagaccgttcagattacagaagagatcaaaaaggtgatgaagtgcgaacctgagagaatttttatcgaaatggctcggggaggcgagaaagagaagaaacgcaccgtcagcagaaaggcccggcttctggaactctatgcggcttgtaaagatgacgtgagagattggacaaaggagatcgaagaccgcgaggaacgggagttcaattctaagaaactgtacctgtattacacgcagatggggagatgcatgtactccggagaggaaattaacatcgatgagcttatgcaaaagaatagcaaatgggacattgatcacatctatccccagtctaagattaaagacgattccctcgacaacatggttctggccaagaaggtgatcaacaatagcaaacagaacaagctgctctctagcgatatccgcattaaaatgaagaaatactggaatgccctgtataagggcaactttatctccaagaaaaagtacgacagacttacccggacagaagatttcaccaatgaggagctgagcgggtttattgaacgccagatcgtcgagacaagacaatcttccaaagctgtggccgaactcctgaaccggctgtatgagcacagcgaaattgtgtacgttaaggctggacttgtctccgacttccgccatgacaataaactcctgaagtctagacggatcaacgattatcaccatgccaaagacgcgtttctgaatatcgtggtgggcaacgtctacaatgccaagttcaccagcaaccctcgcaagtggattaaagagaatagagggacgaactactccatccggcgcgtgtttgattataatgttaagagaggcaacaccgtggtctggcagggagtggaggacggcgggcactctattgatgaaatccggaaaacaatggctagaaacgacattctctacaccgagtatacatactgtgataagggagaactgttcaatgccacccttatcaaaaagggcaacgacaaggctattaatctgaaaaaggccctcgatagcgttaaatatgggggatacaactcccccaagacgtctgcgttcgcctttatcgagttcgacggcaaaaagaaggaacgcaaaaatcatatcgtggagattcccgtctatatcgtgaacattgctaagcggcagcctgatacaatcaaagagtacctggaacagaagaaagggtacaagaatgttgtggtcaagaaatatccgattaagaaaaacgccctgatcaagatcgacggctaccttgctagactgcgcggagccaatgagaccgacattctcctgaaaaacgccgtgcaactcatcctgaatgataagtattacgaaattatccggagagtggagaaatatcttgaatacaacgtccgctatgaggctgagagcatgtttgaaggcttcgaccacgcggatctcaattccctgtacgacgagctgacaagcaagctggaaacctctatttacaagaaacggcccgccaaccagcttaatgctctggagaaggggaaagagaagtttaaaaacatccagaccctcagagaaaaggcccaaatcattaaggagatgctgatcatgtatcgctgcgatgccgctacagttgccaatctcaaagcgattggaggctccgctaacgccgggagcatgaagatcaaaaagaacacgctgacctctcggtcccttgtgctggtgaatcagagcattacaggactcttcgaaaccgaggaggaactggtctga

SEQ ID NO: 4188 - RNA, 4056 nt, synthetic construct
  misc_feature 1..4056: note = Cas9 variant
  source 1..4056: mol_type = other RNA
atgtacaagaaatatggcatcgggctggacattggaaccagctccatcggctggtctgtggtcgatgagtacgggcacattatcagagttaagggacagacaggcctcggggtgcggctgttccgcgaaggacaacccgccgctgacagacggacgtttcgcaccacaagacggcgccttggcagacggcgctggagactgcggctcctgcgcgagattttcgatccttatatcgccgcgcaggacccgaactttttcgctagacagaaagccagcgccatcgctcccggcgattcccggtttaaggccgtgtaccgccttttcaatgaccagaccgatagacaattttatgacaaataccctacagtctatcatctgcggcagaagctcatgaccgaaaagagacagttcgatattcgcgagatctacctggctgtgcaccatattgttaaataccgggggcactttctgacaggaggcgccgcgaagaacttcaaacccgggaagctcgacctgaatacctattttgccacgatcaacgctcagcttgccgctattttcatggattctcaagtggaactgcctcagctcgactgggatgccgtcgtgagcctgcttaccaatgaccaggagtccccctctgacagacagaaagcgctgacaaagatgctcgttgcccaaggagatgctacccagaagcgcttttacacagagttcagcaaagccctgctgggcctcaaggctaaactgtatgtgcttaccgggttcgaaggagacaagacggatcagaaagccctgacactctccctggagacccttgacgatcatcaagacgatgtcacacagctgctcggcgacgaacagcggcagctggtggagctgctcgccagagtgcaaagcgctatccagctggcgattatcatccctaacggcaagaccttttctgggcagatggtccagcaataccagacccactatgatcagcttcgcctgctcaaagactaccgggagcagctgacagatcaaaagcacagacgcgcccttaagcaggcttatgccgactacctggccaatgaccaggatcaggacgctctcgttaaagccgtggaaaaggtgctgaaacaaaaccagccgctgtccacggtcggagtgcggctccagaccgcgattgatgctggcgacttcctgcccaagcaaagaacaaaagccaatagcgttatccctcatcagattcaccagcaggagcttgatcgcatcattgaagcccaatctgtgtactatccctggctggctgaggaaaaccctgtcgccgctcatcggtcctacgccccctataagctcgacgagctggtggattttagagttccgtactatgtggggcctctggtccagccccaggcggacaaggccgctaaagagaccaagttcgcctggatgacacggaaagaagctcagagcaccacgcctatcacaccctggaattttgagcaagaagtggatcgcaacgcctctgcgaatgccttcatccagagaatgaagaccaccgacacataccttctcggagaggatgtcctgcccaaaaactccctgctctatcagcggtttgaagtgctgaatgagcttaacaacgttagagtggacggcaagctgctcaccattgctgagaagcagcgcctgttccaagatctgtttgtcgaccggagccaggcctccgtgacaatcgctcagcttcaagccaatctcattgcccacggggctgcgaaagacagagttgaaatcaagggactggccgatcctaaacgcttcctgtctagcctcacgacctaccacgactacgctcagattatcccggaggccctggaacagcccgataagagagccgacatcgagaaaattatcaactggtccacaatttttgaagataccagcatcttcaaggagaagctgcaggagattgcttggctgacacctgaccaacggcgccagctctctcagaaaagatatcggggctggggccagctgtccgataagctgcttacccaactccgcgacgccacggggcagagcgtgatggatctgctgtggaccgaacccaataactttatgcagatcattagacggacagagttccagcaagcgatcgctcgcgtcaatcagaccgacctcaaacagcaggatctggccacaaccatcaacgacctttacacgtctcctcaaaataagaaagccattagacaggtgctgctcgtggttgctgatatccagacagccatgcatgaagtcgcgcccagctggctgttcattgaggctgcccggggaccggagcaaaaccctaagcgcaaactggccagacagcagcagcttctcgaggcttataagacctccgccaaggagatcgtgaatgaagctgtgaaagagaagctgctgtctgccattgacgaccaccaaaaatttgaagatcaggtcgtgctctacttccagcagaacggcctggacatgtatacagggaagccccttgattttgagcggctgagcaaataccatatcgaccacatcattcctcaatccgttgtgaaggatgacagcctcgataatagagtcctgaccacccccgaggaaaacgagcgcaagggagcgcgggtgcctggccccctgtatgcctctcagcaggggagatggcgccttctgcagcgggctggcctcatctcccaaagaaaactggaccatctcctgcttcgcccggaagaactggatcagcaggccacaggattcgttgctcggcaactcgtggaaacgagacaggtcattaagctgatcaccaatattctgagccagcagtacgaccctgagcaaacaaaacttgtgtctgttaaggccggcctgtcccaccagtttcgcacccggctcaacctgcccaaactcagagagctgaatgattaccaccatgcccacgacgcttatcttgcggcccggatcgggacatacctgctccagcgctatcccaacctggaaagattctttgtgtacggacagtatcaaaagacccggttcgacctgaagcgccattttaacttcatcggcgagatgcttaaagggaagcctgaagatgctgtcattgtgaaagccccgcacagcgagacggtgatctgggacaagcaggatgaagtcaaacagctgaagaagattatggagtacagacacctcctggttacacatgaggtgtatgacaatcacggagccctctttaaccagaccatccatcccgctaaaaatcctaagaaccggaaactgattcccagaaagaccacacaatccaccgaactttacggcgggtactctggcgagacaacgggatatctggccatcgcgcgcaccgtgacaaagaataagatcagctaccaggtcctgcgggtgcctaccagactcgttggccgcctgcagcggtcctctgaaagcgctcagagacaaattcttacagattggttcgccccctcctttgtgagccgcgggaaacagcagcctttcgagatcgtcctgcggcacgtgttcaagaaccaaaccgttattgacgatatccatgagcagtctcacagatttggactccgctccgacacgtattactgcaatcagcagcaactggtgctcagcctggaacagcagagaatgattatcgatcagaaacttaacaataccaacaaactgatggtcgtgtatgaggccgtttgtgaccaagtggctaagtacttccccctgtatcggatgaatcactttaaagaatctctcctggaggccggcccgaaacttgcggaactgcctattaacacagtccagtccaagaatgggaagctcaagctgggacagcgcagcgtgctcctgcagaccatgcaaggccttcatgctaaccccgagacaaaagatctgtctatcatcgggtgccctaagtacttcggcaaacttcaggtgagctccggaattaagctcaccgagaatgccgtcctgatccacgaaagccccacaggcctttttcagagacgggttcgcctgtctgacctctga

SEQ ID NO: 4189 - RNA, 4056 nt, synthetic construct
  misc_feature 1..4056: note = Cas9 variant
  source 1..4056: mol_type = other RNA
atgaagatcctgggcctcgacctggggaccaacagcattggatgggccgtggtcaatgaggctgaaaacgagagagaatcctctagcatcattcggcttggcgttcgcgtgaatcccctgacagtggatgagcagaacaatttcgaaaaagggaagcctatcacgaccaacgccgacagaacactcaaacggtccatgcgcagaaatctgcaacggtacaaacttcgcagagcgaacctggtctctctcctgaagacccagggatggattacagatgagaccctgctcagcgagcagggcaataactccacatttgaaacctatcggctgcgcgctgaggccgccacgaaggaaatcacccttgagcagttcgctagagtgctgctcatgctgaataagaaacgggggtacaagtctagccgcaaaatgaagcacgacgaggatggatcctttgttaacaatcttgacatcgccagagaactgtatgatagcggcctcacaccgggccaatacgcttataacctgctgaaagacgggaagaagtacattcccgatttctatcggtctgacctccaggaggaactggataaaatctgggcctaccagtacgagtatcatgaaaatattcttacccactccctgcgcagcgcgatcattgaccagtctaagacaggaaccacgaaaatctttctcaagacacatggcattttcaccgccgatatcaaagggaacagaaacgagcggaataagcaactgtttgagcttagatgcggagctctggaacgcgccctcacagctgaggaactggccaccgtgatcgcggaggtcaacggccagattaattccagctctgggtacctgggagccatctccgaccggagcaaagctctcttcattaaccaccagaccgtgggccagtatctgatgcaacagcttgacagagatcctaataagtccctgaagaaccagcccttttaccgccaagactatctcgatgagttcgaacagctgtgggagacacaggcccattaccaccctgaacttacggctgccctgaaacacgagatccgggacattatcatcttttatcagagacgcctcaagtctcaaaaatggctggttgccaattgtcccttcgaacatcggaaggtgtgccctaaaagctccccgctgtttcagcacttcagaatttggcaggtcctcaacaatgtgaccgtgacagtcgataacaagacctacgttctgaatgaggaacaaaagagcatcctttctaaagagctgctctacaaggagaaaatttccaagcgcgacgctctgaaaatgctgttcgtgaaggcgaagggcgtggatatgaactttgccagccttgaaggggaccggacaatgtctaatctcctgaaagctgcccaggagatcgtcagcatttccggacatggcgattatgacttcgggaagatgcccgccgatgacatccacaacatcattagatctgtgtttggaggcctggggttcgctaccgactggctcaatctggatacggacgccgatgaccttgaacaggagagccagatgcgcctgtggcacctcatctactcctttgagggagataacagcacaaccggcgacaccaaactggttgaacggctgatgtctcttctcaacctgcctcaggagtatgcgagactgttcgctaatgtgcatctcgaagatgactactgtggcatttccagcaaggccctgaaacggatccttccctttatgaaggccgggcacatttattctgaggcttgcgccctggctggatacaagcattccgaacaaagcctcacacgcgaggagaacaaaaatagacctctgaaggatcacctggaacagcttcccaaaaactccctccggaatccggtcgtggagaagatcctgaaccagatggttaatgtggtcaactctattatcgacacctatggcagacctgatgaaatccgcattgagctggcccgggaactcaaaaataacgcgctggggagacaggccatcttcgaggctattaatcgcaacacaaaggagagcgaaagaatccaacagattcttaaaaaggagtttggactgacgcatgtgtcccggaatgacatcatccgctacagactctaccaggaactgtctggcaacgggtataagaccctgtacagcaatatttatatcccccaagagaaacttttctccaaggaaattgatatcgagcacattatccctcaggcccggctctttgacgacagcttctctaacaaaacactggagtaccgcgatgtcaacatcaagaaatccaataccacagctattgactttgtgagaaacgaatatggcgagaatgaagttgagcagtacaagaagcgggtgaacgatctgctcaaaagcggagccatctctcaggcgaaggccaaaaagctgaaaatgaccgaggctgaaattcccaatgacttcatcgagcgcgatcttagaaacacgcaatatatttcccggaaggcccaggaaatgctgcgcgacgtcgctagagtggttaccgccacaaccggcagcgtgacagatcggctcagacaggactggcagctggtcgatgtgatgcaagagctgaattgggacaagtacgaacgccaggggcttaccacggtgatcaacggacgggatggccagcagatcagacgcattacagactggaccaaacggaatgatcacagacatcacgccatggacgctctgacaatcgcgttcaccaagcccgcctacatttcttatctcaaccatctgaatgctcgcagcgaggacgatatccggtccattgagagacgctttctcgaacgggacgccaacgggcacctgagattcatcagccctattgcccacaattttcggtctgaggctaaacgccatcttgaaatgatcctggtttccatcaaggccaaaaacaaggtcgtgaccagaaataacaacacaacgaagaccaaaggaggccggcgcaatcggattcaactcacaccgagagggcagctgcacgatgcgaccgtgtacggcagcatcctgcttccccatacaaagaccattgctgtcgacggaaaaatgacggccgagatcattggccaggtgcaaaaccctgttttcagacaggccctgtcccagcgcctcgaggcttgtgggaatgatcccaagaaagcctttacaggaaagaactctctggaaaaagcgcctgtgtggatcgaccaggctcacaccgagcatgtccccgccgaagtgaccatccaacggctcgagccgcagcacacaattagacgcgccgttaataaggatctgaacatcaataaggtgcttgacaaaggcattcagcacatcctgcaggctcggctcgatgcctatgggggagacgctgccaaggcgttcgccaacctggataataaccctatttggctgaatcaagaaaaaggcatcgctatcaagagagtcaccacagccgagaacattagcggggaaccccttcatcacaaacatgacaaggagggccgccctatcctggacacgaatggaaagcccatgccttccgattttgtgcggctcatgaacaatcaccatgttgctattttccaggacgccgatggcaacctgcaggagcacatcgtgtctttttacgaagccgtcgctagagtgaccgagctcgggctgcccgtgattgacaaagaatataataaggataaaggatggcagttcctttttacactgaagcaaaacgagtacttcgtctttccgaaccctgcgcagggcttcaatcccgacgagatcgatctgaccgacgaacgcaactatagcagaatttcccccaatctctaccgggttcagaaaatgtctagcaagtactatgtgttccgccaccatctggagacaaccgtggaagataagaaagagcttcaggggatcacgtggaagagaatccaatccctgaacaatctcaaaggaattgtcaaggtgcggatcgaccacattggccgcatcgttcagattggggaatactga

SEQ ID NO: 4190 - RNA, 4056 nt, synthetic construct
  misc_feature 1..4056: note = Cas9 variant
  source 1..4056: mol_type = other RNA
atgttcagccagcaaaacaatctgtactgcgagtccctctctaagctgtattacaacatcaccaaaaattttcttagcaagaacgaagtgtgtagaatttatgagatcttcttttgctccattctgacatacttcctcaaaaagtataatcacgacatctttaaaaagtctagcacgatgaagaccattctgggccttgatctgggggtcacatccatcggatgggccgttatcgtgaccgacgatgacaacacacccattaaaatcctcggcatggggtctcggattatccctctgagcaccgctgataaggaagagttccagaaaggacaggccatttccaagaatcagagccgcacaatcgcgagaacccaacggaaaggctacaaccgcaagcagctgagaaaggaagaactcaaaaagattctgggggagcttggaatcacgccgtctaaagaactgctcaatctgccctccatcgagctttggaagctgcgggctgacgccgccagcggcaacgctcctctctctgccgaacagctgggccgcatcttttatatgctgaatcagaaaagagggtacaagtccgctcggagcgaggccaaccaagataaaaaggacaccgattacgtggcggccgtcaagggacgccatcagcagctcaaagagaagggccagacaattgggcaacacttctataccgaaatgctgacacttgaggaaaattctggacattttcaggtgaaaaacaatgtttaccccagagaggcttatctggaagagttcaacgccattatcgctgcccagaagcctcaacacgcgtttctcaccgacgatgtggtcgaccggctgcgcgatgaggtgattttctaccagagaaaacttaagtcccagaagggcctggttagcatctgtgaatttgaggggttcgaacggacgttctttgacaacgtgaaacagaaggacaaaacaatcttcaccggacccaaggtcgcccctaaatcctctccgctctttcaactgtgcaagatttgggagacagtgaataacatcaatctgaaggtgaaaaacaccgatggcagcaagaataaatgggctgactatgtccccaccctcgaacagaagcaggagattatcgagcatctgttcaaaaacgccggcatttcccttgatgctctgcgcaagatcctcgggtttaataaggacgaaatcttcgttaacaaacagattgagaagggactgcaaggcaatacaacgtacgccgaaatccacaaaattcttggggatagcaagcctgagctgctcggatttaacatcaatattgaaccctctaaacactccgccctgctggtggacaagagaaccggcgagatcctcgctgagaaagaagggcaacaggtgagcgcggagattgaaaaggagaacttctatcagctgtggcatacaatctactctatcaaggatcttgacgagtgtgccgctgccctgattaaacggtttaatatcgatcctaacgtcgccgctcagctcgccaagattgacttcagcaaaggagcgtttggcaataagtccaacaaagctatgagaaagatcctgccctacctgatgcagggctataactacgccgatgcctgctctcttgctgggtataatcacagcgactcccagaccaagaaagaaaaggaggaaaacgtggttgacgataaactcaagctgctggagaaaaatagcctccgccagccggtggtcgaaaagattatcaaccaaatgatccatgtggttaatgccattatcgacaagtacggaaaacctgatgagattcgggtggagctggctagagaccttaagaaatctaaggatgaacgcaacgaggccgaactgcagaatgcgtccaacaaaaagctcaatgaggaagtcgccaaccggctgaaggagctgggccttcccgtgacaaaaagattcgtccagaagtataaatttatcttccctgtgcgcgaccggaagattaaagaggctcaactcgttaatcagtgtatctactgcggggaaaccttcaacgtgacggaggccctgagcggagataattttgacgtcgatcacatcattcccaagtctatgctgttcgacgattcccagacaaacaaagtgctcgttcacagaaagtgtaatgctaaggacaaaagcaacaagaccgcctatgattttatcgcggccaaaggcgaaaacgagctggctatttaccttgaccgcgtggacgattggttcaagagaggggtcctgtcctacggcaaaatgcagagactcaaggtgtcttatgaacaatacgccgagcgcaagcagctgaaaaaggagaccgaagctgacatcaaactgtgggagaattttattgaacgggatcttagacagacacagtatatcgccaagaaaagcaaggacctcctgaagaaaatctgcaacaatgtgaccgttacagagggaaagattacggcccaactgcggaacctctggggctgggatgacgtcctgatgaatcttcagctgcccaaatacaaggctctcgggcagaccgagatcaaagaatggacatccgagcatggacgcagactgcacaagaaggaagagattaccaactggacaaaacgggatgaccatagacaccatgcgatcgatgccctggtggtggcttgtaccaagcagggcttcattcaacgcatcaatacgcttaactctagcgacaccaaagatgccatggaccgggaaattaaggccgctaaagagaagtataatgagctctacgataagaaactgctgacagaaaccaacgagcaggtcaagaatcacacagaaagatttaacaaactcgagacctatctgaagtcccagcaacctccgcttttcacgacacgctacgtggaacaggaggccgacaaaatctttgttagcttcaaggcggggaaaaaggctgccacctacggaatcagaaagattaaaaaggacggcaaaaaggtggtcgtgcaggagaaaatcgttgtgccccgcggggccctgcacgaacagtctgtctatggcaagattaagacacaagagaaagataagcctctcaaatacctgtttgaaaatcccgagaccatcgtggacaaccggattaagatcctggttaaagaaagacttgataagttcgagggagacgtgaagaaagctctgacctccctcaagaaagagcctctgtttatcgataatgaaaagaacacactcctggagaaagccgcgtgctatacggacgctaccgtccttaagtacaagctgcaggccctcaaagccaaccaggtgaatgatattgtggacgaaggcgtcaagcggatcgttaaagctcgcctggcccagcataagaacgagaaagaggctttcaaggatacagtgtggttcaatcaagaaaaacggattcccatcgtgagcgtccgggtgtttgcccgcccggacgcgtctaagctggccattatcaagaccgatgagaacaataaacctatcgggttcgctcttacaggaaacaatcaccatattgccatctataaggacaacaccggcaaactggttcagcacatttgcacgttttggtccgctgtggaaagaaagaaattcggggtccccacagtggttaagaataccggaaccctctggagcgagctgctccacaaggacctgcctggcacatttcttgataaactgccccaggacgggctcgaactggagtactctctgcagcaaaacgagatgttcgtgcttggcctgcctaaggagagctttgaggatgccatcaaaaataacgacctccccctgctctccaagcatctgtatcttgtctggagcatttctgataatgactactggttccggcaccatctggaaaccaaaaactccgagctcaagagcacaacgggagccaaggaatccaaacgctactatagatttcagtctgtgggcaccttcacaaaggagaatccgatcaaagttcagctgaaccacctgggggagattaccaagatcggagaaccttga

SEQ ID NO: 4191 - RNA, 4059 nt, synthetic construct
  misc_feature 1..4059: note = Cas9 variant
  source 1..4059: mol_type = other RNA
atgaagaaaagaaaccgggaggaatactatgtgggcctggacatcgggaccagctccgtcggatgggccgttgctacacccgattaccgcattcctaagttcagaggccacaaaatgtgggggtctcggctctttgccgagggaaagcgcgcggctgaaagacggcagttccgcacgaatagacggcgcctggccagacggcgcgacagacttcaaatcctggaggaactctttgccgaggagatggctaaagtggataacaccttctttatgcggctgaaggaaagcaagttctttcttgaggacaaaacagtgaaggaaaaacatattctgttctccaccgataagtttgacgccgatcgcttctataaagacaatccgacaatctaccacgtcagaaagcggctcatggaggaggaaccccaggatattagagagctgtttctggctgtgcatcacatcctcaagtatcgcggccatttcctgtttgccgggtctcttgaacagaacggagcgagcatcgaggaactggttcggaccctcctgggcaaacagggccttgccattctggacgatacaatcgactccaatgagatggtgaacattctcaagaataccggggagacgaaatctgatagaaagaaagacgtccaagaactgtggaaccctctgaaggacaaagtgaagaaggctcaggccgctgagatggccggactcgttctgggccttaaaagcgatatctccaagctgttcgcgaatagcgactacaaagatctcgactcttccattaagaacatcaatttcagctctggggattatgaagagaaacgcgacgattacgccaactccattggagacgatatcgtgctgcttgacaccatgaaggctctgtacgatacactcatcctgagccagattctgcagggcaagcggtctatctccgccgctaaagtcgaagactataatacccacaaggagcaactcagagccctgaaagccattcttaagccccacaaacgcctgtacaacgagatgtttcgggaaaataacaagaaggacctcagcaactatgtggcttacatctcctcttatagcgaggggaaaagagtgaatcgcgaaggattctacaagtatgtccaggcggttctgaaacaggtggatgactccgatagcaagcaggccattcttgaggctatccggctggaaacatttctccctctgctgagagtgaaagacaacgccgtcatcccccatcaaattcaccaggccgagctcgaggctatcctggaaaccgcccgcaagaagtacaatttccttaacgatgtgtctgacggcgtttccgtgaaagataagattatccagctgtttacgttccggattccttactatgtcggcccgctcaatccccatagcggggagacagtggcggacagaaaacaaggaaccggctgggttgtgcggaagcagcgcgggaaagtctacccttggaactttgctgatatggtggacgtcaaggcctctgccgaggctttcatcacaaatctgaccaacaaatgcacctatctgatcggagaagatgtgcttcccaagagaagcctcctgtactccgagtttatgctgctcaatgaactgaacatgattaagtatgacggccacgagcttcctgttgccatcaaacagctgtacattgaacaggtgttcaagcaagagcacaaaaagcagacaaaagggcgggtcctcgattttctgaagagaaatggactgatcacgggctctgctaccgccgtgattacaggcatggacgacgcgatcaagggggatcttcagagctatcgcgacatggttcggattttcggagccggctttgatcattccatggctgaaagaatcatccgctgggtgaccctcttcggggaggccaaagacattctggagaacaagatcagagaagtctacggaaatagcatttctgattcccagatgcgggctatcaaaaagctgaaatacgccgactggggccgcctcagccaagcgttcctgattgccgtgaaggggtgtgataagtctggcgtggagagaaacatcatcacatgccttcgggcttccagccagaatctgatggaaattctctccgaccagggaacctatatcaaacagattaaggcctggaaccaccaacatacgacaaacatgatggataccctggactaccagctggttgatgacctttatgtcgctccctctgtgaaacgcagcatctggcagtccctctgtattgtggaggaactggtcaagatcatgggccaggccccgaaaaagatctttgtggaggttaccagaacaaagcaagccgagaaaaccaagaaagattctcggaagaaacgcctggtggaactctacacagctattgggaaggagggagcggcctggaaaaaggaaatcgaggctcaccaggccggcgacttcagacggaagaaactgtatctttactatacgcagatggggcgctgcatgtacagcaatgaacctattgccatggacgctctgtttacctccgcctacgatatcgaccatatttatccccaaagcctcacaaaggatggatcttgggacaacctggtcctggtgaaatcccagcttaataaggagaaaagcgatcagtaccctctcagacccgcgatccgggagaagaacaaggctcactggcagtatctgtgtagagccggcttcatctctgaaaagaagtacgagcgcctgatgcggaccacagaactcaccgccgaggagctgtccgggtttattgctagacaacttgttgaaacgagccaggccaccaaagcggtgacaggcctgctcgagcgcatctataccaatacagaaatttgcttcgtcaaggctgagaccgtgtctcagtttcggcaccagcataacttcatcaaaattagagaactgaataactaccaccatgccaaggacgcctatctgaatatcgttgtgggaaacgtctaccacgagaagtttacgaaaaatccctgggagttcattgctcgcagcacagaacggagaccttacaaccttaatcgcatgtatgattttgacctgctcaagcaaggccgggtgatctggcaagtgccgaaatccctggagaccgtccaggccatgatgaaaagcaacgatgttagaatcaccaaaaagctcctggtgcagaagggggaactttacgacgctacaattaccaaagcccacaaggcgaaagagggaacatatttccccctgaagggcgccgatgctcggctccgcgacgtgcatagatacgggggatatgagaaaatcaagattgcctactattctgtcttttcctgtcgggaaaaggctagcaatacgatccacaccctgattatccctatccccgtgtacaaagccggcctgcttcagacagaggccgacctgaccgcttacgcgtggcagacaaagcagaaaaccaagcctattaaagatatctattccgccattacgcccatctacaagaaactctgcattaacacagttgtgaagatcgacgggttcaagtatttcctgggcggaaaaaccggcgattacatgtggctcgacccggctatccctgtcgtgctggatgaacaagccgccgcttatcttaaggccatttctaaagttgggcgcgcggacgatgtggagaacaccgctcaggccatcgacctgattacagccgaagctaatgaggccttttacgatgtcctcctgaagaaaatggaagcgaagatcttcgctaaggcctatcagaccattgtggagaaactggccagcgagacagctagagaacggtttagagagctttccatcggagcccagtgttcttgcctgctcgaaattctgaacctcctggctaataacaagacgaccttcacatttttcaaagacaagatgggcgttaccatgagccgccggaaacaacccatggatcttacaaagctggaggagtgtatcgtgtacgaaacctccatcacggggctgtacgagaaggccgtctctctcctgtga

SEQ ID NO: 4192 - RNA, 4059 nt, synthetic construct
  misc_feature 1..4059: note = Cas9 variant
  source 1..4059: mol_type = other RNA
atgggcaagagataccacatcgggctggacattggaaccagctccatcggctgggccgtgatggatgacgatttcaaaattatgcgggtcaaggggaaaaagggaatcggcgttcgcctctttgaggaagggaaaacagctgccgagagacggggacatcgcacgaccagacggcgctattctagacggaagtggcgcctgaaccttctggaagagattttcgaccccgaaatcgcgaaggtggatcctacatttttcgctagactcaaagagagcaatctgtccccgaaggacgatcggaaacagtactctggcaaccttatctttcccgagaaggccaaagaagagattcgcgaatggaccgagaagtatcctacaatctaccacctgagaaatgccctcatgaccgagaaccggcaattcgacattcgcgaagtgtttctggctctgcatcacatcgtcaagtatagaggcaatttcctctttaacgggaatttccagacaggagaggtgaacctgagcgatcggtttgacgatattaattccgccttcatctctgcttgcggcgaagaggaagcgccccagattcctagcgagctttacaacgacatccaggagctgctctttgataaaaataccagaaagctggacaaccaaaaacagcttgccacgaagctgtcccaggacaatgataaagactggagcacccagttctctaaggccctcttcgggtataaaacaaagtttaaggttgtgctgcaatccaacgaagatctggacgatttccagctcgacagcgatgacgctgatgacaaaatcgcctctatttccgagcagatcgatgacgaccgcggaagcattctggataatatcaagattctttactctcggatcaccctgaacgaaatcgtccccgacggcaaaacactctcccagagcatgattgagaagtacaacctgcatagagatcaccttaaagaaatcaaggaccaactgaagcacaccgataattgggtgaaatttgacgatctctattcccagtacgttaacgggaagctggagtctgaccgccataaaaagctgagctccgatgacttctataaaaaggtgctcacgctgtttgatggagagcttaagacacgggtcaaagaatggcaggagaagggcgagttcctgcctaaacaaagaaccggcagcaatggggtgattccgcaccagctccatcagaacgaactggaccagatcattgaaaatcaatctaagtactatccctggcttgctacactgaaccctaatgagaaacgccagcgggtggccaagtacaagctctccgagctggtcgcgtttagaatcccctattacgttggacctatggtgaccaaagatcagagcgacttcgcctggatggtgcgcaagtctgacgaaaaagagatcaccccctggaactttgatcaggtcgtggaccgggataagagcgctgaagagttcattaatagaatgacaacgaaagacacctacctgatcggcgaggatgttctcccggccaagtccctgctttatgaaaaatttacagtgctgaacgagctcaataacattcgcatcaatgggaagcctctgaccacagacgaaaagcaccaagtctaccgggatctgttccagaacgctaaatctattagcaccaagaaatttcacaattatcttgtgtgtaagctcaacaaacccaaccatctgaatatcacgggattctccgacctgacaaagttcaacagctctctcgattcctacattgacctgaagaaaatctttgccgatcagatcgacgatcagagccttcaagacgacttcgagaagatgattagatggtctaccgtttttgaagataaacagatcttcgagcggaagctgtccgagattaattggctcaccgaccaggaacgcagcgaggtggccaaactgagatatcggggctgggggagactgtccaagcgccttctcgctggaatccacgatgaaaacggccagcggattatcgacgcgctgtggaactctcctaagaattttatgcaaatccaggccgaggtcgctttcaataaacagattaacgatctgaatacaaaggaactcagcgacaacaatgtggaggatgtcctggccgacgcctacacctctccccaaaacaaaaaggctatcagacaggtgcttctggttgtggaggatattcagaaagccatgcatggcgacgcgcccacatccatcagcctcgaatttgctcgcgaggaacaggagtccagcagaacgcggtctcgcagagccgccctgtccgctacctatcggcaaattagcgatgaaatcgtctctgccacagtgaagggggagctgggaaaggctacctccatcagcgaccgcctttacctctacttcacacagggcgggagagacatgtataccggagagcctattaatatcgatgaaatttctcggggctacgagatcgaccacattctgccgcagagctttatcaaagatgactccctggataaccgcgttctcgtgaagggggccatcaataacggcaaaagcgcgaactatgtcatggaccagtcttgggcccccgatagactggcttggtggaagaaacttctggacaatcggctcatttcccgcaagaaataccaaagcctgacgctgacccctggaaagatcaacaagtattcccagaatggcttcattaacagacagcttgtggaaacaagacaggtgatcaaactcgttgccaatattctgaacgatcaatactctaatgacgataccaagatcattgtcgtgaaagctgccctgaacagccagctccgggggtttctggagcttttcaagaatcgcaacatcaatgactatcatcacggaatggatgcgtacctgtccacatttatcggcaactacctctataaaaagtaccccaagctgcggtcttatttcgtgtacggggagttcaaaaagtttagcggaaaacagaatctgaagtccttcaactttcttcacgacctggaagacgattctattaatatcattagcaacgacgatggcgagatcgtcgggaaccatcacgaaatgattgaggaactcgagaaagcctatcaatacaagtatatgctggtgtccagagaggttttcgaaaagaccggcgacctctttaatgtgacggtctacagccgcaaagctaagaaaacactgatccctatcaagcaggataaacccattaacatctacggaggctattctgggaataacgacgcctacatggctattgtgaaacttccgggaaagaagggcaagcctgatacctataaaatcgttgggattcccctgcggttcgccggagagctcgaaagagccaagcagctgggcgagtccgcttaccgcgaaaaactgagcgcggtgatcacacctcagtttaccaaggagaagaaagaccggaagaccggggagatcacaaaagtcgtggatgacttcgaagttgtgcttgatagagtcccctatcgccaactgtttaaggactctgataaatggttcatgctcggctccgccgcttaccagtataatgccaagcagctggtgctcaacaatgacgacgtgaaactgcttaacgagcagggacggaagaagctggaactccctaatgagaaactgagctctgccctgaacgatgtctttgaccatattatccaaattatgaactccaagttcggcctttacgataaaaatgggttcagaacgaagctgaccgaagctgccagcatcttttacgacctccccctgcgggcggagtataatggaaacaaaaaggttacagatggcaagctcgaggtgctggacaatattcttatcgggctgcacgctgatccgtccttcggaaacctgaaacagctcaatatgagcaccccttttggccagatgcagacaaaagggggcgtggtcctgaacggaaactctacccttatttaccaaagccccacgggcctgttcgaacgcagagtgaagctcaaggacctgtccaaatga

SEQ ID NO: 4193 - RNA, 4059 nt, synthetic construct
  misc_feature 1..4059: note = Cas9 variant
  source 1..4059: mol_type = other RNA
atgaagaaaatcctgggcctcgacctggggaccacaagcattggatgggccttcatcaacgagggcgaaaatgataacgagacgtcctctattatcaatgctggggtgagaattgtcccccttaccacagacgaagaggccgattttaagaaaggaaacaccatcagcatcaatgcggaccggacactgaagcgcggcgctagacgggggctccagcgcttcaaacaaagacgggatgccctgcttcagtcctttcgcggaattaacttcatctctagcaattacgtttatgccgaaaccggcaagcagacaaccttttcctcttacaagctgagagctaaaagcgccacggagctcgtgaccaaggaggaactggtgcaggtcctgctcatgctgaacaaaaagcggggctataaatccagccgcaaggctaagacagccgaggaaggggacgcgattgatggaatgaaaatcgccaaggagattttcgagaataaccttacccctggccaatgggtgtacaattctctgtccatcgggggaaaatttattccggacttctatagaagcgatctccagaaggaagttgagaaaatcgtgcggtttcagaaccagttccaccccgaacaaatgaatgagaagctgcttgaaaacatccagggcaaagctcgcacagtcacctctcagtacttttcccggattctgaatatccctctcgccgagaacaaggggacgagagaggaaacaaagctgcagcattataaatggcgcaacgaggctctgaccgaggaactcgacctgaaggtgcttgccttcattatcacagaaattaataaccaaatcaatcagagcaacggatacctgggcgcgatctctgatagatccaaagagctctactttaatcaggagaccgttggccaattccagtataaccagctgaaggaaaatgcccacaccaaacttaagaaccaggtgttctaccggcaagactatctggatgagtttgaaaagatttgggagacacagagcaaattctaccccgaactcaatgacgagctgaagtccgaggtcagagacatcacgatcttttatcagcgcaaactgaagtctcagaaacatctcgtgagcttctgcgaatttgagaaggggcacaaggctattcctaaatccagccccctgttccaagaatttcggatttggcagaacatcaataacatcgtggtcaagaatgagaccacaaaagagcctttccttctgggagaagatctcaagaaagttattgcccaggagctgtcttttaaggaatccatgaccgacagccagcttctgacattctgtgatctcaagaaaggcacccatacggtgaactttaagaaaatcgaggggaatagaacaaacacctctctgttcaaggcttttgaaaagattctggtgctcgagggatacgacgagctggatcttagcaagctggacgcctccgatatcaaatctattatcaagagcgccttctccgacctcgaaattagcaccgctatcctggatttcgacccgacaatccaaggcaacgattatgacaagcagtcttactaccagctgtggcaccttctctattccagcgaggaagacgattttctgaaaaagtctctgatggacaaattcgggtttaaggagtcccacctccccttcctgcttaatattaacctgcaggcggattacggaagcctctccgccaaagctatcaagaaggtcctgcctcatctgatggacggccacatttatgataaagcctgcacccttgtgggctacaatcattctagctccctcacaacggaccaaaacaatgaacgcgttctgaaggataccctggagctcctgaaaaagaactctcttcggaatcccgtggtcgagaaaatcctgaaccagatgattaatgtgatcaacgccatcattaaggaccctgctatggggaagcccgatgaaatcagagttgagctcgcccgcgaactgaaaaataacaatgagcagcggagcgaaatgacaaaggcgattaacaaatccaccacagagcacgagcaaatcagaaagctgcttcacaccgaatttgggattcatcgcgtgacgcggaatgacatcatcagatataaactctggaaggagtgtgatggcattagcctgtacaccgggaagccgatcgaaccttctaaactgttcacaaaggactatgatattgagcacatcattcccaaatcccgcctctttgacgacagcttctctaacaagaccatctgcgagcggcagctgaacatcgataaatccaataagacagcttacagctttttccaggaaaaactttctgccgaggaatttgaccagttcgagaagagagtcaagagcctgtttggaaaaatttcccggaccaagcaaaacaaactcctgatggccaataacgaaatccctgagggcttcattgatcgccagctgagagagacgcagtacatcgctaagaaagccaaggaaattcttctcgaggtgagccggaatgtcacagctaccatcgggtctgtgacagacaagctgagagatgactgggaactggttgatgtgatgaaagagctcaactgggaaaagtatgacaaactgggccttacctacattgaggagggaaagaatggcgaacgcctgtataaaatcaaggattggaccaagcggaacgaccatagacaccatgccatggatgcgatcacagtcgccttcacgaaacccgcttacattcagtatctcaataacctgaatgcccgcaccaacacagacaagaaaggaaattccatcattggaatcgagaacaagtacctgaaaagagataagaataacaaacttcggtttattgaacccatccctaacttccgcgaggtggctaaaaagcaactggaaagcatcctcatttcctataaagccaagaataaagttgtgaccaagaacaagaatgtcaccaaaaagtctaacggcacaaatcagaaaatccagctgacgccgagagggcagctccacaaggagacagtgtacggaaaactgcaacagtacgtgaccaaggaggagaaaattaacgcgaattttacccccgaatatgttacaaaggtcgccaagaaagaataccgggaggcccttctgaagcgcctcatcgagaacgaaaatgaccctaaaaaggctttcaccggcaaaaacgctctgagcaagaatcccatttatatctccctggagaacaatatccttgtgcctgaaaaggtgaaaattgtctggctgaagtctgactacacaatcagaaaagatattacgcccgacctcaagatcgataaagtgattgacatcgggctgaagaccattctccagaaccggctgaatgagtttaacggcgatacaaagaaagccttcgttaatcttgacgaaaacccgatctggcaaaacaaggagaaaggaatcgccattaagcgcgtgaccatcagcggcgtctccaatgctcaggcgctgcacaccaaaaaggatcatctcgggaacgagattctggacgaaaatggacagcctctgcccgtggattttgtttctacaggcaacaatcaccatgtggccatctatagagacgagaaggggaaccttcaggaagaggtcgtgagcttctttgaagctgttacgcggaataacctgggactctccattatcaataaaaaccacgagaagggctgggagttcctgtttagcatgaaacaaaatgagttcttcatctttcctaccgatgggttcaacccccacgaaattgacctcctgaatacagaaaactaccatcttatctctcgcaatatgtttagagtgcagaagattgccaccaaaaactatatgttcaaccaccatctggagacaaagtccgtcgacggcgaaatgctgaaaaccaagaagcagctcagcaaaatctcttaccactttattcagacaccttcctacctgaattatatcatcaagattcggatcaaccatcttggacaaattgtgcagctgggcgagtactga

SEQ ID NO: 4194 - RNA, 4059 nt, synthetic construct
  misc_feature 1..4059: note = Cas9 variant
  source 1..4059: mol_type = other RNA
atgaagcaggactactatatcggcctggatatggggaccgagagcgtgggatgggccgtcacagacgttgattacaacctcattaaaaagagaggccaagactattggggagtgtacctgttcgatgaagctcagacggcccaggggcggcgcgcgtttagaaccaatcggcgcagacttgctcgggtgcgccacagactgaacctcctgcaggagcttttcgactccgaaatctctgccaaagattttggcttcttttatcggctggagaatagcaagtacttcgacgaagataaacccgagattgcccgcgggaagtttctcctgttcaacgacaaggattttggagacaaagagtattacaagaattaccctacaatcttccatctgagaaacgctctccggacccaagaaattaaagatgtccgcctgctttatctggccgtgcaccatatcctcaagaatagaggccactttctgttcggcgagcaggactttaacgttaatgacgcttccgatgtgtctggggaatttgagaaaatcaaccggttccttagcgagaatgacggagccggcttcgatcgcgaaaagattccggagatcttcgaaacactgtgcaacgagaatctcgcgaagagagaacggaaagagaagattctggagctggccgggaactccaaaaataagctcctgggagaagctgtcaacgccgtggttggccttaacttttctctgagcaaaatgttcggggaggacagagattttcagggagaaaataagatgtccttcaccgacagctcttttgaggaaaaactcgctaaggcccgcatggcgctggatgacgatgaggccgacttccttgagacactgaagaaagtgcagtccgtcgctagcctccataacatcctgcacggcaaggaatttatttctgaggccaaaaccgaggcttacgaaacgcaccggagagatctgtccgaactcaagaaatatgtgcgcgagaattgtcccgagaagtacgccctggtgttccggagacaagtcaagaaaggcaagaaaaacaccagcggggccgacgaaaatgagaaggacgataaaaaggttaacaattatgctgcgtacatcggaatggacaagggcaaagggtttgaaaagtgcaaaaaggaggatttctatgcctttcttaaaaaggagattggaatcaacgacgaatctctgctcgctaagatcgatgagggcattttcctgcctaaacagatctccgccgaaaattgtgacattccctaccaggtgcatcttgccgagctgaaggctatcctcgccaacgcggaaaattacttcccttttctgaaacagaaggatgagaactgcgagatgacagtgagcgagaaaattatctccctgatgaagttccgcgtcccctattacgtggggccttttaccgacaaagaaacacggttctcttggatgatcaagaaggaaggactcagcacccagaaaattacgccgtggaattttgatgacgttgtggatagagacgcttccgagaagaaattcatcgaacgcatgacaaacttttgtacctatctgacaggcgagaaggtccttcccgccagctctttcctgtactccgagtatgcctttctcaatgaactgaacaacctgaaagtgaatggcaccaaggatcttcgggttaagaacattctcttcgactttgctaaaaccaataagaaactgacactgaagaaatgctgtgagcagctcgtgaagaacgggctgcttcctgaaggaagcaaggccagagacgtcttctctggcacggatggggactttaaaaatagcctgtcctcttacatcgatttcaagcgcattatcggagacaaagctgatctctatcgggacatgtgcgagaagatcattctgtggatcaccgtgattagcgataaagaaagactggtcaagatcattaaggacaaatacggcacagtgctttccgatgaggagatcaaggggctcaaagccctgaactacaccaagtggggccggctgagcgaaaaactcctggacggaattttcgagacagattctgaaggcgaggttgggaatgtgtccatcatcgagaagatgcgcaccgacacggaaaactttatggagcttctgagcaataaacacaactataagagagcgattgaactcgccaattctgagtccatcgtcgatgaacgggtgacatacagagctgttgaggagctgtattgtagccccgccgtgaagcgctccatttggtctgctctgaaaatcgtccgggaaattgtgaaggtgcagggacatagccctaaaaagatcttcgttgagaccaccagagaaaaacccgacgtcacacgcaagggccaaagaaccgtgtcccggaagcagcagcttctcgacaaataccgcgagaacctgagaaatgaaacagagctgatcaagaaaattgaggaaacggaggattctaagtttaacagcgacaaactcttcttttatttcacccagatggggaaggatgcctacacaggagaaaagatcgagtttgacgatgtgttcaaaaccgaaaagtatgacattgatcacatctacccgcggtccaaaattaaggacgatagcctggacaatcgcgtccttgtgagacggaaaatcaaccaatctgttaagaaggattcctaccctctgagcgcggagatccgcaacagaatggagggcctctggcggcagctgcgcgacaaaaagctgatttctgacgaaaaattttatagacttacacggtccacgcccctcaccgagaaggaatgcggggatttcatcaatgcccagctgattgctaccagccagtctgccaaagctgccatccaactgctcaagagaatgctgcctgagagcgagattgtgtactccaaggccggcaacgtcaatgaatttaaaaagcgccttgagttcgtgaaaatccgggaactgaacgacctccaccatgctaaggatgcgtatttcaatatcgttgtgggaaacgtctttaatacaaaattcaaccacaatcccgccgtgtttcagagaagcaacggcaccgggaattacgacttcgagcgcctgtatgattttgacattacaaacgcttggaagaaaggagatgaaaatcggatcagatctgttgccgagaagaacacctgtcgcgtggtccggttctccaagacggagaaaggccagttttacgacgccacaatttatcccgctgggaagaatgataaactggcccctgtgaagggaaaagcgccgcttaacgacaccagcaagtacggcgggtacgataaggaaacaaccgcttatttcatgctggtgaaatccagagacaagaaaaagaaagataagaccctcctgtctctcgagtgcgtcacagttctggccgacaagaactttcgcacggccgaagacaaacttaagtactgcgagaaagaactgggcctcaaggagcccgagatcctgattgagaaaatcaagctgaatacccttttcaagattaacggaagctatgcttggatccggggcagaacaaatgatcggctggtgctctgtaacgccaatcagctgtggctcgacaacgggtccgcgaaagaactgaagaaaatctctaatcattttcgcgatgtgaagaaatacaacaataaggaccttcctgtcagagaagaggagttcagcaaagaacaaaacctggctctctatgatctgtttaccgagaagctgggaggcaagatttacgccgggcttcccgtgcagggacagatcaaaaatctggaaaagggccgggacaaattcgaggccctcgaactgaaggatcaactcttcgttctgatggagattcttaaatttatgcaatgcaactccatgacatctaatatcaagctgattgggggcgctgagaacgccggaaagaatcgcatcagcaaactgatccaggactccgatgtgaagatgattttctgtagccctaccggctatttttgcaaagtcgtggacttcaagagatttctctga

SEQ ID NO: 4195 - RNA, 4059 nt, synthetic construct
  misc_feature 1..4059: note = Cas9 variant
  source 1..4059: mol_type = other RNA
atgaagaaaatcctgggcctcgacctggggaccacaagcattggatgggccttcatcaaggagcccgaaaaagatgtggtcggctccgagattgttgacatgggggtgagaatcgtgcctctttctagcgatgaagagaacgactttgctaagggaaatacgatttccatcaacgccgatcggaccctgaaacgcggcgcgagacggaatctccagcgcttcaagcaaagacggaacgctctgcttgaaatctttaaggagaaaaagctgatttctacaaatttcaaatacgccgaggacgggccgagctccaccttttctacactcaacctgcgcgccaaggctgccaaagaaaagatcgagctgcaggatctcgtcaaggtgctgcttcagattaataaaaagagaggatataaaagctcccggaaggctaaaagcgaagaggacgatggctctgccatcgactccatgggcattgcgaaggagctgtacgaaaacgatctcacccccgggcagtgggtttatgaggccctgcaaaaaggacgcaagaatgtgcctgacttctacagaagcgatcttcaggaagagtttaagaaaatcgtcaactatcagtctgagttctttcccgacattttcaatgcttcctttgtggaagactggatgggcaaggccagcacacctaccaaacagtacttcaacaagaaaggggttcaactggctgagaataagggaaagcgggaggaacgcagactccaggaatataaatggcgggccgaggcggtgaactttaagatcgatctgtctgaaatcgccctgattctctcccagatcaatagccagatttccaactctagcggctacctgggggctatctccgaccgcagcaaagagctttacttcaagaacctgacggtcggacaatatctctaccagcagattaaaaagaatccccacaccagactgaagggccaagtgttctatcggcaggattaccttgacgagtttgaaagaatctggtctgtgcagtccagcttctatcctcagctgaacgatgccctcaaacgcgaggtccgggacatcacaattttcttccaaagacgcctgaagtctcagaaacatctgatcagcaattgcgaatttgaggatcaccataaggttgtgccgaaatcccaccccgtgttccaggaatttcggatttggcagaacctcaataacctgcttctgatcaagaaggacaatctcaacgagaaattcgatctggagcttgaatctaagattgctctggccaatgagctcgcctttaaaagagaactgaacgtcaaggacgctctgaaaatcctcggcctgaagcctaatgagtgggagttcaactttaccaaaatcgaagggaatcgcacaaaccaagcgttctttgatgccttcgctaagattatcgagcttgaagacggagagcccattgacctgggcgatctcaaggccgacgatatcctggaccagttcagcgaagcctttctgcggattgggatcgataccgagcttctccaggttaattccgacattgagggagctgaatacgagaaacagagctatatccaattctggcatctgctgtactcttccgaagatgaccagaagctcaaactgaaccttatcagaaagtttggcttcaaacctgagcacgccaagattctggcgagcatctctctccaggatgaccacgcttccctgagctcccgcgccattaagaaaatcctgccccatcttcagtctgggctcatttacgataaggcctgtacgtatgctggatacaaccacagctcctcttttacaaaagacgaaaatgagaagcgggagctgagagccgaactggagctcctgaaaaagaacagccttcgcaatccggtggtggaaaagatcctgaaccaaatgatcaatgtcgtgaacgctattctcaaagatcctgagctgggccggcccgacgaaatcagagttgagatggcccgggagctgaaggcgaatgccgaacagcgcaaaaacatgacctccaatattgctagcgccacaagagaccatgataagtatcgggagatccttaaatctgaatttggcctcaagagagtgaccaagaacgacctgctgcgctacaaactctggctggagaccgatgggatttccctttatacaggaaagcctatcgaggctagcaaactgttttctaaggaatacgacatcgagcacattatccccaaagccagactcttcgatgactcctttagcaataagacgatttgcgaaagacagctgaacatcgataaagcgaatgtcaccgccttctcttttctgcaaaacaaacttagcgctgacgagttcgaacagtatcagtcccgcgtcaagagcctctacggcaaactgtctaaggccaaaattcagaagctgctcatggctaatgataaaatccccgaggactttatcgccagacaactgcaggagacacggtacatttccaagaaggccaaagaaatccttttcgagattagccgcagagtgtccgtgaccacagggaccatcacggataagctgcgggaagactggggactcgttgagattatgaaagaactgaactgggagaagtatgataaactgggccttacatacaccatcgaggggaagcacggcgaacgcctgaacaagattaaagactggtctaagagaaatgaccatcggcaccatgctatggatgcgctcaccgtggccctgacaaaacctgcttatatccagtacctcaacaatctgaacgccaagggacttaataacaaaaagggcaccgaggtcttcgccatcgaacagaagtatctgaaacgcgagaatgggaagctctgttttattccgcccatcgaaaacattagaagcgaggctaaaaagcacctgtcccggatcctggtgtcttacaaagccaagaataaggttgtgacaattaacaaaaataagacgaaaagcaaggcgggacttaacgagcaaatcgctctgacccctcgcggccagctccataaagaaacagtctatgggaagtccttccactactctaccaaatttgagaagatcggagccagcttcaatgtgcagaagattaacacagtggccaaaaaggaagagagagaggctctgctcaaacggctggccgaaaatggcaacgaccccaagaaagcgtttaccgggaagaacacgcttaataagatgcctatctacctggatctcggcaaaaacattaagctgtccgagaaagttaagaccgtcgtgctggaacagaattatacaatcagaaagaacattgaccccgatcttaaggtggacaaggtcatcgatgtgggaatcaaacgcattctggagagccggctcgaagagttcggcgggaatgctaagctggccttttctaacctcgaggaaaatccgatctggctgaacaaagagaagggaatttccatcaaaagagttaagattagcggcgtgtctaatgtcgaatcccttcacgtgaagaaagaccatttcggggagcctatcctggatcaagaaggaaacgagattcccgttgactttgtgagcaccggcaataaccaccatgtcgccatctacgaggatgaaaatgggaacctgcaggaggaagtggtttctttctttgaggctgtggtccgccagaatcaaggcctccctatcattaagaaaaaccacacactgggatggaagttccttttcaccctgaaacagaatgaatattttgtgttcccctccgacgactttgtgcctgccgatgtcgacctcatggatgagcagaactaccacctgatcagccccaacctcttccgggttcagaagattgctcggaaaaattatgtgtttaacaatcatctggagacgaaggccgtggacaacgatcttctgaagtccaaaaaggaactgagcaaaatcacataccacttctatcaaaccccggagcatctccgcggcattatcaagatccggattaatcacctggggaaaatcattcagatcggagaatactga

SEQ ID NO: 4196 - RNA, 4059 nt, synthetic construct
  misc_feature 1..4059: note = Cas9 variant
  source 1..4059: mol_type = other RNA
atgaacaagaaatactatctgggcctcgacatcgggaccaatagcgtgggatgggccgtcacagatgagaactacaatctgtataagtacgctggcaaaagaatgtgggggattcggcttttcgaagccgcggacacggctgccgagcgcagaatgaagcggtccaaccgcagacggctgtctcgcaaaaagcagagaatcgatctcctgcaagaactttttagcgaggaaattgttaagaaagacctgaccttctttatccggctcaatgagtcccgcctgcacttcgaggataagtctacaggagaaaaatatcccctgtttgtggacaaggagtacaccgatattgactatcataaacagtaccctacaatgtaccacctcagaaaggaactgatcgagaacccggagccccatgatatccggcttgtgtatctggcctgccaccatattctcaagaatcgcggccacttcctgatcaacgggagcatttccgacgtcaaaaatctttcttttgtgtgtggagaaatgatcaaggagttcaacagcgtttccgaatacgagattagcctgaccgatatcagagaactcgagcggattctgtctgacaaaaagacagctaaatccgtgaaggccaaacaggtcgctcagctgtttgagtgcacccctgccgaagataaggagcaacagaagtgtgcgaaagccatcatcacgaatctcagcaagctgattgtgggccttaaaggcaacatctctaagatgttccaccagcccctggaagagatttccaccaagagctttaagttcacagaagctaagtatgaggacgagatcatgcctgccattgaagagaattaccccgactatgcttctgttatcgatcgcatcaaaggggtgtacgactggtccgtcctcgtggaaattctggatggagaggactatcttagctttgccaaggtgaaagcgtacgaaaagcatggcaaaaacctgcacatcctcaagaatgtcatgaagaaatactgcaaggatgaggtttatcaggccttcttcaacgggattaacgagaaaaatggatacggcaactatatcggggctattagaaagaatggacatacctacaaaatggaccggtgtaagtccgaagaggatttttataagggcctgcagaaaatcctgtctacaatcgtgcctgaccaggaagatgaggagctcctggaaaaacttaaagccgaggtggaaaaccagaccctgctcccgctggctagaagcaaggagaatggcacgattcccaaccaggtccaccttcaagaactgatgaaaatcctcgacaatgccaaggagtacctggatttcctgaaaaaggaggacgaatatgggacaattgccgagaagatcatttccatcgctaaatttcgcattccttactacgtgggacccctcagccggagacacaaggaagagggctctaactcctggatgatccgcaaagaagaggggcggatctatccttggaatttcggagacaaggttgatgtggagcagagcaacaaagaatttattgagagaatgaccaataagtgcacatacctgatcggcgaagacgtccttcccaagaactctctgctctatagcaaatacatggtgctgaatgagctgaacaatcttaagattcgcgggaacaaaatctccgttgaactcaagcagcggatttataaagatctgttctgtaccatggcgaaggtgaccggaaagagaatcctggagtacctcaaaatggaggacccggaaatcgtccaagaggatatttctggctttgacatcgatttcaagagcgccctggcttcctatcttgactttaaaaagcaagtggtcggcaacgaaattgagaaagatcattacaaggagatcattgaagagatcatcaagtggaaaacaatttacgacgatgacagcaagatgatgcgccggatgatcgaaagagagtatcctgaagtgttcgataaagagcagattaagaaaatctgccagctgaagtactctgggtggggaaatttttccgaccgcttcctcaacggcgttagaggggccgacaaagagacggaagagagctataccattatcgaagccctgtggaagacaaattacaacctgatgcaacttctctctaagcagttttccttcaaagaggaaatcgatcagattaatgctgagaaggccggagacgtgggcaaaatcaactatgagaataccgtcaaggatctgattgtgagcccctccaacaaacgggcgatctggcagacaattcaaatcgctgaagagattaagaaggttatgaaatgtgaacctgagcggatcttcatcgaaatggcccgcgggggcgagaaggagaaaaagagaaccgtgtctcggaaaacgagactgcaggaactctacgccggatgcaaggacgatacacgcaattggatgaaggagattggcgaccgggaagagagagagtttaacagccgcaaactgtatctttactacacccagatggggaagtgtatgtataccggagatgaaatcgacgtcgatgctctgatgaaaggcaattccaactgggacattgatcacatctacccccagtctagaattaaggacgatagcctcgacaatatggtgctggtgcggaaagacgttaacaataagaagcgcaacaaaatcctgtcccccaagatcagagaggatatgaaagggtattggacaatgctttgccaaaagggactcattagcaaacggaagtacgaccgcctgaccagaacaacggatttcaccgacgaggaactgtctggctttatcgaacggcagctcgtcgagacacgccagtccagcaaggccgtggctgagctgcttaacagactgtataaagattctgaagtggtctacgtgaaggccgggctcgtttccgacttccggcatgataatgacctgctgaaaagccgcagagtgaacgattatcaccatgcgaaggacgcctttcttaatattgtcgtgggcaacgtttaccacgtgcggttcacctctaatcctagaaaatggatcaaggataaccgcgacagcaattactccattcggagagtctttaactatgacgtgaaacagggagataagatcgtttggcacggcagcgagaatgggggacattctatcgaccaaattaagaaaatcatgtcccgcaacgatattctctacacagaatatacctactgcgagaagggccagctgttcaatgaaacgctggctaaaaaggggaacgagaaagccatcgctctcaagaagaatctggacccggtgaaatatggaggctacaccacacccaagaccagcgcctttgcgttcgtcgagtttgatgggaaaaagaaagaacggaagaaccacattgtggagatccctgtgtatgtcgttaatattgccaagagagaacccgacgctgtgaaaaagtaccttgaggaacgcaaaggctactccaacgtggtcatcaagaaatatcctatcaagaagaactctctgattaaaatggatggatacctcgcccggctgagaggcgctaatgagaaggacatcattctgaaaaacgccgtgcagcttatcctgaataaggatctctatgagattgttcgcaaaatcgaaaagtacctggagtataacctccaataccaggccgacgctaaattcgaagggtttacaatgaaggatctgaatatgatctatgaggagctttacctgaagctcaaagaaagcattttccagaagcggcccgcgcagcaaatgaaaaccctggagaagggaaaagaagccttcatctccattgagaacctgggcgaaaaggctaaggtgatcaatgagattatcgccatgtttagatgtgacgccacgacagtcgctaaccttaaagtgatcaatgggtctcagaacgccggaagcatgaaggttaataaaaacaccctgacatccaagtctctcaaactggtgcatcagagcattaccggcctcttcgagaccgaagaggaactggtctga

SEQ ID NO: 4197 - RNA, 4062 nt, synthetic construct
  misc_feature 1..4062: note = Cas9 variant
  source 1..4062: mol_type = other RNA
atgaagaaaaagtactatctgggcctcgacatcgggaccaacagcgtgggatgggccgtcacagatgagaattacaacctgtgcaaattcaatggcaagaaaatgtgggggattagactttttgaagacgctaagacggccgcggagcggcgcaccaagagatccaaccggcgcagaatcgctcggacaaaacagcgcattgatctgctccaagaactgtgtgagaagtctatcttcgaaaaagaccccacctttttcattagacttaatgagagctccctgcacctcgaggataagtctacaggagaaaaatatcctctgtttgttgacaaggagtacaccgatatcgactatcatcgggaatacccgacagtgtatcatctgcgcaaggagctcatcgagaaccccgaacctcacgatcccagactggtgtaccttgcctgctgtcacattatcaaaagccggggccatttcctggtcaatgggtccatttctgacgccaaggatctcagctttatctgcgagaacatgattaattccttcaacgctgccagcgactacaaaatcaatattcaggatatgaccgctctggaaacgatccttaccgaccgcaagatggccaaatctgtgaaggcgaaacagatcgttcagctgtttaagtgtattccttgcgaggacaaggaacaacagaaatgttgcaaggccatcattacaaacctctccaaactgatcgtgggactgaagggcgatattagcaaaatcttcaatgagtcttttgaggaaatcaagtccttcaagtttgctgagaccaaatatgaagacgagattctccccacaatggaagagatctaccctgatcacgccgagattatcgaaaagattaaaagcatctatgactggtctatcctggatgagattcttgacggcgaagagtacctgtccttcgctaaggtcaaagcctatgaaaagcacaagaaaaacctccatgatctgaagatccttattaaaaagtactgtgacgatgagacctatcagagcttctttaatgggatgaacgagaaaaacaagtactccaattacatcggatctattagaaagaacggccacacgtataaagtggaaaagtgcaaaagctccgaggacttctacaaggaactgctcaaactgctgagctctgttaatccggggcaggaggatgagtccctcctggaacaaatcaagtttgagacagaaaaccagacccttctgcccctcctgcggacaaaagagaatggaaccattcctaaccaggtgcatatgcaggaacttatcaagatcctggacaatgcgagcaagtatctcgacttcctgaacgagaaagatgagtacggcaccacagccgacaagattatctctattgctaaatttaagatcccctattacgtcgggcctctgagcgatcgccacaaagaaaatggatccaactcttggatggtgagaaaggagaatggccggatttatccctggaacttcgacgataaggtggacgccgaaaagagcaataaggagtttatccaaagaatgacgaacaaatgtacctacctcatcggcgaagatgtcctgccgaaaaattcccttctgtacagccgctatatggttctcaacgagctgaacaatctgaaaattcgggggaacaagatctctgtggagcttaagcagcagatttacaatgacctcttctgcacaaaagctagagtgaccggaaagaacatcctgaattatctgaaaaaggaagatcctgagctcgccgccgaagacctgtccggctttgatgtcgacttcaaaagcgctcttacatcttacctggattttaagaagcaagtggttgggaacgagattgaaaaagactattacaaggagatcatcgaggaaattatcaaatggaagaccatttataatgaggactccaaaatgatgaagcgcatgatcggacgggaataccccgagacgctcaaccaggatcagattaaaaagatctgccacctgaagtacaatggctgggggaacttcagcgagacatttctgaatggaatcaaaggcgcgaacaaggaaaccggcgagtgttataccattatcgaagccctttggaaaacaaattacaacctcatgcagctgctgtccaagcaattctctttcaaagaggaaattgaccagatcaatgctgagaagaccggggccattggaaagatcacatatgagaacctcgtgaaagatctggtcgtgagccctgccaacaagagagctatttggcagacgatccagatcaccgaagagattaaaaaggttatgaaatgcgaacccgagcgcatctttattgaaatggcccggggcggggagaaggagaagaaaagaacagtgtcccgcaagacccggcttcaagaactgtacacaggatgtaaagacgataccagagactggatgaaggagatcggcgatcgcgaagaacgggagttctctagcagaaaactctatctgtactatacgcagatggggaagtgcatgtacaccggcgaggagattgacgtcgatctgcttatgacagctaattccaagtgggacatcgatcatatctacccccagagccggattaaagacgattcttttgacaacatggtgctcgtccgcaaggacatcaataacaatgtgaaaggaaacaatattgttccttccagcatccagaaggaaatgacctcttattggaaaatgctgctgcaaaaggagctcatttccaagaaaaagtacgaaagactgacacggagcaccgatttcacggacgaggagctttctggctttatcgaaagacagctggtggagacacgccagagctccaaagcggtcgccgccctcctgaaccggctgtataagaatagcgaaatcgtgtacgttaaagctgggcttgtgtctgatttcagacacgacaacaagctcctgaaatcccgcagaattaatgattatcatcacgccaaggacgcttttctgaacatcgtcgtgggaaattgttaccggaccaagttcacagccaacccgcgccagtggattaaaaagaatagagataccaactatagcatccggcgcgtgtttgacttcgatattaaacaaggcgacaagatcgtttggtacgggaacaaaaatgagaacggaaagcataccattgatcagatcaagaaagcgatgtccagaaatgacatcctctacacagaatatacgtactgcgagaagggcaaactgtttgacgagacccttacaaagaaagggaacaagaaggccattcccctgaaaaagaatctcgatcctctgaaatatggcggatacacctctgtcaagacaagcgctttcgcctttatcgagttcgacgataaaaagaaggaacggaaaaaccacattgtggaaatccccatttatgtggctaatatcgccaagcgcgagcctgaagcggtcatcaaatacctggaggagcagaagggctatgtgaacattgttgtgaaaaagtaccccatcaaaaagaactcccttctgaagattgacgggtacctcgccagactgcggggaggcgattctagcatcattaccctcaaaaatgctgtccaactggtgcttgacaagaaatcctatgaaatcatccgcaaggttgagaaatacctggatcacaattctaagtatgaagccaacagcaagctcgagaaattcaatgaaaacgacctgaatattatctacaacgagctgtgtcttaagctgagaaattccatttatcagaaacggccggtgcatcagctcgagacgctggaacaggggatcgataactttagaagcctcgagtctctgaaggacaaagctaagattatcaacgaacttctggccatgttccgctgcgatgccaagacaggaatggacctccggctgattggcggggcttccaatagcggcagaatgcgcatctctaaatcccggctgaccagcaagtctcttaaactgatcaaccaatccgtcaccggactctttgagacagaggaggaactggtgtga

SEQ ID NO: 4198 - RNA, 4062 nt, synthetic construct
  misc_feature 1..4062: note = Cas9 variant
  source 1..4062: mol_type = other RNA
atggagaagaactactatctgggcctcgacatggggaccagctccgtgggatgggccgtcacagatgaaaattacaacctgatgagaaagaagggcaaagacctttggggagttcggctgttcaaggaggctaaaacgtctgccgaacgcagagtgaagcggaccagccgcagacggctccagcgcgagaaggcgagaatcgggtatctgaaagaactttttgctgatgagattaataaggtggacgccggcttctaccaacggatggaggattccaaatttatctctgacgataagacagtccaccagaaattcaccctgtttagcgacacaaactataccgatgaagactactataatgattaccccacaattttccatctccgcaagaagctgatcgagtccgacgatgaatacgacgtgagaatggtttttctggccctcctgaacatgtataaacaccgggggcatttccttaatgctaacctgtctgacaatggaatgggcgatattaacgagcagtacgaccgcctcaaggagctgtgcagcgaatatcttaatgtggagtgggaaaacaaacctgataagtttgaggaaatcctgaaagagtgtaattgctccaacagcctcagaaatgagcggctgctggaaaccttcaacctcaagaaaacggacaaggagaagtgtgaaatgctgaaacttatctgcggcctgtctgggaccctctccaagatttttaaagatctggacgatgacagcgagacaaagaaaatgaccatctctttccgctccagcaactacgatgaagaggccattaatgtcgaggaaatcattggatctgagaactttgaaatcattgctgtgcttaaggagatccacgactggtccatgctggccaatatcatgagaggcaagaaatatctcagcgttgcgcgggtggaagagtacgagaagcataaagatgacctgaagattctgaaaaaggtcatcaaggaatattccattgaggaatacaacaatttcttcagagtgatggccgacaacaattactctgcttatgtgaacagcgtcaattccaacaaagagagcacacgcagaggggccaagtgtgataatgacacctttttcaaagagatcaagaaaattgttaacaagtgctacgattctgaagagaaggaatatatcctcaaagagatcgaaaagggaacgtttctgccgaaacagattatctccagcaatggcgtgattcccaaccaagtgcacaagatcgagatgaaaaagattcttcagaatgctgagaaatacctgcctttcctcacagaaaaggacgattctgggctgagcgtctccgagagaatccttcagatgttttctttccagatcccctattacattggacctatcagcggcaagattggctccgacgagaaaagcaagaactcttggtccgtgcgcaaagagaaggggcggatctatccctggaactttaaagataagattgacgaaaaggagagcgccgagaaattcatcgaaagaatggttaatcactgtacctacctgaacaatgagatggtgctccctaagaactctctgctgtacgaaaaatttatggtcctcaatgagctgaacaatcttaagattaacaatgaaaacatctccgtggagctgaaacaaagcctctataataacctgttcaagacaggaaagaaagttaccgcgaagggcatcaaatcctacctggagcgcaatgggctttgcgaaccgaacgaggatattaatctcaccggaatcgacggcgattttacaaaccggctgtctaactatgccaagttcaaagggatttttaatacggacgaactgacctacgagcagtggaacatggctgagaagatcattaagtggagcacaatctatggagattccaaaaagttcctcgaagagaaaatcagaaatgaatactctgagaagctggacagccagcagattaaacgcatccttggcattaagttccgggactggggcagactgtccgaagaactcctgaacatggagggggccgatgtgaataccggagaaatcaaaagcgtcattggccgcatgtgggacgagaactataatctgatggaacttatcgctacagataactttacctacaagcaagtgatcaaggagaaacagaatgggctcgacaagtctctgtccgaaattgattacgacgatctggacgagctctatgtcagcgcccccgtgaaacggatgatctggcagacgctgcttattatcaaggagctggtttctgtgattggatacgaacctacaagagtcttcgtggagatggccaaagatgttaacaccgaaaagaagcggaccgactcccgcaaaaagaaatttctcgatctgtataagcaatgtgagaaagacgaaagagatttctggatcaaggagatcgacgacaagagcgaggctgaatttcggaaaaagaaactgtacctttattacacacagaagggcagatgcatgtataccggggagcagattaatcccctcgatctgacaaacgacaatctgtacgatatcgaccatatttaccctcgccacttcgtgaaagatgactctatcgaaaacaatctcgtcctggtgaagaaggagaaaaacgcgcataagagcgatacgtttcccattgaggacgatatccggaaaaaccagtatgccttctggaagatgctttacgagaaaaattttattaccaaggtgaagtatcaaagactgacacgcaaagagccgttctccgacgaagagaaggctaactttatcatgagacagatcgttgaaacccggcagggcacaaaagtcattaccgatatcctcgaaaagagcttcgacaaaacgcagattgtgtacgtgaaggccggaaatgtctctctgtttcgccaaaaatatgagtgtatcaagtgcagagaaattaacgacttccaccacgccaatgatgcttacctgaacatcgtggttggcaatgtgtatgacaccaagttcacatccgatcctcggaactttatcaaagagtaccgcaagaatccccagaaaaacgaataccatatgtataaacttttcgactacaatgtccagagaggggatcgggtggcctggaccgcgagcaacggagagtccatgaaagttgtgaagggcacactcaagaaaaatacccctctggtcacgtttatgtcttatgaggaacacgggggactgtacgaccagaacattatcagcgctaaggatattgagaaagtgaagggcaaagggtatctccccatcaagtcctctgacagccgcctgaataacacagaaaagtacggcggatatgccaaagtttccggcgcctacttctttgtggtcgagcataccgtgaagaatgtgcggattcggacaatcgaacccatgccttgctaccttaccaaagtcctgaccacaaaggagaaaatcgaagattattgttgcaacattctcaagtacgactctccggttgtgaagtatgagaaaatcaagatgtacagcctgattaaagtgaacgggtatcccatgtacctgacgggacgcaccggcaatcaacttatcgtctccaacgggattcagctggtgctcagctatgatgaggctaagtacatcaaagacctgctcaagattaatcaggaagagttcgatcagaacagactggaaaatcttggaatcaacaaatttcggaatgagaagctgtacgacacactcaacaagaaatataccaatgagatctacaagaaaagacctaactctatgggcaataagatgattgaatggaaaaacacattccaaaatctgtccatcaaggaccagaccgaggttctgcttcagctgattcaactcgggcagaagcagaacagcggcgtgaatctggaaaaactcggagcctctaagaaaacgggcgtctccctggtgagcaagaaaatcacagataaggagtcttttgaacttattaacaagtccatcaccgggctgtatgagaacaaagttgacctcctgcgcgtgtga

SEQ ID NO: 4199 - RNA, 4062 nt, synthetic construct
  misc_feature 1..4062: note = Cas9 variant
  source 1..4062: mol_type = other RNA
atggccgctttcaagtactatctgggcctcgacatggggaccaacagcgtgggatgggccgtcacagatcccaattacaacctgcttaaagcgaagggcaaagacctgtgggggatcagagagtttaatgaagctagcacggccgttgagcggcgcacccacagaatttctcggcgcagacggcagcgcgaacaagtgagaatcggactcctgaaggattatttccatgacgccattggcgaggtggatcctgactttttccagcggcttgctaacagcaaataccacctggaagataaggacacagaggtccgctataagaataacgtgtttaatgatgacgattacaccgacaaagattatttcgaccagtacccgacaatctaccatctcagaaaggagctgattgaatccaccgacaaacacgatgttcggctggtgtttctcgccctgcttaacatgttcaagcatcgcgggcactttctcaattctggactgggcgagaacagcggcgaaaataacatcaataacgcttatctggagcttacaaatctgctctccgagttcacccagtacaacctgaacgaaacgatcgacgggaaaaagattgaggatatcctgtctagacgggacatgagccgcaccagaaaggccgaaggactcgcggagattctgggcgtcgattataaaaataagccctacaaagaacttatccgggggctgtgcggactcaagtttaacgcctgtgctattttccctgagatccaatccgacgaggtgcccaaactggatatttgccttagcgaagcctcttttgacgagaagtccgatgaaatcgctaatatcctgggcgaggactatttcgaaattatcatggccatgaaagatatttacgacatcgggagcctcgcgggaattatgaagggccacaactatctgtctcaggccagagttacatcctacgagaagcataaagaggacctgcgcctcctgaagaatgtgatccggaaatactgtagcaaggaagattatgacaacttctttaattctgaggctgatggctcctacgccagctatgtcgggtcctacaactctaaaaccaagcagagacgcgtgggaaataagcggagctccgaggaactttataaagctatcaagaaaattctgaagaacgtgcctgccgaagacgccgatgtccagagaatcctcatgagcattgagaatgagacattcctgcccaaacaacttaccgcttctaacggcgttatccctaatcaggtgcacgcgaaggaaattaagaaaatcctgtccaacgccgagcgctacctcccgtttctgcgggaaaaggacgagacggggctgagcgtgtctgagaaaatcatgaaactcttcagctttcagattccctattacgtcggacctacaaccgaaaaatcctctaaggatggcgggaatggatgggtggttagaaaggaggaaggccaggtgctgccctggaacatcgacgagaaaattgatatgaaggctacaagcgaagccttcatctcccgcatggtccggagatgcacctacattagcggcgagcctgtgcttcccaaatcttccctggagtatcaatccttttgtgttctcaacgaaatcaataacattaagatcgacggggagcgcatctctgtggaactgaaacaggatatttacaaggaggtcttccagaaaggaaagcgggtgaccaagaaacaactgtgcaagtatcttcatacaagaggcatcattgaagccgaggagcaggtcacggggatcgacgtgaccattaataacgctctcacaacctacggaaaatttaaggccatcctgggcgatgacatctccaaagacagcgttcagaagatggtggaaaatattgtcttctggtgtacagtgtatggggattccaagaaatttctgaaggaccggatcgaggaaaaatacggcgagaagctcaccaaagaacagattaagcgcatcgttggattcaagtttaaagattggggcaacctgtctaagaatttccttgagctgagcggggcggacgtgtccacgggagagtctgtcagcattatcagagctctctggaacaataacctgaatctgatggaacttatcaactcccggctctataattacaaagagagactggccgaataccaaaacacaatgatgaagaccctgagcgatattgaggccgaggacctcgatgaatattacttctctgctccggtgaaacgcatgatctggcagaccattctgatcattaaggagcttgtgaaggttctgggctgcgaacctgaccggatctttgtcgagatgacaagacgccccgatgaaagaaaaatgcggaccgagtcccgcagaaagaaattcgaggaactctataagaaagtgaaggacgaggatgtggactggatgaaagtcatcgcccacgctgatgaaacagggagcattcggtctaagaagatgtacctgtatctgacgcagaaaggacgctgtatgtacaccggcaagcacatcgagctttccgacctctttaataacaacctgtatgacattgatcatgtgtaccctagacacttcgttaaagacgataatatcgacaacaatctggtgctcgtctgcaaggaaaagaacgcccataagagcgatatttaccccctggaggacgagatccttgcgtctcagaagaatatgtggagcgaactgcggcgctccgggtttattacagaggaaaaatataacagactcatcggccggaatagcttcaccgatgagcaaaaggccggatttatcgctcgccagctggtggaaacatctcagggcaccaaaggggttgccaacattctgcagcaacttctccccgagtccaagatcgtgtacgctaaagccagcaatgtctccgagttcagaaacacgcgggacattcctaagtctagactgatcaatgaatttcaccatgcgcacgatgcctatctgaacattgtggttggaaatgtgtactatgtcaagttcacccagaacccgctcaattttatcaaaaacgactacgatcgcgacaagaccaaaaacaattataacctgagcaagatgttcgactgggatgtggagcggaatggcgaagtggcttggatcgcccagaaaaaggacggggaggctggaaccattgccacagtcaagaaagttcttggcagaaacacacccctgatgacgcgctactcctttgaggggaagggcggactcacaaatgaaaccctgtactctgccaaaaaggctaaagaggaaggctatatccctttcaagagctccgatgagaagatgaaagacgtgacaaagtacgggggattcacctctgtgaccggcgcgtactttttcctggtcgaacacacagagaaaaagaaacggagcagaatgattgagtccgtgcccctttatctggcccagaagatcgaacaaaaccctcatgagctcgaaaaatattgtgagcaggttctggggctcattgattttgacatccgcgtgcggaagatcaagattggaagcctgatcaaaagaaagggctacttcttttatattacggggaaaaccggccaccgccttatcctgcggaatgctgtcaacatgtgcctcaagaaagaatgggtgaagtacatttctaagctggagaaagccgttgataagaataacgtggagggaatcattacaaaagaaaagaatgagctgctttactccgaactgatcgagaaattcaagaacagcatcttttctaatagacccaacccggtcggcgacaagctcgatgaagccaaagagaagttcattaatctggacatcgagaaacagtgcattgtgctctgtcaaatcctgcagctttccagcgttctggggtctgaatgcgatatgaccctcctgggagagtccgctcattgtggcaagattctgatcagcaaaaagatcggggacgaagatatttatcttatcaaccagtccgtgacaggactgtacgagaagaaaattaatctccggaccgtctga

SEQ ID NO: 4200 - RNA, 4065 nt, synthetic construct
  misc_feature 1..4065: note = Cas9 variant
  source 1..4065: mol_type = other RNA
atgaagaaaatcctgggcctcgacctggggaccaacagcattggatgggccttcatcaatgaggctgaaaacgagattgaagtgtcctctatcgtcaatacaggcgttagaattgtgccccttacgaccgatgaggaaagcgactttaagaaagggaacacaatctccatcaatgccgatcggaccctgaagcgcggagcgagacggggcctccagcgcttcaaacaaagacgggaggctctgcttgagacatttaaccgcattaagttcatcgccaccgactttgtgtacgccgaaacaggggctgccaccacgttctctagctatcagctgagagctaagtccgccgtcgaggcggtgaccaaagaagaactcgttaaggtgctgctgatgctcaataaaaagcggggatacaaatctagccgcaaggccaagacagctgaggaaggcgatgccattgacggcatgaaaatcgctaaggagatttttgaaaacaatctgacccctgggcagtgggtctataactcccttagcaaaggaggcaagttcatcccggatttttaccactctgacctgcagaaagagctcgaaaagattgtgagattccaaaatcagtttcattccgagcagatcaacgataaactgcttgccgacatccaggggaaaagccggacacaaacctctcagcacttctccaagacgctgaatattcccctcgcggagaacaaaggaacacgcgaagagaccaagctgcagcattatcagtggagaaatgaagccctggctaacgagctcgatatgaaaatcctggcctttattatcacagaaattaacaatcaaatcaaccagagctctggctaccttggggctatctccgaccggagcaaggagctgtatttcaatcaggagaccgttggacaataccagtacaaacagctccaggaaaacgtgcacgccaagctgaagaatcaagtcttctatcgccaggattaccttgacgagtttgagaaaatttgggagacccaggccaagttccattccgaactgaacgagaaactcaaggctgagatcagagacattacaatcttttatcagcggaaactgaagtctcaaaagcacctggtgagcttctgcgaatttgagaaaggccacaaggcgattcctaaatccagccccctcttccaggaatttagaatctggcagaatctgaacaatgtggtcgttaagaacgagacgaccaaagaggtgttcgaactttctgaggaactgaagcagctcatcgccgaggaactgcaatttaaggagtccatgacagatgtgcagatgcttaccttctgtgagctgaaaaagggcacacataccgtcaattttaaaaagattgaagggaaccgcacgaatacaagcatctacaaggctttcgagaagattctcgaagtggagggatatgaaatcgacttttctaaaatgaagcctctggagattaaggagaccgttgcccccatcttcgaaaccctgaacattaatacagtgatcctcgatttcgaccctaccatccagggcaacgattttgacaaacagccgtactatcaactgtggcaccttctgtacagcgccgaggatgacgataagctcaaagaaacactgaagacgaaattcgggtttaaggagaaccatctgcccttcattcttaatatcaacctccaggctgactacggatccctgtctgccaaggcgattaaaaagatcctgcctcacctcatggatggccacatttatgacaaggcttgcctgatggtcgggtacaatcatagctccagccttaccacagcccagaacaatgaccgggtgctgaaggataccctcgaactgctgaaaaagaactctcttagaaatcccgttgtggagaagatcctcaaccaaatgatcaatgtcattaacgccatcatgaaagaccctgctatgggaaagcccgatgagattcgcgtggaactggcccgggagctgaaagctaataacgaacagagaaagaaagccacatccgacatcaataccgcgacgaccgagcacgagcgcattcggaagctcctgcatagcgaatttaacatcccgagagtcacacgcaatgatatcattcggtataaactttggctggagaccggcggcatctctctctacacagggaaccctattaaagcctccgacctgttcagcaagaactatgatatcgaacacattatccccaaatccagactgtttgacgattctttcagcaataagaccctttgtgagcgccagctcaacatcgacaaatccaataagacggcttactcttttctgcaggaaaaactgagcgagaacgatttcgccgcttatgagaatcgggtgaaggacctctttaagacaggaaaaattaagtcctacaccaaatacaagaaactgcttatggccgataacgaaatccctgagggcttcattgacagacaactgcgggaaacacagtatatcgcgaagaaggccaaagagattctcctggaagttagccgcaatgtgaccgctaccatcgggtctgtcacagacaagctgagacaggattgggagcttgtggacgttatgaaagagctcaactgggaaaagtacgataaactgggactgacgcatattgaggaaggcaagaatggggagcggctctccaagatcaaagactggaccaagagaaacgatcaccgccaccatgccatggacgctatcacagtggcctttaccaaacccgcctatattcagtacctgaataaccttaatgctaagacacaaggcgaaaacaaagcgaatagcatcattggaatcgagaacaagcacctgtatcgggataagaacaataaactcagattcatttctcccatgaagaacttccgcgaggaagccaaaaagcagctggagtccatcctgatcagctacaaagctaagaataaggtcgtgaccaaaaacaagaatacgaccaaaaagtctggcgggacaaaccagaaaattcagcttacccctagaggacggctgcataaggaaacagtgtatggcaaactccaacagtacgccaccaaggaggagaaggttaatgccagctttacagaagactacatccagaaagtcgctaagaaagagtatcgcgaagccctgctcaagagactggaggaaaacgataatgacccgaaaaaggcgttcacggggaagaacgctcttaataaaacccccatttacatctccctgaaggataacattatcgtgcctgagaaagtgaagacagtctggctcgagaccgactatacaatccggaaagatattacccccgacctgaagatcgacaaggtgattgatgttggaatcaaacgcattctgcaaaatagacttaacgaatttaatggcgaccctaagaaagccttcgtgaacctgggggagagccccatctggctcaataaggaaaaaggcattgccatcaagcgggtcacgatctctggagtgtccaacgctcaggccctgcacaccaagaaagatcacctcggcaacgagattctggacaagaatgggaacccgatccctgttgattttattagcacaggaaataaccatcacgtggcgatctaccgcgacgaaaaaggcaatcttcaggaggaggtcgtgtccttctatgatgctgttattagacggaacctggggctctctgtgatcaataagaaccatgaaaaaggatgggagtttctgttcagcatgaagcagaatgaatttttcatctttccctccgacggcttcaaccctcacgagattgatctgcttaatcccaacaattaccatctgatctctcctaacattttccgcgtccagaaaatcagcaccaagaattatatgtttaaccaccacctcgaaacaaaggccgtggacggggagatgctgaaatccaagaaagagctctctaagaccagctaccatttcattcaaacacccaccaacctgaatggcatcatcaaagtgagaattaaccaccttggaaagatcgtccatctgggcgaatactga

SEQ ID NO: 4201 - RNA, 4065 nt, synthetic construct
  misc_feature 1..4065: note = Cas9 variant
  source 1..4065: mol_type = other RNA
atgaagaaaatcctgggcctcgacctggggaccaacagcattggatgggccttcatcaatgaggctgaaaacgagattgaagtgtcctctatcgtcaatacaggcgttagaattgtgccccttacgaccgatgaggaaagcgactttaagaaagggaacacaatctccatcaatgccgatcggaccctgaagcgcggagcgagacggggcctccagcgcttcaaacaaagacgggaggctctgcttgagacatttaaccgcattaagttcatcgccaccgactttgtgtacgccgaaacaggggctgccaccacgttctctagctatcagctgagagctaagtccgccgtcgaggcggtgaccaaagaagaactcgttaaggtgctgctgatgctcaataaaaagcggggatacaaatctagccgcaaggccaagacagctgaggaaggcgatgccattgacggcatgaaaatcgctaaggagatttttgaaaacaatctgacccctgggcagtgggtctataactcccttagcaaaggaggcaagttcatcccggatttttaccactctgacctgcagaaagagctcgaaaagattgtgagattccaaaatcagtttcattccgagcagatcaacgataaactgcttgccgacatccaggggaaaagccggacacaaacctctcagcacttctccaagacgctgaatattcccctcgcggagaacaaaggaacacgcgaagagaccaagctgcagcattatcagtggagaaatgaagccctggctaacgagctcgatatgaaaatcctggcctttattatcacagaaattaacaatcaaatcaaccagagctctggctaccttggggctatctccgaccggagcaaggagctgtatttcaatcaggagaccgttggacaataccagtacaaacagctccaggaaaacgtgcacgccaagctgaagaatcaagtcttctatcgccaggattaccttgacgagtttgagaaaatttgggagacccaggccaagttccattccgaactgaacgagaaactcaaggctgagatcagagacattacaatcttttatcagcggaaactgaagtctcaaaagcacctggtgagcttctgcgaatttgagaaaggccacaaggcgattcctaaatccagccccctcttccaggaatttagaatctggcagaatctgaacaatgtggtcgttaagaacgagacgaccaaagaggtgttcgaactttctgaggaactgaagcagctcatcgccgaggaactgcaatttaaggagtccatgacagatgtgcagatgcttaccttctgtgagctgaaaaagggcacacataccgtcaattttaaaaagattgaagggaaccgcacgaatacatgcatctacaaggctttcgagaagattctcgaagtggagggatatgaaatggactttagcaaaatgaagcctctggagatcaaggagaccgttgcccccattttcgaaaccctgaacatcaatacagtgattctcgatttcgacccttctatccagggcaacgattttgacaaacagccgtactatcaactgtggcaccttctgtacagcgccgaggatgacgataagctcaaagaaaccctgaagacaaaattcgggtttaaggagaaccatctgcccttccttctcaatatcaacctgcaggctgactacggatccctgtctgccaaggcgattaaaaagatcctccctcacctgatggatggccacatttatgacaaggcttgtcttatggtcgggtacaatcatagctccagcctgacgaccgcccagaacaatgaccgggtgctcaaggatacactggaactgcttaaaaagaactctctcagaaatcccgttgtggagaagatcctgaaccaaatgattaatgtcatcaacgccatcatgaaagaccctgctatgggaaagcccgatgagattcgcgtggaactggcccgggagctcaaagctaataacgaacagagaaagaaagccacctccgacatcaatacagcgaccacggagcacgagcgcattcggaagctgcttcatagcgaatttaacatcccgagagtcacccgcaatgatattatccggtataagctgtggctcgagacaggcggcatctctctgtacaccgggaaccctattaaaggatccgacctgttcagcaaggattatgacatcgaacacattatccccaaatccagactttttgatgactctttcagcaacaagacactctgcgagcgccagctgaatattgataaatccaacaagaccgcctactcttttctgcaggaaaaactcagcgagaatgacttcgctgcctatgagaaccgggtgaaggatctgtttaagacgggcaaaatcaagtcctacacaaaatacaagaaacttctgatggctgacaatgaaatccctgaggggttcattgacagacaactccgggaaacccagtatatcgccaagaaggcgaaagagattctgctggaagttagccgcaacgtgacagccaccatcggatctgtcaccgataaacttagagaggactgggagctcgtggatgttatgaaagaactgaattgggagaagtacgacaaactgggcctcacacatattgaagaggggaagaacggcgaacggctgtccaagatcaaagattggacgaagagaaatgaccaccgccaccatgctatggatgccattaccgtggcttttacaaaacccgcctatatccagtaccttaacaatctgaacgccaagacccagggagagaataaagctaacagcatcattggcatcgagaataagcacctctatcgggacaagaacaacaaactgagattcatttctcccatgaagaatttccgcgaagaggcgaaaaagcaactggaatccatccttattagctacaaagccaagaacaaggtcgtgaccaaaaataagaacacaacgaaaaagtctgggggaacaaatcagaaaatccagctgacccctagaggccggctccataaggagaccgtgtatgggaaactgcagcaatacgctacaaaggaggaaaaggttaacgccagctttaccgaggattacatccagaaagtcgccaagaaagaatatcgcgaggctctcctgaagagacttgaagagaatgacaacgatccgaaaaaggccttcacaggaaagaatgcgctgaacaaaacgcccatttacatctccctcaaggacaatattatcgtgcctgagaaagtgaagaccgtctggctggaaacagattataccattcggaaagacatcacacccgacctgaagatcgataaggtgattgacgttggcatcaaacgcattcttcagaacagactgaatgagtttaacggggatcctaagaaggctttcgtgaatctcggcgaaagccccatctggctgaacaaagagaaaggaattgccatcaagcgggtcaccatttctggcgtgtccaatgcccaagctctccacacgaagaaagaccacctggggaacgaaatccttgataagaacggaaatccgatccctgttgactttattagcaccggcaacaatcatcacgtggccatctaccgcgatgagaaagggaacctgcaggaggaagtcgtgtccttctatgacgcggttattagacggaatctcgagctgtctgtgatcaacaagaatcatgaaaaaggatgggagtttctgttcagcatgaagcagaacgaatttttcatttttccctccgatggcttcaatcctcacgagatcgaccttctgaaccccaataactaccatctcatctctcctaatattttccgcgtccagaaaatcagcacaaagaactatatgtttaatcaccacctggagaccaaggctgtggatggggaaatgctcaaatccaagaaagagctgtctaagacaagctaccatttcattcaaacccccacaaaccttaacggcatcattaaagtgagaatcaatcacctgggaaagatcgtccatctgggcgaatactga

SEQ ID NO: 4202 - RNA, 4065 nt, synthetic construct
  misc_feature 1..4065: note = Cas9 variant
  source 1..4065: mol_type = other RNA
atggccgacttcgctaagtaccaacccggcatggtggccgatgggagaaaaatccctctggactggaccctctattacctgcggaagaaagcgcttacacaagctattcgcaaggaggaactggcctggatcctcctgaactttaatcagaaaagaggatattaccagcttcggggcgaggaagaggaagagaacagcacgaagcacgaggaatattacgagctgaaggtcgtttccgtggaagccgctgaggaggggaaaggaggcaatacctggtataacgtgacactcgaaaatgggtggatttaccgcagacagtctaagatcgagctgaacgattgggtcggaaaagtgcggccgttcattgttaccacagaatacgagatcgacggcgtgaccatcaagaaagataagaatggcgaagtcaagcgcagctttagagccccctccgagaacgactgggggctgcggaaaaagcgcacagagtctctcctggaagagagcggaaaaaccgtgggcgctttcatttataatcatatcctttccgaacctgccgataagattagagggaactttatccggacgattgagcgcaaattctacaagaaagaactggaggcgatcctcagagagcaatctaagcaccagaaggaactgaaagacattgatacccttatcgcctgcatcaaggagctgtatcccaataacaaacctcatcaggacagcctcattaagaaagatatgacatacctgctgatcaccgacctcatcttttatcagcggcccctgaagtccaagaaaagccttattgctgattgtccttacgaatattacgagtacgttattaaggaaacaggagagaataaacgccaatctatcaagtgcatcgccaaatccaacccgtattaccaggagttcagactgtggcagtttattatcaatctccggctgttcgacagaaacaacgacaaggaagtgaccagcgagtatctttcttccatggaagattacacgcgcctgtttacatatctcaatgaccggaaggatattaaccaggagaccctgctgaaagacttctttaagcaaaagaaggtcaaaagaggcatggagaaggagttccccatccgctggaattacattgaggataaggaaaagaagtatccttgtaacgagacacggcacgaactcctgaccgctcttgggaaagtgggaatcgaccatagctggctggatgacaaggaactcttctacagactgtggcaccttctgtactctgtggagtccaaagaagaggccgaaggcgcgctccgcaagctggtcgataatgacgattttgttaacgccttcctgaaaatcaagccctttaagaaagagtatggcgcttacagcgaaaaggccattaaaaagctcctggctgtgatgcggatggggaatctttggaacgaggtggacatctgcgagcagaccagagaccgcattcagaatatcattaaaggagatatcgacgaaaagattaaggatcggatgggcagaacattctcccaactgtctgactttcaggggctccctgagtggctggcctgttatgtcgtgtacggacagcacagcgaagccacggatatccagcgctggaccaaacccgagaacctgatggcttatatcaatggcttcaagcaacattcccttcggaacccgattgttgaacagtgcatcctcgagacactgagaaccgtgcacgacatttggaaagaggcggggcatatcgatgaaattcacatcgagctgggacggggcatgaaaagcacagccgaccagcgcgctagaatgtctaaatccatcatgcagaatgaaaacaccaatctccggattaagagcctgcttatggagctgaagaacgccaaagagtttgaaaacgtcagaccttactctcccatgcaacaggagatcctccgcatttatgaagagggcgccctgcaggaactgacgaaggaggatgctcagtacaatgagatcagcaaaatttcccaaatggcccagccttctgcgaacgaacttctcaagtaccggctgtggctggagcagaaatattgtagcccctacacagggaagcccatctccctcagcaagctgttcacctctgcttatcagatcgaacacattatccctcaatccagatactttgacgatagcttcaccaataaagtgatttgcgaggccgaagttaaccagcttaagtctaatatgctgggatatgagtttatcaaaaagcatggcggggagattgtgcgctgtacaatgatcggagacgtcaaactcctggatgccaaggaatactataacttcgtgaccgagcactacacaaataacagacggaaaaaggaaaagctgcttatggaggacatcccgcaggaatttctcaatcgccaaatgaacgactccagatacattagcaaaaaggtcatggctatcctgtccaatattgtgcgggaggaggatgaacaggaggccaaatctaagttcgttatcgcttgcagcggcgggattacggaccgcctgaaacaggattggggcctcaacgacgtgtggaactccatcgtctatcccagattcgaacggctgaataaacttaccaatacagagaactttggacgctgggagaacaagaaaggcaaacaggtgttccaaacctctgttcctctggaactccagaaagattttagcaagaaaagaattgaccatcggcaccatgccatggatgcgctggtgatcgcctgtgcttccaataacatcattaattacctgaacaatgagagcgccaagtctcaggaaaagcgcgaggaccttagaaagaagctctgcgataaaaaccggatcattagaaagccctgggaaacattcacccaggacgctcacacggccctggagaatgtcgtggtgtcctttaaaaactatatccgcgttattaataaggcgaccaactactatgagaagtacgataaaaatgggaagaaagaaatcgccgagcaaaagggacaggacatgtgggctatccggaaacctatgcacaaggaaacagtcttcggccaggtgaacctgagacgcaagattaccatcaaactcaaggatgccctggagaaaattcccgctatctgcgacaaggaacttcgggactatattaatatcctggtggccaaacagtttaacaagaaacaaatcctcgcccatttcaagagcattaattacagactgaacatgaagtctgtcgataaagtggacgtttggcagttttccaacgagaaggagccgatggtggctacacgcaaaagcgtcgatacctctttcgacacgaagcggatcgcgacaattaccgatacagggatccagaaaattctgcttaattacctgaaggccaagaacaatgaccctaacatcgcttttacccccgaaggaattgccgagatgaataaacacatcaccgaatataacaatggcaagcaacatcagcctatcctcaaagtgagagttagcgagcccaagggggccaaataccaggtgggcgaaacaggaaacaagcgctccaagttcgtcgaggctcagaaaggcacgaatctgtattttgccatttacgaggataaggaagggaaccggagctataataccatccctctcaacgaggtgattgaaagactgaaacaaggactttctcccgttccggacgcgaatgagaagtccatccctctgaaattccacctcagccccaacgatctggtgtacgtccccaagacagacgaggaaaatgagattaagatgggccagatctataaattcgtggattcctctgggaccacagctaactttgtgcctcaccgggtcagcaatctgatctacaacgttgacaagaaaattgccgaaaacttctgtaatcatgagatcattcagaacgaatacggaatcggctccccgcagtctaagaatcagaaaagcattaccggggagatgatcaaggccgtgtgctggaaacttgaggtggaccgcctgggcaacatccacaagattatcaagtga

SEQ ID NO: 4203 - RNA, 4065 nt, synthetic construct
  misc_feature 1..4065: note = Cas9 variant
  source 1..4065: mol_type = other RNA
atgaagaaaatcctgggcctcgacctggggaccacaagcattggatgggccttcatcaaggagcccgaaaaagatgtggtcggctccgagattgttgacatgggggtgagaatcgtgcctctttctagcgatgaagagaacgactttgctaagggaaatacgatttccatcaacgccgatcggaccctgaaacgcggcgcgagacggaatctccagcgcttcaagcaaagacggaacgctctgcttgaaacatttaaggagaaaaatctgatcccgtctaacttccagtacgccgaggacgggcccagctccaccttttctacactcaagctgcgcgataaagccgctaaggagaaaattgaactggacgatttcgtcaaggtgctcctgcagatcaataagaaaagaggatataagagctcccggaaagccatgagcgaagaggacgagggcaccgctattgattctatgggcatcgccaaggaactttacgagaacgacctgacacctgggcagtgggtttatgaagcgctcaaaaatggacgcaagaacgtgcccgatttttacagatccgacctgcaagaggagttcaaaaagattgtcaattatcagagcgaattttaccctgacatccttaacacctctttcgtggaggattggatgggcaaggcctccacgcccaccaaacagtattttaataagcgcggggttcagctggctgaaaacaaaggaaagcgggaggaaagacggctccaagagtacaaatggcgcgccgaagctgtgaatttcaagattgacctgagcgagatcgccctgatcctctctcagattaactcccagatcagcaactcctctggctacctgggggcgattagcgatagatccaaggagctttattttaaaaatctgacagtcggacagtacctctatcaacaggtgaagaaaaaccctcacacccggctgaagggccaggtgttctacagacaagactatcttgatgaatttgagaaaatctggagcgtccagtcttccttctacccgcagctgaatgacgaactcaagcaggaggttcgcgatgtgacaattttctttcaacggagactcaagagccagaaacatctgatctctaactgcgaatttgaggagcaccataaggtggtccccaaaagccaccctatcttccaggagttccgcatttggcagaatctgaacaatctgacccttatcaagaaagacaacctgaatgaaaagtgtgaactcgccctggaggataagacggctcttgccaacgagctggcttttaaaaaggaactctccgtgaaagacgccctgaaggttctgggcctcaaaccctctgattgggagttcaattttacaaagattgaagggaaccggaccaatcatgccttctttgaggctttcgcgaaaatcattgaactggaggacggagagcctatcgaccttggcaacctgaaggccgatgacatcctcgatcaatttagcgaggctttcctgagaattgggatcgacacagaactgcttcaggtcaattccgatattgaaggagccgagtatgaaaagcagagctacatccagttctggcacctcctgtactcttccgaggacgatcaaaaactgaagcagaacctcattcgcaaatttggcttcaagcccgagcacgccaaaatcctggctagcatttctcttcaggacgatcatgcctccctgagctcccgggcgatcaagaagatcctcccgcatctgcagtctgggctgatttatgacaaggcttgcacctacgccggatataaccacagctcctcttttaccaaagatgaaaatgagaaaagagaacttcgcgccgagctcgaactgctgaagaaaaacagcctccggaatcctgtggtggagaagatcctgaaccaaatgattaatgttgtgaacgctatccttaaggaccccaatctgggcagacctgatgagattcgcgtcgaaatggcccgggagctcaaagctaacgccgaacagagaaagaatatgacatccaacatcgcgagcgccacgcgggaccacgagaaataccgcgagatcctgaagaaagagttcggcctgaagagagtgaccaagaatgaccttctccggtataaactgtggctggaaacagatgggatttctctctacaccggaaagcccatcgaggcttccaaactgtttagcaaggaatatgacattgaacacatcattcccaaagccagacttttcgatgactctttttccaacaagacaatctgtgagcgccagctgaatatcgataaagctaacgtcaccgccttcagctttctccaaaataagctgtctgcggacgagttcgaacagtaccagagccgggtgaagtccctgtacggcaaacttagcaaggccaaaattcagaagctcctgatggctaacgataaaatccctgaggactttattgccagacaactgcaggaaacgcgctatatctctaagaaggctaaagagattctcttcgaaatcacaatgagagtttccgtgaccaccgggacaatcaccgataagctgcgggaggactggggacttgtcgagattatgaaagaactgaactgggagaagtacgataaactcggcctgacatatacgatcgaagggaagcatggcgagcgcctgaataagattaaagactggaacaagagaaatgatcaccggcatcacgccatggacgcccttaccgtggctctgacaaaaccggcgtacatccagtatctcaacaatctgaacgccaaggctattggaaataaaaagggcaccgaaatctttgccattgagcagaagtacctcaaacgcgagaacgggaagctgtgcttcattccccctatcgaaaatatcagagccgaggctaaaaagcatcttagcaaaatcctggtttcctataaggccaagaacaaagtggtcacaattaataagaacaaaaccaagaaaaaggcgggattcaatgaacaaacggctctcacaccccggggccagctgcacaaagagaccgtgtacgggaagtcttttcactacagcaccaagttcgagaaaatcggagcctcctttgacgcccagaagattaacacagtggctaaaaaggaggaacgcgaagccctgcttaaaagactggcggagaatggcaacgatcctaagaaggctttcaccgggaaaaactctctcaataagatgcccatctatctggacctcggcaaaaacatcaagctgagcgaaaaagttaagacggtcgtgcttgagcagaattacacaattcggaagaacatcgatccggacctgaaagtggataaggtcattgacgtgggaatcaaacgcattctcgagtccagactggaagagtttggcgggaatgccaagctggccttctctaaccttgaagagaatcctatctggctgaacaaagaaaagggaatccccattaagcgggttaaaatcagcggcgtgtccaatgtcgagagcctccatgtgaagaaagatcactttggggagaagattctggacgaagagggaaacgaaatccctgttgatttcgtgtctaccggcaataaccatcacgtcgctatttatgaggacgaagatgggaatctccaagacgaggtggttaacttttacgaggccgtgatcagacgcaatcagggcgaatccattatcaaatatcggcacgaggaaggatggaacttcctgtacagcatcaagcagaatgagtttttcgtcttcccctctcaagactttaaccctaacgatttcgaccttctggatcccaaaaattatgacctgatttccccgaacctctacagagctcagaagtttagcaaggtgatgtacggcaattctgccgtgcgcgattatgtcttccggcatcacctggagacagttcttaacgacgtgaaagaactgaaggatgtggcgtacaaacagctcaagtccctgcagtatctcaatgggatcaaaaaggtcagactgaaccatcttggacaaattatccaggtgggcgagtactga

SEQ ID NO: 4204 - RNA, 4065 nt, synthetic construct
  misc_feature 1..4065: note = Cas9 variant
  source 1..4065: mol_type = other RNA
atgaccctgcactacaacgtgggcctcgacatcgggacaaatagcgtcggatatacgattgttgatgacaacggcaagatccttcaggtgaaagggaagaatggatacggcgtgagagtcttcaaagagggggccaccgctgccgaacggcgcatttttagaacaacccatcggcgccttaagagacggaaatggcgcctgagactcctgcaagatttctttgagccctatatccttcctcaggacgatggattctttattcggcgcaaggaatccaacctggtgctcaatgacagagatgaggacacagcgtctctgttcaacgatcggagcgaccgcgatttttaccaggcttatccgaccatctaccacctgagacaggccctcatgacagaaaagcggcaattcgacgttcgcgagatctatctggccatgcatcacattatcaaatacagaggccattttcttctgaatggcaccgtgaacaatttcacgaacaataagattgatctccactccgactttgaggaactgaacgcccttctgctcaatgtcatccccgagctgaaattccagattgacctggatcactctaccatgtttcagacaaccctcctgaacacaaccatcagccggtccgggagacagcgcgaccttgtgaagtctttctacaatggaagcgatgacaaacaactggctaagcagcagaagtccgttgctacggaactcctgaaagccattcttggcctgaaggcgaaattccataagctctttaacctggatctgctcgagacaaccgagtgggagttcagctttgacgccgaggatatcgacgataaactggctaagctggaacctctgatgacagagaaccagcaacaggtgatggacatcctccagcggattttcgccgctatcaccctgaatgggattgtccccgaaggaaaaaccctttctgcctccaaggtggatagctatcaaaagcacaaacaggacctgaagctcctgaaagcgatcgcccagcattctgacaagaaaacagctacggtgctgcagaccgcctacaacgagtatattaatggcatcgcttccaagcctctcaagcaagaggatttttacaaaagactgacaaacgccgtcaagaaaagctctgacccccaggttgccgatatgcttgctctgatcgaccaggaaaagttcctccctaaacagcgcaccaaggagaatggggcgattccgcaccaactgcaccagctggaacttgagcggatcattgataaccagaaggactattacccctggctcgccgaactgaatcctaaccaggctagacaaaaagtggccaagtataaactgtccgagctcgtggcctttcgcgtcccctactacgtgggacctctgatcgagcccgaagttcagcaggctacaagcaatgcccatttcgcgtggatggctcggaaggaggccggcccgattaccccttggaactttgatcagaaagtggacagaaatgtctccgccgaacgcttcatcaagcggatgacgacaaaggatacctatcttctggctgaggacgtgctccccctgcactctctgctttaccaaagatttatcgttctcaacgaactgaataacgtgcgcgtcaatggccagaaactgaccaagaaacagaagcaagccgtgtatcaggatctcttcaaacggcagcctcatgtcacaaagaaacagtttaagagctacctggtgcaaaccggggagttcgctgagtccagcaagattgaaggacttgccaacgagacatctttcaactccggcctgacgaccgaaaatgagctcagaaaaatctttggggcgcagctggacgaggcccggtatcaggttgatttcgaacagattatcgagtgggctacactgtttgaagacgccaagattcttcgcaccaaactcgctgagatcacatggctgaccacggaacaaattgagaagctggccggaatcagataccggggctgggggagattcagccgcaaactcctggcgggacttcgggaccagaacggccagcagatcattgatctgctctgggacacccccaataactttatggtgatcgtctctcaagccgctttcagcgaggccattacaaaggaaaatgagaagctgatcgatagacgcggcgctcaggacgtgattaccgatctgtatacatctccccagaacaaaaaggcccttagacaagttctcgccatcgtggctgacgtccagaaagcgatgggaggggtgcctccgcagcggatctttattgagttcgcccgcgaagatgaaaagaatcccagacggtccgtggagcgcagcagacagctggagaaactgtaccaaaccatctccaacgaatttctcattaatagcgaggttcggcaggaactgaaggaggctgtcgaccagaaggtgaacttcaaagatcgcctttttctgtacttcctccagggcggggtggacctgtattctggaaagagaatcaatattgatcaactgtcccactacgacatcgatcatatccttcctcagagctttattaaagacgactctctggataaccgggtcctcgtgtcccagaagctgaatcgcagcaaatccgactctgttcccctcagcgagttcgccaactataagttcggccctgccatgcaggctaagtggctgcaacttaaagaagccgggctgctctccaagagaaaatacgataatctgacgctggaccccacaaaactttctaagtttgcgccgctgggcttcgtgaaccggcagctcgtcgagaccagacaggtgatcaagctggctgccaacctcctggccagcgaagagacaaaagttgtgaccattaaggctaatatgacccaccaggtccgcaaggaacttgattttcctaaaaaccggaatgtgaacaattatcaccatgccttcgacgcgtacctgacagcttttgttggaatcttcctctccaagagatatcccaaactgaagccttactttacgtacggcgatttccaaaaagggaacaagctgcccgaccttaagaattttaacttcctgtatgagctcaaaaataaggatcgcagcattgactctaacaccggagagatcatctgggataaacagcgggacctggcctacatgaataagatttataactttaaaaaggtgacagtcgtgcacgaagtgctcaccaagtccggcgccctgtacaatcagacactttataaagctagcgaggacaaggcctctgggagaggaaccaaacaactgatccgcaagaaagataacatgcctacggaactgtacggcgggtatacaggctccaccagcgctttcatgtctattgtccggctctggaagaaggacaaaccctactacaaggttgtgggaatcccgaccagaatggccgcgaaactggccaatcaggctcagcttctggattatctcacaaagaaattcaccacacgcaagctggtgaagaaaacgggcgactacaagaccacagtcgagcggtttgaactcgtggttcctaaagtggggttcaaccagctggtcattgatggaggccaaccctttatgcttgggagcgccacctatcagtacaacgctagagagctgttcatctccaaggaggccgtgaaagccctgaataagcagctcagcacacatgttgacctggtgcaggtctttgatgaaattcttgtgcaagttaaccggtggttccccctgtatgacaccaatggatttcgcgagaaactctctcacggcagagatcggttcatgaagctgaacgactcctttgaagaaaagagcgatacgcagatcgacgtgctcaatcgcatcctgattgggttccacgctaacgcggccagaaccaatcttaaaatcctgggcctgggaacagatctcggctttatgacccagcaggctgggattcggctgacagaaaaggccatccttgtccatcaatccccttctggactgttcgagagaaaagtggccctccgcgacctgaagggcctccggtga

SEQ ID NO: 4205 - RNA, 4068 nt, synthetic construct
  misc_feature 1..4068: note = Cas9 variant
  source 1..4068: mol_type = other RNA
atgacctacagcatcggcctggacattgggacaggatccgtgggctgggccgtcatcggggatgactatagactcaagcgggctaaaggaaagaacctgattggcgttcgccttttcgattctgccacgaccgcggctgagagacgggggtaccgcacaaccagacggcgcctgagcagacggcactggcgcctcagactgcttaatgacatctttgcctccgatctggccgaacaggacgagaacttcctcccccggctgaaatattcttgggtgaatcctgatgacgaacaaaacccgcagctgaatagcgatgtggctaacggagccctctttggctcctctgagacagacaaggctttccataaaaattaccccaccatttatcaccttcgccatgaacttatgacagataccgccaagcacgacctgagagaggtctacctcgcgatccatcacatcgtgaagtatcggggcaactttctgaatacggccgataaaattaacgctgagaatagcttcaacgttgacctttttatcgccgctctggacgaatacaatgagttcctcgaaacccctattacatccatcaaggatgcccagctgtttagcgacaaactgaccgatattaacgcgcgcaataagtctgtgagagtcgagaacgccatgtccgagacatacgacgataaaagcaagatcttcaaggctattctcaccgccctggtggggaacacggctaattttcagacaatcttcgacctttctgatctggaaaaagacgaggccaagaactttaaattcaagctcgatctggaagacgttgagaccaaacttgatgtggtccgggccaagctgtccgacgaacaaaatgctttcctcgaggcggtgctgatcgcctatgacggaattacactgaaaatgatcctcggcgattacaagagcatttctcagtccatgatcgagagctataagtcccaccagagagactggaaatacattaagaacaatgtgcgcctgaacgaacagaaaatcgagcccgataaaaattctgtcaaatttttcaagctggaccctaagaaactgatctatcccagcaacctcgcttacctgcaagttatttccagcaatgaagatgagcatcggaaggggcttgactattttaaaaccgccatccaggatgccgacattctgcagagaatcgaaaacgataccttcctccctcgccagcggacaaagagaaatggagtgctgccgtaccaactgcacctcgctgagctggagcagattatcaaaaagcagtctaagtactatccctttcttgccaacatctacacgcaagacaataaaaccgaaaacaagctgattggcctcctgaaattccgcgtgccttattacgtcgggcccctggtggaggcggaaaaggttacaggagatggcaaaaatcattggcttatcaagaaggagctccaggaaaacacccctattacaccctttaacttcgacgatgtggtcgacaaagacaagtccggcgagcagtttatcaaacggattaccgggacggatagctatctgatcggagagccgacactgcctgaaaattctctcctgtaccagaagtataacgtgcttcaagagctgaataacgttagaaatgaacgccaccagcggctccccattaaagtgaagcaggacatcttcgagcacgtctttaaaatcgataagaacgtgaatgctaagaaagtcatggcctacctgaagctgaacggctacggggacttccagattgccggacttagcgataccagaaccggcaaatttaattccaacctctctagctataattacttcgtggacctgctggggcgcgagaagacagaaaagatccgggaggatagactcgaagagattatcgaaattcaaaccgttttcgaggacaagatcctggtggctaagcggctttccaacctggattttctcacacctcaggagaaaagcaagctgtctgccaaacattatacgggatggggccgcctgtcccagaaacttctcaccacacagttcatcaagaccgctctgagcgaagccggcgacattatcccccaatctcactccattatcgatctgctctactatacagacaagaatctgatggagattcttaacgataagacctttaatgtcagaaactggctgacggaacagaacaaagggaccgagagcggaaattccctctacgaccagatcgacgcgctggccggccccaaggatatcaaacgggggattacacaggtgttctctatcattgacgatatcaagaaagctatgggaagcaaccctgaaaccgtttatctggagtttgccagagagacacaaacctcccgccttacaaattctcggctcaacagagtgcaggaaatttacaatagcccggagctgaagacggagttcgcttacctggccaagaaactcgaagcggaaaccaaggagtccatccatgacgatcgcctgtatctttactatctgcaggagggcagagacatgtacacagggaaagaaatcccctttgatcaaattagctctaactatgacatcgatcacattatccctcaggccttcaccaaggacgattccctcgacaatcgggtcctggtgaaccgcgctaccaatgccagaaaaagcaactctcccacatttacgaatgacattatcgataaccggaagtcctggtggcagagcctggtgaaacgcggccttatgtctaaggagaagttcgaaagactgaccgacaaacggaagacatttagcgagaatcagaccaaccatttcattgctcgccaactcgttgagacaagacagatcatcaaaaatgtcgccgatctgattaagaacaactacgacggaacccaggccgtggctatccgggcgtccctcacgggcgaaatgcgcagatatctggattggcctaaaaatcgggacatgaacgattaccaccacgcccatgacgctcttatgatggccacagtggggaagtacgtcgatagacgcggatttttcgacaatggcagcgtgtctgatggggccggaaacgcttataatctgtacaccaaggactggctcgttgccgcgcgggtgggcaccagaaacgattcccagcgcgtcaatccctatgggttcattgtgggcagcatgaactccaaagctgttcggcaacaggtgaataaggagacaggagaaatcgtctggggcaacgagaatctggactacctgagacacgtgctttcttataaaaagattctggttacccgccggctcagcgggtcctctggaagactgtacgccgaaacactctttagcccgaaccctaaagccaagctgatcgctcagaaggccaatcgctccgtggcgctttatggcgggttcacgaaagctgagtctgcctacaccgccctggtcgagtttaacaagaaaggagaccggagctacaagctcatcaaagtgcccatggctattgccaatagagtgaacgataagcagatcacagtcaccgcttatattgcctccctgaatctgcgggacttcagccgcgttgtgcttgaacatctgcctctcggcacactgatcagagagtctgatgggtccgaattttacgcggccagctctgagtataagcacaacgctaaagaactctgggcccccaaggagattctgcggtccagcaaaaagctggacaaagctaccgccgataacctgatcgacatcttcgattttctgacgaatgacaagaccatttctaacttcaagttttacgagaaagatctcctgcaccttaagaatgtgcgcgacaaattcgtcgaagcctccgatgagatcaagattaaagtgctgagcgacgttatctatgaactccataacgatgctggctggagagacccttttaagcacattcaagagaaacccgcgtggacaatgcttcaggtgaagggaggcatcaagctctccgaaaaagccgctattgtctaccagagcccgaccgggctgttcgagacaatcaccatcgtgggagagtga

SEQ ID NO: 4206 - RNA, 4071 nt, synthetic construct
  misc_feature 1..4071: note = Cas9 variant
  source 1..4071: mol_type = other RNA
atgaagaaattcgaggaatactatatcggcctggacatggggaccggaagcgtgggctgggccgtcacagattccgcttacaacattatcaagagacacgggaaagccctctggggaattagactgtttgagtctgcgaagacggctgaggagcgcagaatcttccggaccagccgcagacggacagaacgcagaaagaatcggcttcatctgctccaggagatttttgccgaggaaatctccaagaaggacatgggcttctatcaacgcatgaaagagtctaagtactggcacgaagataaaaaggacatcaacgggaatatgcccgagctgccttatgccctttttgctgatgacggattcaccgataaagactactataagaagtacccgacaatttttcatctgagatacgccctcgctaccaacacaaccgataaacccgacatccggctgctgtatctcgccctgcaccatattatcaagcaccgcggccacttcctttttgagggcaaaaagctgagcgaagttaaagagttctccacggcgattgaagccctcgtgcagcaggctgaggaacaggagatcgatctgaagtctcttacccaagaggaagtgctgacacagctcgagcatattatgagcgacgcccagtgcaccaaatccgataagaagacacaggtcagcaaactgatcgtggggaccgacaagcaaaaacagaagcaggaaaaagctatcgccgcgctgattacgggatgtacagttaagctctctgacatctttgccgatcctgagctggacaaggaagagatttccaaaatctgcttcagcgataatggctacgaggaaaaggaggtggaaattgagtctgtccttgctgacagatttctgctcatcgccgctgccaaaggggtgtatgattggaccgttctgcacgacatccttggagatgcccggttcctgtccgaagctaaggtgaaaacatacgagaagcatcgcgacgatctcagaaaggtcaaacagctgctgcggatggacaaggaggtgtatgaagcggtgttcggcgtcagcgagaaaaacgaagccaattactctgcttatattgggatggccaagaaaaacggaaagaagcaacccatcgagaaaaagtgttcccaggaggatttttacaaattcctcaagaaacagctggacagacttagcgttgacgaaatgggccaagagattatcgatgaactgaaggccgagatggacctcggcaccctgtttcctaaacagatgattcgcgataatggggtgatcccctaccagcttcacgaaaacgagctgaatgctatcctcgacaacgcccagaagttctatccttttctgctggagaaggatcaagacggatacaccccggtggagaaaattcagaagatcttccggtttcggattccctattacgtcggccctctcaatacagcgcaccaggataaagggggacattcctggtctgtgcgcaagaaagaaggcaagatctatccctggaacttcagcgaaatgattgacgaggaagagtccgctacgaagtttatcgagcggatgaccaataaatgcacatacctgattggggaagatgttcttcctaaggagagcctgctctatgccaaattcaacgtgctgaacgaactgaataaccttagaatcgacggagagctcatcgcccccgaactgaagcaggatatttacaataacgtctttaaaaagtaccaacgcgtgaccggcaagaaagttaaggactatctgcggatcaatggcgtgatttctaaagagcaggagctctccgggttcgatcagaactttaagagctctctgaaggcttaccacgacttcaagcagatcgtcggaacaggcgtgcttagcgaatccgagcaagaagacattgtcagagatatcaccctgttcgccgactctcagaagatgctcaaacagcgcatccatcggaagtatccgatgctgagcgataaacagattgctcaactggccaataagaaatacgcggggtggggaagactttcccgcacgtttctcgagaacatcgagagcgtgaataaggaaacaggcgaggttatgaacattatcaccgccctgtgggaaaccaatgagaacctgatgaaactcctgtctgggaagtatgactacacaaagcagattgaacagtggaatgctcggcaaatgaaaaagggcgagatcgagtatcaggatatcgaggaactttacgtgtcccctgccgtcaaaagacccatttggcagaccatcaagattgtgcgggaaatcacaaacattatgggaggcgctcctaaacgcatcttcgttgaggtggccagagaacccggggagaagggagtccggaaggtgagcagacgcaatcagctgctcgacctgtacaaagcgtgtaagaaagaggcccccgaactgtatgatcggcttgctaacaaggagtctgacaacgccctcagatccgataaactgtttctgtactatagccaaatgggccgctgcatgtactccggggacgctatcgatctcgacgaactgttcacgaatagatatgatattgaccacatctaccctcagtctaaggtgatggacgatagcattgacaaccgggttcttgtcaagcgcgatctcaattccaaaaagaccgacacatttccggtgtctgaggaatatagaaaagccggaaaggccctgtggagcaccctgctgaaaaagggccttatctccaaggagaaatacaagcggctcacacgcaccgagcccttcggggaagatgagctggctggctttattgcgagacagctggtggaaacgcggcagagcaccaaagccgtcgctcatctcctggaggaggcctaccctgacgccgaaatcgtgtatgctaaggcccgcgcggtttctgagttcagacacaaatttgatatgattaaggtgcgggaagtcaacgacttccaccatgctaaggatgcctaccttaatatcgtggttggaaacacatattacgtgaaatttaccaaggacgccgcttggttcgtccgcaataaccccggcagaacatataatctgaaaaagatgtttgagaacgaaaccgtgaaacgggggaatgagacggcctggatccctggagataacggcacaatttgtaccgttaagaaatggatgagaaagaataacgtcctcttcacacgccgggcgtacgaggtgaaagggggactgttcgaccaaaatatcctgaaaaagggcaaagggcagattcccatcaagggcggagctgacgaaagacttcgctcccgggataaatatggcgcctacaacaaggccagcggggcttactttatgctggtggagtctgacggaaagaaaggcgaaagaaagcgcaccattgagttcgtgccggtctatctcgccaaatccctggaagagagcgttgagctccggagacgctactgcgaagaggaactggggcttgtgaaccctgatgtgcggctgtctaagatccggaaaaatgctctcatcgacgtcgatggatttaagatgcacctggtgggcagaaccgagaaccgcctgcttctgattggggccacacagctcgttctgagcgaagacgatcagcaactcatcaagaaaattggcaagtattgtctggaccatagagagaataaagatgcggtgctttccgagaagtacgaactgacgatggacctcttcgagaaactgtatgatatctttgtcttcaagctggaacagaccgtgtacgccgttaaacttagcaaacaggctaaggacctgaaagaggtgaaggaggaatttctcgccctggatgacgagcaaaaatgcctcctgcttatggaaattctgcacctgttccagtgttctccccagctcgctaacctgacaaatatcggaggcgggaagtccgccggaagccttaaaatcctgtccgacattaccaagcagcaatctgtcctcctgatcaaccagagcattacaggcttttatgaacaggtgatcgatctcaagaccatttga

SEQ ID NO: 4207 - RNA, 4071 nt, synthetic construct
  misc_feature 1..4071: note = Cas9 variant
  source 1..4071: mol_type = other RNA
atggaggtgggcaactactatctggggatcgacgccggaaccgatagcgtcggctgggctgttacagacaatcagtacaacgtgattagaaagaaagggaagtccctctggggaatccggctgttcgatggcgccaatacggcgcaagaacgcagaacctttcgggcccttcgcagacggaacgagcgcaaaaagcagagaattaatctgctccaggaactgttctgcaaagagatctgtaaacttgaccccaactttttcattcggctgcgcgattctagcctctggtccgaagacaaggaggagaaacagatctattctctgtttaatgataagaacttcaatgacagaaactaccacaataactataaaacaatctaccatctgcgggctgatctcattaagaataaagaaaagcacgacgcccgcctggtgtatcttgctatccatcacattatgaagaacagagggcattttctgttcaatggaaacatcgagagcgtcacctcctttgaaaacacattcaatgagtttaaaaactgcctcctggatgagcttgaaattaatctggagtgtccttctatcagcgagttcgagaacattctcaaggaccggacctttaaaggcacacaaaagtgcaaaaagctgaaagaactgtgttccatcccgagctctgataagaagctcgacaatatcttcaaactgatttccggccttaaggccgacctgagcatcattttcgaggatgagtcttttaaagaaaacgagcacaataagatctccttcgctgacagcaactacgaagagacccgcgaagtgctcaattctgagattcaggagaaaacgctgatcatcgatatttttaactccatctacaattgggttattcttagcgacatcctgtccgggggagaatataacggcgggctctacctgtctattgccaaggtgaatacctataacaagcacagcaaagatctgaagatcctcaaatccgtcatcaagaaatacttcccccagaagtatacagacatttttgcgagcaataaggagaacaactactgctcttatatcggaatgtacaaatccggcgggaagaaatacagcgtgaagaaatgttctgataagcctgaagagttctataagaccattaaaaatatcattaacaagaatacagccgaagagatcagcaacgacaaagatgttcagtacattctgtccgagatcgaaaataactcttttcttcccctgcaaatcaataagaacaatggagtgattccttatcaggctaacaaaatcgagctcgaaagcattctgaagaatgccgagaactaccttcccttcctgaaagagatcgacaccgaatgcaataagacgacatccgagaagattatcgatctctttgagttcagaatcccttattacgtcggcccgctgaacaccagcaaaggcgaaaatgcttggatgattcggaaggaagacgggacaatcagaccctggaactttgagcagaaagtggacattgataagaccgccgcggagttcatcacccgcatgacaaaccagtgtacgtatctgaataacgaaaccgtgctccctaaatactctctgctttactccgagtatacagtcctgaatgaaattaacaatatccggatcaacggagagaagattagcgttgaactcaagcaagacatctttaatattctgttcaaaaacaataaacaggtgacctgcaagaagctgctttctcatctcaactccaatggctacaacctgaaaaaggatgacctgagcgggttcgatggaaattttaagtcctctctcagctcctatatcgacctgaaaaactacattttcggcgataatatcgacaagccccagatctataaccttgccgagaaaattatcctgtggattacactctacggggatgactctaagctgctgaaaagagtgcttcaaaagaactgtagcgagcagctcaatcctgaacagatcaagaaaattaccaagctgaaatttaagggatggggccgcctgtccaaggctttcctcagcgagctgcggggcgccgatagagaaacgggggagacaatgaccatcattaagggacttcgcaacacccagaataacctgatgcaactcctgtctcagaattatacatttaccgaagagtgcgagaaaatcaactccggctacttcatcaatcccaacgaaattagctacgactctatcgtcaagaatattgtggcttccccgagcatcaagcggtctgtttggcagacaattcagatcgtggaggaaatccaaaaagtcatggggagcaagcctagaaaaatttttgtggagatggcccgcggagaggaagagaaggttcggacgacctccagaaaacagaagctgcttgatctctataagaacatcagcgacgaatgcgccaaaggcatgtacgacgagatttattctaaggatgaatccgacttcaaaaatatccgcctgtacctgtattacacacagatggggtgttgcatgtatagcggcaagcacattgatctctcccagctgtctaacaccaatatctgggaccgggatcatatctacccccaaagcaaaacaaaggacgattcccttgacaacctggtgctcgtctacaagtctattaatagcgagaaatccgatgacatcatttctcctaccatccagaacaatatgagaacgttttggaagctgctgttcgatcggaaatttattagcgagaagaaatatcaccgccttaccagaacaacacccctcaccgacgaagaactggctggattcatcaaccggcagctggtggaaaccagacagtccacgaaggtcatggcgagcatttttaagcgcatctaccccaacacagagatcatttatgtgaaagccaagaatgtttctgatttccggcacagaaaagactgtgaaaacggcgtgaaggtccgcgagctcaatgactaccatcacgctaaagatgcctatctgaacatcgtggttgggaatgtgtactccagcaagttcaccaacaatcctcttatgtggctgaagaacaatagaaacgtcaaatattctctcaatcggatgtacgactttaacctgacagtgaataacgagaatatttgggtggttggaaacgaaggcacccaaaagaccgtcaacaaatacctggggaagaatgatatcctttatacacgctacgccatgacgaacaaaggagagctgttcgaccagaatccgctcaaggctaccggcgataaatccaagcagacaaccctggtgcccctcaagaaagggaaggaagtgtggaaatatggcggatacaacagcattacaccttcttattttatgctggtcgagtccaaggacaaaaagggcaattacatcagaaccatcgaaacgatgcccctttatcgggagaaggagttcagcaaaaacgaagagtttctgctcaattactgcaaggaagtgcataaactgaaggagcctaaaattatcctgaagtgtattaagaaaaacgcccttctgatcgttgatgggttccccatgcacctcaagggatccacaggcctgcaactcaaactgcagggggcggtgcagcttattctggagagcgacatggtcatctacctcaagaaactgatgaagtttgtgaatgaaaacaatatcaacaagaataaactggaggttaccccgtatatggaactttctgctaaggagaacattaaactgtacgatatcttcattcagaagctcaccacaggaatctatagcaaacgccctgccaatcccgtggaaaagctgattaacgccagagacatctttattgagctcaccgtcaaagagcaatgcatcgtgctgtccgaaatccttcatctgttccagtgtaagcctctgacatctgctaacctcgttagcattaatctgaagaaaacggtgggcatcattcagatcgccaagaacattaccgctaaaaatgtcaaacttgtgcaccagtcccccacagggatctacgagtataccgtggatctgaacaagatctga

SEQ ID NO: 4208 - RNA, 4071 nt, synthetic construct
  misc_feature 1..4071: note = Cas9 variant
  source 1..4071: mol_type = other RNA
atgaccaagaaagagcagccctacaacatcggcctggacattgggacaagctccgtgggatgggccgtcacgaatgataactatgacctcctgaatatcaagaaaaagaacctttggggcgttagactgttcgaagaggctcaaaccgccaaagaaacacggctcaatcgctctaccagacggcgctacagacggcgcaagaacagaattaattggctgaacgagatctttagcgaggaacttgcgaagacagatccttccttcctgattcggctccaaaattcttgggtgagcaaaaaggacccggatcgcaaaagagacaagtataacctgtttatcgatgggccctacaccgacaaagagtattaccgggagttccctacaatctttcatctgcgcaaggaactcattctgaataaggataaagctgacatcagacttatttatctggccctccacaacatcctgaagtaccggggaaatttcacctacgaacaccagaaatttaacatttccaatcttaacaacaatctgtctaaggagctcatcgagctgaaccagcagctgattaaatatgatatcagcttccccgacgattgcgactggaatcatatctccgacattctcatcggccgcgggaacgccacgcaaaagagctctaatattctgaaagattttacccttgacaaggaaacaaagaaactgctcaaggaggtgatcaacctgattcttggaaatgtcgctcacctgaacaccatcttcaaaacatccctcaccaaggatgaagagaaactgaattttagcggcaaggacatcgaatctaagctggatgacctcgattccattctggacgatgaccagttcacggtgcttgatgccgctaacagaatctacagcacaattaccctgaatgagatcctcaacggcgagtcttatttttccatggccaaagttaatcagtacgaaaaccatgcgattgacctgtgtaaacttcgggacatgtggcacacaaccaaaaatgaggaagccgtggagcagagcagacaggcttatgatgactacatcaacaagcctaaatatgggaccaaggaactgtacacatccctcaagaaattcctgaaggtcgccctgcccacgaacctcgctaaagaggccgaggaaaagatctctaaaggaacctacctggtgaagcctcgcaatagcgagaacggcgttgtgccgtatcagcttaataagattgaaatggagaaaatcattgataaccagtcccaatactatcccttcctgaaggaaaataaagagaagctcctgagcatcctgtcttttcggattccttactatgtcgggccccttcagtccgcggagaaaaaccctttcgcctggatggaaagaaagagcaatggacacgctcgcccctggaactttgacgagatcgtggatcgggaaaaatctagcaataagttcattagacgcatgacagtgaccgactcctacctcgtcggcgagccggttctgcctaagaactctctgatctatcagcggtacgaggtgctcaatgaactgaacaatatcagaattacagagaaccttaaaaccaatcccatcgggagccgcctgacggtggaaacaaagcaacggatttacaacgagctctttaaaaagtataaaaaggtcaccgtgaagaaactgaccaagtggctgatcgcccagggatactataaaaaccctattcttatcggcctctcccagaaggatgagttcaatagcacactgaccacatacctggacatgaaaaagatctttgggtcttccttcatggaagataacaagaattatgaccagattgaggaactcatcgagtggctgacgatttttgaagataaacaaatccttaacgagaagctgcatagctctaaatactcctatacccccgaccagattaagaaaatcagcaatatgagatacaagggctggggacgcctctccaagaaaatcctgatggatattacaaccgaaacaaacacgccccagctgcttcagctctctaattacagcatcctggacctgatgtgggctaccaacaataacttcatttccatcatgtctaatgacaagtatgattttaaaaactacattgagaatcacaacctcaataagaacgaggaccaaaacatcagcgatctggttaatgacatccatgtgtcccctgcccttaaacggggcattacccagagcatcaagattgtccaggaaatcgtgaaattcatggggcacgccccgaagcacatttttatcgaggttacaagagaaaccaagaaatctgagattacaacctcccgggaaaagcgcatcaaaagactgcagagcaagctcctgaacaaagctaatgatttcaagccccaactgcgggagtatcttgtgcctaacaagaaaatccaggaggaactcaagaaacataagaatgacctgtcttccgagagaattatgctgtacttcctccagaacggaaaaagcctgtattctgaagagagccttaatatcaacaagctgtccgattaccaggtcgaccacattctcccccgcacgtatatccctgatgacagcctggagaataaggcgctggtgcttgccaaagaaaaccaacggaaggctgatgacctgctcctcaattctaacgtcattgatagaaatctggagcgctggacatacatgctgaacaataacatgatcggccttaaaaagtttaaaaatctgaccagacgggtgatcacagacaaggacaagctcgggttcattcatcgccagctggttcagacctcccaaatggtgaaaggagtcgccaacatcctggataacatgtacaagaatcagggcaccacatgcattcaggccagagctaaccttagcacggcctttcggaaagcgctgtccggccaggacgatacctatcacttcaagcatcccgaactcgtgaaaaatcgcaacgttaatgactttcaccacgctcaagatgcctacctggcctctttcctcgggacatatagactgcggcgctttccgaccaacgagatgcttctgatgaatggagaatacaacaagttctatggccaggtgaaggagctctacagcaaaaagaaaaagctgcctgactccagaaagaatgggtttatcatttctcccctggtcaacggaacaacccagtatgatcggaatacgggcgagatcatctggaacgtggggttccgcgacaagattcttaaaatctttaattaccatcagtgtaacgtgacaagaaagaccgaaattaagaccggccaattctacgatcagacaatctatagccctaaaaatcccaagtacaaaaagctgattgctcagaaaaaggacatggatcctaacatctatggaggcttttccggggacaacaagtctagcattaccatcgttaaaatcgacaataacaagattaaacccgtcgccatcccgattcggctcatcaatgatctgaaggacaaaaagacactccagaactggctggaggaaaatgtgaagcacaaaaagtccattcaaatcatcaaaaacaatgtgcctattggacagatcatttacagcaagaaagtcggccttctgtctctgaactccgatagagaggtggctaatcgccagcaactcatcctgcctcccgaacatagcgcccttctgcggctcctgcagattcccgacgaggatctcgaccagatcctggcgttctatgataagaacatccttgttgagattctgcaggaactgatcacgaagatgaaaaagttctacccgttttataaaggggagagagagttcctcattgccaatatcgaaaactttaatcaagctaccacatctgaaaaggtgaactccctggaggagcttattaccctgctccacgccaatagcacatctgctcacctgatcttcaacaacattgagaaaaaggcctttggacgcaaaacccatggcctcacgctgaataacaccgacttcatctaccagtccgtcacagggctttacgaaacccggatccacattgaatga

SEQ ID NO: 4209 - RNA, 4071 nt, synthetic construct
  misc_feature 1..4071: note = Cas9 variant
  source 1..4071: mol_type = other RNA
atgaccaagaaagagcagccctacaacatcggcctggacattgggacaggaagcgtgggctgggccgtcacgaatgataactatgacctcctgaatatcaagaaaaagaacctttggggagttagactgttcgaaggggctcaaaccgccaaagagacacggctcaatcgctccaccagacggcgctacagacggcgcaagaacagaattaattggctgaacgaaatcttttctgaggaacttgcgaatacagatcctagcttcctgattcggctccagaactcctgggtgtctaagaaagacccggatcgcaagagagacaaatataatctgtttatcgataacccctacaccgacaaggagtattaccgggagttccctacaatctttcatctgcgcaaagaactcattatcaataagaacaaggctgatattagactggtgtatcttgccctgcacaatatcctcaaataccggggcaacttcacctacgagcaccagaagtttaacattagcacgcttaattccaacctttctaaagaactgatcgagctcaatcagcaactgattaagtatgacatcagcttccccgataactgcgactggaatcatatctccgatattctgatcgggcgcggaaacgccacccagaaaagctctaatattctcaacaattttacactggacaaggagaccaaaaagctgctgaaggaagtcatcaacctcattctgggcaatgtggctcaccttaacacaatcttcaaaacctccctgacgaaggacgaggaaaaactcagcttttctggcaaggatatcgagtccaaactggacgatctggacagcattctcgatgacgatcagttcacagttctggacaccgccaatagaatctactctacaattacccttaacgaaatcctgaatggggagtcctattttagcatggctaaggtgaaccagtacgagaaccatgccattgatctctgtaagctgcgggacatgtggcacaccacaaagaatgaaaaggcggtcggactttccagacaagcctatgatgactacatcaacaaacctaagtatggcacgaaagagctgtacacctctctcaagaagttcctgaaagtggctctgcccacaaatctcgccaaggaagctgaggagaaaatcagcaaggggacctacctggttaaacctcgcaactccgagaatggagtggtcccgtatcagcttaacaagattgagatggaaaagatcattgacaatcagagccagtactatcccttcctgaaagagaacaaggaaaaactcctgtctatcctgtcctttcggattccttactatgtgggcccccttcaaagctctgagaagaatcctttcgcctggatggaaagaaaaagcaacgggcacgcgcgcccctggaattttgatgagatcgtggaccgggagaagtcctctaacaaattcattagacgcatgacagtcaccgatagctacctcgttggagaaccggtgctgcctaaaaattccctgatctatcagcggtacgaggtgctcaacgaactgaataacatcagaattacggagaaccttaagacaaatcccaccggcagccgcctgaccgtcgagacaaaacagcatatctacaacgaactctttaagaattataaaaagattaccgtgaaaaagctgacaaagtggctgatcgcccaaggctactataaaaaccctattcttatcgggctctctcagaaggacgagttcaattccacgctgaccacatacctggatatgaaaaagatctttggaagctctttcatggaaaacaataaaaactataatcagattgaggaactcatcgagtggctgaccatttttgaggacaagcagatccttaacgaaaagctgcactccagcaattactcctatacatctgatcaaattaaaaagatcagcaacatgcggtacaaaggctgggggagactctccaagaaaatcctgacctgcattacgaccgagacaaatacccccaagtctctgcagcttagcaactactccgttctcgacctgatgtggacaaccaataacaacttcatcagcattatctctaatgataagtatgactttaaaaactacattgaaaatcataacctgaataagaacgaggatcagaatatctccaacctcgtgaatgacatccacgtcagccccgctctgaaacgcggaattacgcagtctatcaagattgtgcaagaaatcgttaaattcatgggccacgcccctaagtatatttttatcgaggtgacacgggagaccaaaaagtccgaaattacaaccagcagagggaagcggatccagcgccttcagtctaaactgctcaacaaggctaatggattcaaaccgcagctgagaaagtacctggtccccaacgagaaaatccaagaagaacttaagaagcataaaaatgatctcagctccgaacggattatgctgtatttcctgcagaacggcaagagcctctactctgaggagtccctgaatatcaacaaacttagcgactatcaggtggaccacattctgcctagaacctacatccccgatgactccctcgaaaataaggccctggtcctggccaaagagaaccagcgcaaggctgatgaccttctgctcaactctaatgtgattgataagaacctggaacggtggacatacatgctcaataacaatatgatgggcctgaaaaagtttaaaaaccttacgagacgcgttatcaccgacaaggataaactggggttcatccatagacaactcgtgcagacaagccagatggtcaagggagtggcgaatattctgaactccatgtataagaatcaaggcaccacatgtatccaggcccgggctaacctgtctaccgcctttcgcaaagcccttagcgaccaggatgacagataccacttcaagcatcctgagctggttaaaaatcggaacattaatgattttcaccacgctcaggacgcctatctcgcgtccttcctggggacgtaccgcctcagacggtttcccacagatgagatgctgcttatgaacggagaatataataagttctacggccaagtgaaagagctgtattctaagaagaaaaagctcccggacagccgcaaaaacgggtttatcatttcccctctggtcaacggcaccacccagtacgacagaaatacaggagaaatcatctggaacgtgggcttccgggataagattctgaaaatctttaattaccatcagtgcaacgtgacccgcaagacagagattaaaacggggcagttctatgaccaaaccatctacagccccaagaatcctaagtataaaaagctgattgctcagaaaaaggatatggaccccaacatctacggaggcttttctggggataataaatccagcattacaatcgttaagatcgacaacaataagattaaacctgtcgccatccccattagactgatcaacgatctcaaggacaaaaagaccctgcagaattggctcgaagagaacgtgaaacacaagaagtctattcagatcatcaaaaataacgtgccgattggacaaatcatttattccaagaaagtcggcctgcttagccttaattctgatcgggagatcgccaacagacagcagctgattctccctcccgaacattccgctctgcttcgcatcctgcaaatccccgacgaggatcctgaccagattctcgccttctacgacaagaacatcctggtggaaattctccaggagctgatcacaaaaatgaagaagttctatccgttttacaaaaatgaacaggagttccttgctagcaacattgagaattttaaccaagccaccacgtccgaaaagatcaatagcctggaggaactgattaccctcctgcacgcgaactctacaagcgcccaccttatcttcaataacatcgagaaaaaggcttttgggcggaaaacccatggcctgacactcaatgataccgacttcatttaccagtccgttacaggactgtatgaaaccagaatccacattgagtga

SEQ ID NO: 4210 - RNA, 4071 nt, synthetic construct
  misc_feature 1..4071: note = Cas9 variant
  source 1..4071: mol_type = other RNA
atgagcaagaaagactccgagtactatatcggcctggatattgggaccaactctgtgggatgggccgtcacaaatggcaagtacgacctcctgaacatcaaaaagaaaaatctttggggagttagactgttcgaagctgccgagagcgcggctgggcggcgcattaacagatccacgcggcgcagatatcggcgcagacggaatcgcatcaactggctcaatgaaatttttgccgatgagctgtctaaggtggaccccagcttccttaccagactgaactcctcttggatcagcaagaaagattccagccggacacgcgacaagtacaatctctttatggatgccgactataccgataaaaactaccaccataagtatcctacaatctaccacctgagacgggacctgatgttcgatgacaaacagtttgatattcgcctcgtgtacctggcccttcataatatcattaagtatagaggcaacttcacctacgaccaccggaagtttaatgtctctgaaatgtccagcaacctgacaaaagccctcgagaatttcaaccaagagctgatggaatttgaggacgctttcccggataacaccgactattctgccatctccgaagtgcttctcaagagcaataacgtttctacgaaaattgatgagatcatttccaatctggagctggacaaggataccaaaaagtacctgaaagaagtgctcaagctgatccttgggaacagcgcgaatctgaacacaatctttcatacctccctcgacaaggatgacgagaaactgtctcttagcgccaaggatattgaactgaaactcaataacctggactccctgctcagcgatgagcagatccacttcatttcttccgctaatgaactgtatagctctatcacacttaacgacattctggacggaaagacctacctcagcctggccaaaatcaagcagtatgatacgcactgctccgaccttcaggagctgaaggagatgtggtacaaaacaaccaatcccgatctcatcaagaaatctagaaaggcttacaaagaatatgtccatggcagctacaacacagaggacttttataaggccatttcccctttcctgaagatcgcgattcccgaagatctggccaaagacgctctcaagaaaatcgatgccaatacctacctgcctaagcaacgcaccagcaacaatggcgtgattcccttccagcttaacctgatcgagctcgagaaaatcattgacaaccagtctaagtattacccttttctgaaggaaaatcgggagaaaatcatttccatcctgagcttccgcattccgtattacgttgggcccatccaggctcctacagataagaacttttcttggatggtgaaaaagattcaagccaaagccagaccctggaatttcgacgaagtcatcgatcgggagaagtccagcaacaattttatcaaaagaatgacgaccacagacacctaccttgtgggagaacctgtgctccccaagaactccctgatttatcagaagttcgaggtcctgaatgaactcaacaatatccgcatttctaaaaacctgagccaggatccgcttggctccaagctgtctgttgaggtgaaacagcaaatctttgaggaactcttcaagcggtacaaaacagtcaagagcgaccagctgaagaaatggctgattagaaattcctattttaccgaccctacgatcatcgggcttagcaagccctctgagttcaactccagcctctctacatttattgatatgaaagctatcttcggaatggactttgtgaataaccctcgcaattccagccagctggaggaactggcggagtggctcaccgtgttcgaagataagcaaattctgtctgagaaaatccggcacagcaactacccctattccgaccagcagattagaaagatcagcaacatgcgctaccggggctgggggagaatctctaagaaacttctgtgtgatattaaggttgaatccaccatctataaaagccatcagctccacccctactccattctggacctgatgtggtctacaaataacaatttctacagcatccttcacaaggataaatataactttgagtccattctcgaagactacaatctgggaaccgatgacaagacagatatcaacgagctggtggacaatatccatacgtctcctgccctcaagcggggcattatccaaagcattaacatcgtcaaagagctggtgaagttcatgggccacgctccgcagcatatttttcttgagttcacccgcgaagataaaacatccaccctgtctgaaagcagaaagaaacggctcaagaaactgtataataacctgtccgaggacacaaagaagtttaaacttgacctcagagattacctggttcccgacaagagcatccagaaagaactggagtctcacgataaggacctctccaaagagcgcctgatgctttatttcctgcagaatggaaagagcctctactctgatgaagccctggacattaaccggctgtccgagtatcaagtggatcatatccttcctagaacctacatcaaggacgatagcctggaaaataaagccctcgtcctggctaaggagaaccagcgcaaagccgacgatctcctgcttcagccctctattatcaataagaacatggaaagatggatttacatgaaagaccacgggatgatctcccctaagaagtttaaaaacctgacgcggaccacaattaccgaggacgataaggtgcacttcatcaatcgccagctcgtccaaacaagccagatcattaaaaacgtggcgaatatcctggacaacatgtataaggagcagggcaccacgtgcgttgaaacaaaagctaatctgtccagcgcctttagaaccgccttctctgagcaggatgacaagtaccattttaagcaccccgagttcattaaaaaccgggatgtgaatgactttcatcacgctcaagatgcctatcttgcttgtctgctcgggctgtaccgcatccagagattcccgagcgacgaaatgctcctgattaagaaagagtatcggaagttctttgcccaggcgcaaaactccgtcaaaaatcacggaaagatccctgattctcagaagaacggcttcatccttgctcccctggtgaatggggaaacactcattaacaataaaaccatggagaccatctggaacatggactacaagcgcaaagttattaagatctttaattataaacagtacaacattacaaagagaacggaaatcaaaaccggagagttctacaagcagacactgtatagccctcatgatgaaaatgtgaagaaccccattcctcagaaaaagaacctggaccccaaaatctacggcggctattccggggtccaatctagctaccttgctatcattaaggtggatcagaaaaagccgaccatggtgtccgttcctatccggttttctaagatgattgacgacggaaaactgagcctccagtcctggctggagaataacatcaagcacaaaaagacaattgaggtcctcaaaaccaagatccccatcggccaactgacgtataatcccaagaacgggtaccttagcgtgcagtctgaaaaagagattgccaatgctcagcagctgttcctgccttttgaacatgtggccctcctgacacttctgcacgcgccgacctccgagtatgatcaaatcctcagcttctacgacaccgatattctgctcgaaatctttgacgagattacaaacaagatcaaaaccttctttcccttctacatcgatgagcaggaatatctggtctctattcgcgagaatttccagtccgccacagtgatcgaaaaggttaacgtgcttcaacagctgctgattatgctccatgctaatagctccagaatctctattaaactgggagaggtcagcaagaaggaccttggccggaaaaagaaaagaatccctctggaaaacacggatctcgtgtaccagtccgttaccgggctgtatcagacaaagtttcacattgactga

SEQ ID NO: 4211 - RNA, 4074 nt, synthetic construct
  misc_feature 1..4074: note = Cas9 variant
  source 1..4074: mol_type = other RNA
atgaacgacagaaataagaaatacaacatcggcctggatattgggaccggaagcgtgggctgggccgtcacagacaataactataatctcctgcacgctaagaaaaagaacctttgggggatccggctgttcgatggagccgagacggcggcttcccgcagaacctttcggtctacacgcagacggtaccgcagacggcgcaatagaattaactggctcaatgaaatcttcgccgacgagctggccaaaaaggatcagagctttcttgttcggatgaactcctcttgggtgagcaagaaagacaagattcgccaaagagatcagtataatctgttcatggactccgattacaccgacgtggaatatcatcgggagtttcccacaatcttccacctccgcaaaagactgatcgaagataagtctcaggctgacattcggctggtctacctcgccctgcataacatcattaaatatagaggcaattttacctacgagcaccagaacttcgatgtgagccatatggactccgggcttgctctgctcctgaatcaacttaaccagcagctgcaggcctttgaggttgcgttccctgacgaaacaaactttgagagcatgtctaccatcctcctggaaaagaagacgccgacccagaaaattgatgagatcgtggaccaaattcagcccgagaaggatctgctccagatcaccaaaaatatcatgaagatgctgcttggaaacaaagccgacctggtcaagattttctccctcgatagcgacgataaaatcacagtggaattttcttccaatagcattgagcaagacctgtctaaccttgaagagacactgtccgatgaacagttcaatatcattaccctcgctaacagcatctactcctctatcgttctgaatgacattctgagcggcgagacgtatctctccttcgccaaggctcgccagtacagcgatcacaagaaagacctggccaaacttaaaacaatgtggcgggagtctcctgacagaaaggcggtgggcaaagccaagaaggcttatgatgactacctgcactccgggaaatatggaatcgaagatttttacaaggacatgagcaaattcctcgagaccgccacacccgtcgaactggctaaggaggccaacgagaaaattcttaataagtcttatctgctcaagcaacgcaacaatgaaaacggcgtgatcccttttcagctgaataaaaacgagatgattgaaatcatcaataaccaggccaagtactaccccttcctggctgagaacaaagataagctcctgagcattctttcctttcggatcccttattacgtggggccgctgcagtctaaaaaggacaatcccttcgcgtggatggaaaagaaaagccaaggaaagattagaccttggaactttgatgagatcgtcgaccgcgaagcctccagcaataacttcattcggagaatgacctctaccgatacatatctcatcggcgagcccgttctgcctctgaaatcccccatttaccagaagtatgaggtgcttaatgaactcagcaacgtgcgcatcaatgctgacgaggtcgataacccgctgggggacaaactgtctgtggatctcaagcaggccatctacaatgaactgtttcttaaacatcggtccgttagcaaggccctgctcacgaagtggctgattaaccagtcctatttccaaaatcctcagatctctggactggctgacagcaaaaagtttaactccggccttaccacataccacgacttcaaaaagatttttggcgaggatttcgtgaatgaccccaccaaccagtctcagctcgagcaactggccgaatggctgacaatcttcgaggataaaaagattctcaagatcaaactggacgatagccagtttaattgcacccctgaacagatcaagaaaattgcggggatgagataccagggatggggccgcctttccaagaaactgctctgtgacatcaagacgacaaccgtcaccagcaagaaccatcaacaggcttcttattccattctggatctgatgtggaacacaaatcggaacttcatcagcgtgcttaaaaatgacacctacaagtttgaggataaaattcagacattcaacctcgacaagaatgaagccgccacgccccaagctatgatcgatgagctgcagacctctcccgccctgaaaagagggatccggcagtccgttacaattatccaggagctcgtgaagtttatgggacacgctcctgaacacattttcctggagtttacccgcgaagacgatgtcagctctcttacaaagagcagagactcccggctgaacaaactctatgccagaatcgcgaagaataccaaaaagacggacgatgagctgaaaaagagcctgcttccgtcttccgacattaaagccaccctcaaggctaacaagaataacctgagcaatgatcgcctgatgctctactatctgcaaatgggcaaatccctttactctaaccagcccctggacatcaatcggctcagcgaatatcagatcgatcatattctgcctcagtcctacatcaaggacaactctctggagaatagagcccttgtgctggctagcgagaaccaacacaaatcctctgatctcctgctcaagcccgaaattatcaaccagaatattgcccgctggagatacatgaaagacgcggggctgatgggacctaagaagttcaaaaaccttacacggatccagattaccgatagcgaccagaataactttatcaatcgccaactggtccagacatcccagatcattaagcatgtgagcaacatcctcgattctatgtatggcgaccaaggcacccagtgcgttgagacgagagcccacctgtccacagagttccggaaggcttttagcaatgaagacgataactaccatttccagcaccccgaatttgtgaagaatcgcaacattaatgactatcaccatgcccaggatgcttacctggcctgtcttctggggctctatcaaatgaaaaagtacccgaccgacaacatgatcctgctcaagaaagagtataagagattcttctctaataccaaaaagatttacgataaaaagcaccattttcctgactacgtcaagaacggatggatcatcggctccatgttcaatggggagaaatatgtggatgaagagacaggacagattatctgggaccagcagaccaaggatatggttagctgcatttttcaatacaaacagtataacgtgacaaagcggacggaagccgctaatggcgagttctacaaccagaccgtctataaaaaggaccccaacgagaagcgcaaactgatctctcttaagcaggggctggatacaaaactctacggcggatattccggcgacaatcctgcgtacattgtgctggtgaagatcgatgacaaaaagaacaaactggttaagatgcccatcagacttgccgaacaagtcgacaataagaccattgatctgcagacatggctcgaggaaaacgtgcctcacaaaaaggggatccaggtgctgaaaaccaagattcccctcggacaggtcatctacagcaaaaagaatggctatctggctcttaagtccgacacggagattgtgaacgcccaacagctggttctgccgtacgggtatgtggccctcctgacacttctgcagaaaatgcctgaaaataagtacgatgaggtcctcgcttgttatgacgatggaatcctggacaacatttttgtggccatcatcgataaaatgaagcacttctacccctattacagcggcgagctcaaaaccctgtctgacaatattgataactttaaggaaagccccgacgttaataagatcaaaacccttcaacagctgctgctcctgcttcatgcgtcctctacaaccgctagcattgagttcaacaatgtgaagaaaaactccctggggcggaagcctaattctatcaacattcagaacacagatctcctgagcttttccgccacgggcctctacgaatctcgcatccacatcgactga

SEQ ID NO: 4212 - RNA, 4074 nt, synthetic construct
  misc_feature 1..4074: note = Cas9 variant
  source 1..4074: mol_type = other RNA
atggccgctaagaactacaatatcggcctggacattgggaccagctccatcggatgggccattgtggatgacaactatcagctcatgcacgcgaaaggcaagtacgggtatggaacaagaatctactctgagggccaaacggctgccgatcggcgcgggttcagaaccacacggcgcagactgaatcggcgcaaatggagacttcggctgctccaggactttttcgaaccctatattctgcctcaggatgaggcctttttcatccgccagaagcaaagcaaccttgtcccgcaggacaccaaaaagcagtaccccgaatccgttctgtttgatgacacatctgataaggacttctataccgagtaccctacaatctaccatctcagacaggctctgatgaccgaaaatcggcaatttgatattcgcgaggtgtatctggccatccaccatattgtgaaatacagaggacacttcctcaacaatgctcccgtcaagacgtttaaaagcggcaacctggaccttgccatcaagttcaatgagctgaacgaagagtttaaatccgtgtatcctgatctcgaactgcagttcaatcttgaccagattgacgagatcaagaagattctgctcgattctaccaaaagccggtttgaccgccagggcgaggcggttaagctgatctacacagtgtccgaagtcaaaaccatcgagaagctgcaaaacaaaattgtgaagcagttcctcagcgggatcctgggacttaatacaagattcgatgttctgaccaacacggaatctgacgattccatgtggaaatttagcctcgactctgagtccagcgatgacgccctggatgaaattatcgctcagcttgacgatcccgccattcatgtggtcgagctggtgaatgagatccactcttccatcacactcgctggcattgtgcctgaagggcaaggactgagcgagtccatggtcgaaaagtatgaggcccacaaggcgcatctgcagctcctgaaagccgttgaaaaacttgtggacaagaaggctgccgacaaactggaggtggcttacgatcagtatatcaacggcaaggactctaagcagttcattaaagaggatttttacaaggccgtccaaagcgaaatcaaaggggtggccggagacgaggttgctgaaattaaccagctcatcgagctggatcagttcatgccgaagcagcggaccaaagaaaatggcgcgatcccccaccaacttcatcagcacgagctggacgtgattatcgagaaccagtccaagtactatgattggctcggcgaaaaggtcgggaatgagtacaaactggacaagctggtgagctttagagttccttattacgtgggacccctcgtcgatacagcctctaaagaaaagaaagacgagacccgcttcgcttggatggtgcggaagaaccctgagtccaccgaagccattacaccctggaattttgaggatatcgtcgacaagaacgccagcgctgaaaatttcattaaaagaatgacgaccaaggataaatatctgcttaacgaggacgtgctgccgaagtgctctctcctgacacaggactttgaagtttacaatgagctgaacaatatccgcgtgaacggcgagaaattcaccgccgaacaaaagcagcttattcacgatgagctctttacaaaacatgcgagcgtctccatcaagcagctgaaggacttcctggtgtctgaactcatgtatgttcgggataatctgaaagtggaggggcttgctgacgaaaagaaactgatgagctccctcagcacccagtttgattaccaaaagatcattcctgaccagatcaacgatgtcaaatacagagaggacattgagcagatcattgaatggtctacgatcttcgaggatgccgccatcttcaagacaaagctgaaagaaattgactggctgaccgatgagcaacgcaataaacttgctaacaagcggtatagaggatggggctccctcagcaagcgcctgctggcctgtctcgtggacgaaaacgggcagcggatcattgatatcctgagagactcttccgacaattttatgatgattgtgaaccgccccgagttcaaacaggctatctttgatgagaatgccaaccttaccgaaacaaatagcaagaaggacatgttcgagatgatcgataacttttacacctcccctcagaataaaaaggcgattcggcaagttctgctcgtcgtgcaggacatccagaacgccatgggaggcgtggctccccagaaaattttcatcgaatttgccagagaggatgaggtcaatggccggcgcacaaactctagatatagccaaattcgggaaatgtactccaaggtgacggacgatgttatcaataaaaccgtgagaggggagctggaagctaacaagggatctctgaataaggagaaacttttcctctattttctgcagggcgggatcgacctgtacagcggaaagacaattaacatcgataatatttccagctatgacgtcgatcacgtgctcccccagtctttcatcaaagacgactccattaacaacaaggttctggtgaatgccaaaggcaaccgcgtcaagaatgataacgtgcctatggaactttttggggcgaaaatgtacccgacctggaagcggatggttgacacaggcatcatgagcaaggccaaattcaagaatctgaccctcaaccccgataatgtggacaaatttaaggctgagggattcattaacagacagctggtcgagacgcgccaaatcatcaaactggtggcccagattcttaatgataagctcggcgacgataccaagatcgtgtctgtcaaagctaacctgacacatgacatgagagttttctttgatttccctaagaatcggaacgtgaataactaccaccatgcctttgacgcctatctgtccgctttcgtggggacctacctctataaacgctaccccaagctgcagccttattttgtctacggagagttcaaaaagatggataaacttaagaatatgaccagctttgacttcctgagagatctcaagcacacagacaaagtggttgacaaggatacgggcgagattatcgcggacaaactggccgtgattacaaacatgaacaagatctatgattttaagaaagtcctggtgacccacgaagttcatgaaaattctggggctatgtacgaccaaacactttaccccgccaagctggataaaagcctcggacggaagggcgccaaacagctgatcccgaagaaggacgatatgcctaccgctctctatgggggctacaccggatccaaagacgccttcatgagcattgtgcgcctgaagaaaaaggatgaagtctattacaaagtgatcggcattcccgttagaatcgcggactctgtgcagcacgggaaggaggtcgatgtggaggctcttacacagtttattgaaacgaaattcaccaaggagaacctgaataagaaaacaggagaaatcacccggaaggtggagtggttcgaactcgtcctgcctaaagttctgtttggccaagccgtgttcgacgggggacagccctttatgcttggctccagcacatatcctcataacctgcgcgagctcgtgctgaccaaggattccgtcaaaaagatcgccgggaaggagtctaataaaagctacctcgacgcttatgacgaaattatggaggccatgaacaagtacttccccctgtacgatacgaataaatttagagaaaaggtgatcgagggccggtccaaattcattgaccttccggataaggacgagtatgaaaacaataagctggttcaggtgggaaaatctacaatcattgatcgcatgtttatcggcctccacgcgaacgctgccagaaccgacctgaagaatattgggatcaccacacctttcggatttatgcagcaagccagcggcatcaaactgaccaaggatacagtcgtgcttttccagtcctctacggggctgtttgagcggaaagttgctctcaaggacctgtga

SEQ ID NO: 4213 - RNA, 4077 nt, synthetic construct
  misc_feature 1..4077: note = Cas9 variant
  source 1..4077: mol_type = other RNA
atgaaggagccctacggcgtggggctggacatcggaaccaacagcgtcggctggacagttgtggatgcctccgggcacgtgagaaaaattaagggacagacgggcatcggggtcagactcttcaaagaaggagctgccgcggctgaccgcagaggctttcggaccacacgcagacggctgaagcgcgtgaaatggagacttcggctgctccgcgagttctttgatcaacctatttctaaggttgacatcaatttctttgccagacggaagtatagcgatgtgtccccgcgcgaccccaactacaatggcctggaaaagacccttttcaacgatagatctgaccaggatttttatcatgactaccctacaatttatcatctgcgggaggccctcatgacccagcaccgcaagttcgatgtcagagaaatctacctggctatccaccatattgtgaaatatcgggggaattttctgagaaacgacgccgctacagcctaccgcagcggaaccctcgatctgcagcaacacttcgagacgcttaatcacctgttttcccaggcggacctcgagctgaaccttaatctgaccacagacgttgccctcctggattctatcaagcagaccctggtgcggacagacattagcagatccgatcgccagaaactcatcatgcccctgcttgctgtcctgaccggcgccacgacagctgaaaagaagcggcaaaaagccgtggtgaccgagttcgcgaaggccctcgtcgggaacaaaacaaagattgacgttctgacccttaccgatatcgacgctacagaagccaaagattgggcttttagcctggaggagaatcaggacaagctccctggaattgaagatagattctctgaggtgggccagcagatcatcgacgaagtgattcgcctgtacgcctccgtcaacctggcccaactcatccccgaggggaaacggttcagccagtctatggtggaaaagtataagagacatggagaggatctgaaacttctgaaggcttacattcgctcccagagcgacgcgaaacggggcagagccatccgcgctacgtatgaccaatacattgatggcgttaagtctaaacaggtgacccaggaggcctttcagaaggccctcgggaagttcgtcgacgctgatgtggaccttaattcctgggccgcgcaaatcaaacaggctatcgatagcgaacagtttatgcctaaactgcggacaaaacagaacggagccattccgtatcaagttcagcagaatgagctggaccagatcatttccaaccaaaaggaatactatccctggctcggcgaggaaaaccctgtgatcaaaagacgggggaagttcccctacaagctggatgagctgtttggattccgcgtcccttactatgtgggccccctcattaccaaagagatgcaggccgctacagccaatgctgggtttgcctggatggtcagaaaggcggacggaccgatcaccccttggaacttcgatgacaaagtggatcgggttgcctctgctacggcctttatccagagaatgcagacaaccgacacctacctgattggcgaagaggtgcttcccgctcgcagcctgatctatcaacggttcatggtcctcaatgaactgaacaatattagagtggatgacggccagctgacacctcgccagaagcaaagactttacaaccaggtttttaaaaagcacaagcgggtgaccgccaaaaatatccaggacaacctcgtcgcggcccgcgagttccccacagctcccagaattacggggctggccgatcctaaggtgtttaattccagcctgtctacctatcatgacctcaaacaggtgctgccggaagctatgtccgatgttcggaagcaagccgacatcgagaaaattatcctttggagcacaatcttcgaggattctaccattttcaagcagaaactgacagaaatcagctggctcaccgccgctcagctgaagcagctgggacaacttcgctacagaggctgggggcagctcctgcggaagctgctcacgggactgaaagacgataacaatcgctccattatggacggcctttgggagaccaacgcgaattttatgcagctgagatctcagcccgccatcgaaaaccaaattaagagcgctaatcaggccaacctcacaaccgccgatctgcaggacacaatcaacgagctgtatacctcccctcaaaataaaaaggctatccgggaggtcatggtggtgcttgccgatattaaagacgcgatgcacgggcagacgcccaactggatcttcgtcgaagctgcccgcggcggaggcgtggccgggagacggacacagagcagatctaagcagattgttgctgcctaccaaggaaccgcgcaggctatcgtgcgcgatcaggtccagcgggagctcaaggagaaaattaagaataaagccaactttaatacaagactggtgctgtacttcctccaaaacggccgcgacctgtataccggggacgccatcaatatcgatcggctttccgaatacgacattgatcacatcctgcctcagagcctcgttaaggacgattctctggacaacagagtgctgaccaatgctcgcattaaccgggagaaaaatgatacatttgcctccgaaaagttcggaaagaaaatgggcgctaagtggaaagagatgcatagaatggggcttatgacgaagcgcaaactcgaccatctgctgatgcggcccgatgaaatcagcaagtatgccaccggctttattaacagacagctcgtcgagacacgccaggtgatcaagctggttgaggaacttatcaatgcggaatacccgtccaccgccattgtgtctgtcaaagctaacctgacacaccaattccggcagacctttgacttccctaagatcagagaggtgaatgattatcaccatgcctttgacgctgccctcacggccttcattggaacatacctgctgaaacggtatcccaaacttgagcgctttttcgtgtacggcaaattcgctaagcagcctgtcaacctgaccagatttaacgttatccggaaactcgcgaagaccgacacacccattaccgatatcgacacaggggaagtgctgtgggataagctcacggacattaaatacttcgagaccctgtatgattacaagagacttctggtgacacgcgaagtcagcgagaattatggagccatgtttgaccagaccctcctgaaggcttccgataacggcaagcggctgatccggaaaaagcaatctttcgacacagccatctacgggggatataccggcaagacgcttgcctacatggctattgtgaaagttagcaccaagaaagatgtgcagtatcaggtcgtgggggttcctacaaccatggtgacacaaatcgaacagctggagcagcagggcatgaccaataagcaagccgtcacaaaagtgattgagcccctcatcgcggctaacaataagaagatgctgacctacgaagttctcctgccgaaagtgcgctttgagcaggtcgtgcgggacagaattaagggacagacgcaccgcttcgcccttggcacagatacctactatcacaacatccaggaactgtacctccctctgaccctgcaacgggcctttcttgggaaacagaatgagtccgaggtgcagctgaaccagaatctcctgacagtcttcgacgctaccctcgcccaagttaacagatattttcccctgtacgaaatgaataagttcaaaaagatccttaacagcgcgcgcgatcagattgagctgctggaagctaagaatcagtttgtgaaaaacaagctcgtgctgggaaaacaaggcatccttacgaatatgttcattgggctgcatgccaacgcctcttatggagacctcaaggtcctgggcgtgaaaatcgacttcgggaagctccaggttcccggcggaattaagctgacaggcgatgctgagatcatctaccagtcccctaccgggctttttgaaagaaaaattgccctgaaggacctgtga

SEQ ID NO: 4214 - RNA, 4077 nt, synthetic construct
  misc_feature 1..4077: note = Cas9 variant
  source 1..4077: mol_type = other RNA
atgaacgagccctacggcgtggggctggacatcggaaccaatagcgtcggctggacagttgtggatatgaacgggagagtgcggaaggtcaaaggaaagacggccctcggcgctcgcctgttcaaagaaggggccaccgcggaggacagacggggatttcgcacaaccagacggcgccttaagagagtgaaatggcggctgcgcctcctgagagagttctttgatcagcctatttccaagatcgacccgaatttctttgctcggcgcaagtattctgatattagccccagagaccctaactacaatggccttgccaaaacactgttcaacgatcggaccgaccaagaattttatcacgattaccccacaatctatcatctccgcgacaagctgatgacctccgatagaaaattcgacattcgggaaatctacctggccatccaccatattgttaagtatagaggcaattttctccgcacggggcctgcttctcagtacggaagcgcctccctgcaccttgctacctctttccagaaactgaacgatctctttgcccagagcgaggagtccctgaatttcaagctggtgacagacgaagcgcaacttcagcagatccagcaaattctcgtccggaccgacctgagcagatctgagcagcagcgccagatctggcccctgatggtggttctcatgggcgccacagctgccgaaaagaaacggcaaaaggattttgctaaagagctggccaacgcgcttgtggggctgaaggccaaactcaatgtcgtgaccctgacgaacgtggacacaaccgtcgttaaggattggacattcacccttgaggaatcccaggacaaactgcctgagattgaggaacagctcagcgaagtgggacaacagatcatggatgaggtgattcagctgtacgcttctgtcaatctggcccagctcatcccggctggcaagagattctcccaacatatggtggagaagtataaccaccacgaaaagaatctggagcttctgaaggcctacatccatagccagtctgactccaaacgcgggcgggaaattagagccacctatgatcgctacatcgacggagttaagagcaaacccgtgacacaggagatgttttataaggatctcatgaagtacgtcgaagctgacgcgacgtccaaccacctggccgctgagattaaagatgagatcgactctgaacagttcatgcctaaacttcggaccaaacaaaacggcagcattccctatcaggtgcagcagtacgagctggaccaaatcatctcccatcagaagaaatactatccttggctcggcgaagagaatcccgttgccgaaagacgcgggaagtttccgtacaagctggatgagctggtgggattccgggtcccttattacgtgggccccctcattacaaaagaggaccagcaggccaccagcggggctggatttgcctggatggtcagaaaggcggatggccctatcacaccctggaacttcgaccaaaaagtggatcggattgcttctgccaccgcctttatccagcgcatgcagacgacagacacctatctgattggggaagatgttcttcccgctagatccctgatctaccaacggttcatggtgctcaatgagctgaacaatatgagagtcgaagaccagaagctggcccctcgccagaaacagcggctttataaccaagtgtttaagcagcaccagcacgttagcgtgaagaatatccagcaaaacctcatggatgctggagagtacagagagaccccgaaaattacaggcctggccgaccccaagggcttcaattctagcctgtccacctaccatgattttaaaaagatcctccctgaagcgattgccgacgagcacaaacgcgctgatatcgaaaagattatcctgtggtctacaacgttcgaggacagcgccatttttaaacagaaacttgaagaggtcgcttggctgaccgacgcccagagaaagcagctctccgggctgcggtatcgcggatggggccaactgagccataaacttctcacagcgttcaaggatgacaacgggagatctgtgatggatggactgtgggagacctccgacaatttcatgcagctgcggaaacagcccgccatcgaaacacaaatcaaggaggctaaccaggccaatctcaccgatgctgacattcaggatacgatcaacgaactgtacaccagccctcagaataaaaaggccattcgcgaggtgatgcttgttctggacgatatcaagaacgccatgcacggccaaacaccctcttggatttttatcgaagctgcgagagggggcggagtcgccggccggcgcacccagtccagaagcaaacagatcgtggaggcttataagtccacagccaaagagattgtgtctgaaaaggtccagcatgagctcaacgaaaagatcaaggccaaggctgacttcaatacccggctggtgctgtactttcttcaaaacgggcgcgatctctatacgaatgaggccattaacatcgacagactgagcgaatacgatattgaccacatcctgccgcagtccctcgttaaagacgattctctggacaatcgggtgcttacaagcgcgagaatcaaccgcgagaagaatgataccttcgcttccgagaaatttggacggaagatgggcgcccagtggagagaactgcaccgcaacgggctcatgacacagcggaaactgaagcatctgcttatgagacctgacgagattagcaagcacgccaccgatttcatcaatcgccaactcgtcgaaaccagacaggtgattaaactggttgaggagctgatctcttccgaatatcccagcgcttctattgtggccgtcaaggcgaacctcacacatcagtttcggcagacgttcaattttcctaaactgcgcgaggtgaacgactaccaccacgctttcgatgcctcccttaccgcctttatcggaatgtacctgctcaagcaatatcccaaactggaacggttctttgtttacggcaagttcgctaaacagcctatcaatctgacaagattcaacgtgattcggaaacttgccgtcgctgaggaacccatcgccaatattgagaccggggagatcctgtgggacaagacagcggatattaagtgctttgaaaagctctataactacaaacgcctgctcgtgacccatgaggtgagagaaaactatggcgccatgttcgaccagacgatctttaaggctacagatagccggaaacgcctgattcaaaagaagaaaggattcgccaccgagacctacggcgggtatacaggaagaacccttgcttacctggccatcgtcaaggttgtgacaaataaagacacgcagtaccaggtggtcggcatcccgaccacaatggtgacccagattcaacagctcgaagcctctgggctgacaagcaagcaggctgttaccaaagcgatcggagccatgattaacgagaataacaagaagctgcagtcctatgaggtgcttctgcctaaagtccggtttgaacaagtggttagagacgaggtgaagggccacatccatcgcttcgctctcgggacggatacctactatcacaatattcaggaactgtacctccccctgacaatccagcgggcctttcttggcaaaagaaacgacaccgatgcccagacagagcaaaatctgctcaccgtcttcgaaacaaccctggctcaggtgaaccgctattttcccctgtacgagatgaataagttcaaacagatccttaacagcgcccaagagaagtttgcggctctgcctacgaagaataaaacagttaagaacaaactcgtgaccggaaaggacggcgtcctgaataacctcttcattgggctgcatgccaatgcctctcttggagatctgaaaatcctgggcatgaagaccgggttcggaaagctccaggtgccgggcgggctgaaacttacagaccaggctgaaattatctatcagtcccccaccggcctgtttgagcggaaggtggccctcaaagatctgtga

SEQ ID NO: 4215 - RNA, 4077 nt, synthetic construct
  misc_feature 1..4077: note = Cas9 variant
  source 1..4077: mol_type = other RNA
atgaacgagccctacggcgtggggctggacatcggaaccaatagcgtcggctggacagttgtggatatgaacgggagagtgcggaaggtcaaaggaaagacggccctcggcgctcgcctgttcaaagaaggggccaccgcggaggacagacggggatttcgcacaaccagacggcgccttaagagagtgaaatggcggctgcgcctcctgagagagttctttgatcagcctatttccaagatcgacccgaatttctttgctcggcgcaagtattctgatattagccccagagaccctaactacaatggccttgccaaaacactgttcaacgatcggaccgaccaagaattttatcacgattaccccacaatctatcatctccgcgacaagctgatgacctccgatagaaaattcgacattcgggaaatctacctggccatccaccatattgttaagtatagaggcaattttctccgcacggggcctgcttctcagtacggaagcgcctccctgcaccttgctacctctttccagaaactgaacgatctctttgcccagagcgaggagtccctgaatttcaagctggtgacagacgaagcgcaacttcagcagatccagcaaattctcgtccggaccgacctgagcagatctgagcagcagcgccagatctggcccctgatggtggttctcatgggcgccacagctgccgaaaagaaacggcaaaaggattttgctaaagagctggccaacgcgcttgtggggctgaaggccaaactcaatgtcgtgaccctgacgaacgtggacacaaccgtcgttaaggattggacattcacccttgaggaatcccaggacaaactgcctgagattgaggaacagctcagcgaagtgggacaacagatcatggatgaggtgattcagctgtacgcttctgtcaatctggcccagctcatcccggctggcaagagattctcccaacatatggtggagaagtataaccaccacgaaaagaatctggagcttctgaaggcctacatccatagccagtctgactccaaacgcgggcgggaaattagagccacctatgatcgctacatcgacggagttaagagcaaacccgtgacacaggagatgttttataaggatctcatgaagtacgtcgaagctgacgcgacgtccaaccacctggccgctgagattaaagatgagatcgactctgaacagttcatgcctaaacttcggaccaaacaaaacggcagcattccctatcaggtgcagcagtacgagctggaccaaatcatctcccatcagaagaaatactatccttggctcggcgaagagaatcccgttgccgaaagacgcgggaagtttccgtacaagctggatgagctggtgggattccgggtcccttattacgtgggccccctcattacaaaagaggaccagcaggccaccagcggggctggatttgcctggatggtcagaaaggcggatggccctatcacaccctggaacttcgaccaaaaagtggatcggattgcttctgccaccgcctttatccagcgcatgcagacgacagacacctatctgattggggaagatgttcttcccgctagatccctgatctaccaacggttcatggtgctcaatgagctgaacaatatgagagtcgaagaccagaagctggcccctcgccagaaacagcggctttataaccaagtgtttaagcagcaccagcacgttagcgtgaagaatatccagcaaaacctcatggatgctggagagtacagagagaccccgaaaattacaggcctggccgaccccaagggcttcaattctagcctgtccacctaccatgattttaaaaagatcctccctgaagcgattgccgacgagcacaaacgcgctgatatcgaaaagattatcctgtggtctacaacgttcgaggacagcgccatttttaaacagaaacttgaagaggtcgcttggctgaccgacgcccagagaaagcagctctccgggctgcggtatcgcggatggggccaactgagccataaacttctcacagcgttcaaggatgacaacgggagatctgtgatggatggactgtgggagacctccgacaatttcatgcagctgcggaaacagcccgccatcgaaacacaaatcaaggaggctaaccaggccaatctcaccgatgctgacattcaggatacgatcaacgaactgtacaccagccctcagaataaaaaggccattcgcgaggtgatgcttgttctggacgatatcaagaacgccatgcacggccaaacaccctcttggatttttatcgaagctgcgagagggggcggagtcgccggccggcgcacccagtccagaagcaaacagatcgtggaggcttataagtccacagccaaagagattgtgtctgaaaaggtccagcatgagctcaacgaaaagatcaaggccaaggctgacttcaatacccggctggtgctgtactttcttcaaaacgggcgcgatctctatacgaatgaggccattaacatcgacagactgagcgaatacgatattgaccacatcctgccgcagtccctcgttaaagacgattctctggacaatcgggtgcttacaagcgcgagaatcaaccgcgagaagaatgataccttcgcttccgagaaatttggacggaagatgggcgcccagtggagagaactgcaccgcaacgggctcatgacacagcggaaactgaagcatctgcttatgagacctgacgagattagcaagcacgccaccgatttcatcaatcgccaactcgtcgaaaccagacaggtgattaaactggttgaggagctgatctcttccgaatatcccagcgcttctattgtggccgtcaaggcgaacctcacacatcagtttcggcagacgttcaattttcctaaactgcgcgaggtgaacgactaccaccacgctttcgatgcctcccttaccgcctttatcggaatgtacctgctcaagcaatatcccaaactggaacggttctttgtttacggcaagttcgctaaacagcctatcaatctgacaagattcaacgtgattcggaaacttgccgtcgctgaggaacccatcgccaatattgagaccggggagatcctgtgggacaagacagcggatattaagtgctttgaaaagctctataactacaaacgcctgctcgtgacccatgaggtgagagaaaactatggcgccatgttcgaccagacgatctttaaggctacagatagccggaaacgcctgattcaaaagaagaaaggattcgccaccgagacctacggcgggtatacaggaagaacccttgcttacctggccatcgtcaaggttgtgacaaataaagacacgcagtaccaggtggtcggcatcccgaccacaatggtgacccagattcaacagctcgaagcctctgggctgacaagcaagcaggctgttaccaaagcgatcggagccatgattaacgagaataacaagaagctgcagtcctatgaggtgcttctgcctaaagtccggtttgaacaagtggttagagacgaggtgaagggccacatccatcgcttcgctctcgggacggatacctactatcacaatattcaggaactgtacctccccctgacaatccagcgggcctttcttggcaaaagaaacgacaccgatgcccagacagagcaaaatctgctcaccgtcttcgaaacaaccctggctcaggtgaaccgctattttcccctgtacgagatgaataagttcaaacagatccttaacagcgcccaagagaagtttgcggctctgcctacgaagaataaaacagttaagaacaaactcgtgaccggaaaggacggcgtcctgaataacctcttcattgggctgcatgccaatgcctctcttggagatctgaaaatcctgggcatgaagattgggttcggaaagctccaggtgccgggcgggctgaaacttaccgaccaggctgaaatcatttatcagtcccccacaggcctgtttgagcggaaggtggccctcaaagatctgtga

SEQ ID NO: 4216 - RNA, 4077 nt, synthetic construct
  misc_feature 1..4077: note = Cas9 variant
  source 1..4077: mol_type = other RNA
atgaaggagccctacggcgtggggctggacatcggaaccaacagcgtcggctggacagttgtggatgcctccgggcacgtgagaaaaattaagggacagacgggcatcggggtccgcctcttcaaagaaggagctgccgcggctgaccggagaggctttcggaccacacgcagacggctgaagcgcgtgaaatggagacttcggctgctccgcgagttctttgatcaacctatttctaaggttgacatcaatttctttgccagacggaagtatagcgatatttccccgcgcgaccccaactacaatggcctggaaaagacccttttcaacgatagatctgaccaggatttttatcatgactaccctacaatctatcatctgcgggaggccctcatgacccagcaccgcaagttcgatgtgagagaaatctacctggctattcaccatatcgtcaaatatcgggggaattttctgagaaacgacgccgctacagcctaccgcagcggaaccctcgatctgcagcaacacttcgagacgcttaatcacctgttttcccaggcggacctcgagctgaaccttaatctgaccacagacgtggccctcctggattctattaagcagaccctggttcggacagacatcagcagatccgatcgccagaaactcattatgcccctgcttgctgtgctgaccggcgccacgacagctgaaaagaagcggcaaaaagccgtcgtgaccgagttcgcgaaggccctcgtggggaacaaaacaaagatcgacgtcctgacccttaccgatattgacgctacagaagccaaagattgggcttttagcctggaggagaatcaggacaagctccctggaatcgaagatagattctctgaggttggccagcagatcattgacgaagtgatccgcctgtacgcctccgtgaacctggcccaactcattcccgaggggaaacggttcagccagtctatggtcgaaaagtataagagacatggagaggatctgaaacttctgaaggcttacatccgctcccagagcgacgcgaaacggggcagagccattcgcgctacgtatgaccaatacatcgatggcgtgaagtctaaacaggttacccaggaggcctttcagaaggccctcgggaagttcgtggacgctgatgtcgaccttaattcctgggccgcgcaaatcaaacaggctattgatagcgaacagtttatgcctaaactgcggacaaaacagaacggagccatcccgtatcaagtgcagcagaatgagctggaccagattatcaacaaccaaaaggaatactatccctggctcggcgaggaaaatcctgttattaaaagacgggggaagttcccctacaagctggatgagctggtgggatttcgcgtcccttactatgtgggccccctcatcaccaaagagatgcaggccgctacagccaacgctgggttcgcctggatggtcagaaaggcggacggaccgatcaccccttggaattttgatgacaaagtggatcgggttgcctccgctacggccttcattcagagaatgcagacaaccgacacctacctgatcggcgaagaggtgcttcccgctcgctctctgatttatcaacggtttatggtcctcaacgaactgaataacatcagagtggatgacggccagctgacacctcgccagaagcaaagactttacaatcaggttttcaaaaagcacaagcgggtgaccgccaaaaacattcaggacaatctcgtcgcggccggggagtttcccacagctccccgcatcacgggactggccgatcctaaggtgttcaacagctccctgagcacctatcatgacctcaaacaggtgctgccggaagctatgtctgatgttagaaagcaagccgacattgagaaaatcatcctttggtccacaatttttgaggatagcaccatcttcaagcagaaactgacagaaatttcttggctcaccgccgctcagctgaagcagctgggccaacttcggtaccgcgggtggggacagctcagcagaaagctgctgacgggcctcaaagacgataataaccggtccatcatggacgggctgtgggagaccaatgcgaacttcatgcagcttcgctctcagcccgccattgaaaatcaaatcaagagcgctaaccaggccaacctgacaaccgccgatctccaggacacaatcaatgagctgtatacctcccctcaaaacaaaaaggctattagagaggtcatggtggtgctggccgatatcaaagacgcgatgcacggccagacgcccaattggatttttgtcgaagctgcccggggaggcggggtggccggacgcagaacacagagccggtctaagcagatcgttgctgcctaccaaggcaccgctcaggtgattgtctccgatcaggtgcagagagagcttaaggagaaaatcaagaacaaagcgaatttcaacacacgcctcgttctgtactttctgcaaaatgggcgggacctctataccggagacgccatcaacattgatagactgagcgagtacgacatcgatcacattcttcctcagtctctggtgaaggacgattccctcgacaatcgcgtcctgaccaacgcccggatcaatagagagaaaaacgatacattcgctagcgaaaagtttggcaagaaaatgggggccaagtggaaagagatgcatcgcatgggcctgatgacgaagcggaaacttgaccacctcctgatgagacccgatgaaatttccaagtatgctaccggattcatcaatcgccagctggtggagacacggcaggttatcaagctcgtggaggaactgattaacgccgaatacccgtctaccgcgatcgtcagcgtgaaagccaatcttacacatcaatttagacagaccttcgactttcctaagattcgggaggtgaacgattatcaccatgctttcgacgccgctctgacggcctttatcggcacatacctcctgaaacgctatcccaagctggagagattctttgtctacgggaaattcgccaagcagcctgttaaccttacccggttcaatgtgattcgcaaactggctaagaccgacacacccatcaccgatattgacacaggagaagtgctctgggataagctgacggacatcaaatactttgagaccctctatgattacaagagactgcttgtcacacgggaagtgtccgagaactatggcgcgatgttcgaccagaccctgctcaaagcctctgataatgggaagagactgatccgcaaaaagcagagctttgacacagctatttacggaggctataccgggaagacgctggcctacatggccatcgttaaagtgtccaccaagaaagatgtccaatatcaggtggttggcgtgcctacaaccatggtcacacaaattgaacagcttgagcagcagggaatgaccaacaagcaagctgtgacaaaagttatcgagcccctgattgccgcgaataacaagaagatgctcacctacgaagtgctgctcccgaaagtccggttcgaacaggtggtgagagaccgcatcaagggccagacgcaccggtttgctctggggacagatacctactatcacaatatccaggaactttacctgcctctcaccctgcaaagagccttcctgggaaaacagaacgagagcgaggtccagcttaatcagaacctgctcacagtttttgacgccaccctggctcaagtgaatcgctatttccccctctacgaaatgaacaagtttaaaaagattcttaattctgcccgggatcagatcgagctgctggaagcgaagaaccagttcgtgaaaaataagctggtcctcggcaaacaagggattctgacgaacatgtttatcggacttcatgctaacgcctccttcggcgacctcaagagcctgggggtgaaaacatctttcggccagctgcaggttcccggaggcattaagctcaccggggacgccgagatcatctatcagtcccctacaggactgtttgaaagaaagattgctcttaaagatctgtga

SEQ ID NO: 4217 - RNA, 4077 nt, synthetic construct
  misc_feature 1..4077: note = Cas9 variant
  source 1..4077: mol_type = other RNA
atgaagcagggcaaaagagggtactatctgggactcgacatcggcaccgatagcattgggtacgccgtgacagacgagcaatatcatctgcttcggttccatggaaacgatgcttggggctcccacgtctttgactctgccagcctgtgcgatgaacgcagagggttccggtccgcgcgcagacggctcgaccgcagacagcagcgggttaagctgcttcaggagatctttgctaaagaaattgccaatatcgatccccgcttctttattagactgtctgagagctaccggtggcgcgacgatacggacgatagatatatctacttcaacgaagaggagtataccgacatccaatacatgcgggattaccctacaattcatcacctcatctgtgaactgatggagaatgaagaggagcatgacattcgcctggtgtatctcgcctgcgcttggctggtggcccacagaggacactttctttcccagctgtctgtcgacaacatcgatagcctcattgacatcgaatccgtgtaccagaagttcctgcactttttcattgataatggctgtgagaacccgtggatccaggacgctgaacttgttggcgggatcctgaaagagcacattggagtgaccgaaaagcataatcggctcggcgagatcatgctggggaacagaaagcccagcaaagatgtccgcgacacatttctgtattctgagtactgcattatccggctcctggccggaggcacctgtaaacttagagatctgtatgggaaagaagagtacgaagacttcggatccgtgagcctcgagatggatgacgataagctggcggaaattatgatcaatatcggcgaggactatgagcttattgccgttctgcgctctctccacgactggtccgtgctggctgatatcctggacggccaaaacgggctcacaaatattagcaccgccaaagtcgctatctacgaacagcacaagaaggatctggccacgcttaaatactttattcggaagtattgccctgagaaatacaacgcgatcttcaaggacgccagagaagataattatgtggcttactcttatcattacaacaataaactggacggacagatcaagaaaaaggccgataccgagacattctccaagtttctcattaaaatcattcacagcatcaagcccgacaaagaagatgagattatctatcaggacatggataaccgcctgggccttcggcaattcctgcctaagcagagaaacaccgacaatcgcgtgattccccatcagctctacgagtacgaactgaaaaagatcctggagaacgctgccaagtatctctcctttctgaatcaaaaagaagatgggatctctaacacagagaagattatcagcattttcaaatttaagatcccttactatgtcggaccgcttaataaacactccgagttcgcctggattgacagaaagagcggcaagatcctgccctggaactacgaaaatatgatcgacgatgacgcttctgaggaagcgtttattaaaaagatgaccaaccagtgtacgtatctccctggggagtccgttctgcccaaagatagcctgtgctaccagaagttcatggtgcttaatgaaatcaacaatattaaagtggacggacggaagatctctgtcggcgccaagcagggcatttatagcgatctctttctgaaatacaagaaagtgaagcgctcccaaatcgaggagtacctgatctctaacgggcagctcgaaaagaatcggagagagacactgagcggaattgacatccagattaagtccagcctttcttcccatatcgctttccggcgcctgctcgaacagaaaattctgaacgaggccgatgttgaaagaatcatcgagcgggccagctatgctgaggacaagggcagagtggccaagtggctgcgcgcgaaataccctcaccttaccgaagctgatattaagtatatctgtaaagtcaagattaaagactttgggcggctctctagaacattcctgaccggaatcgagggcgcctgcaaggaaaccggggaggtggccacaattatctccatgatgtgggaaagcaatgataacctgatggagctcctgtccgagcgctacacgtttgctgacaccattcttgagttcaagtctgattattacacagaaagaaaacaaaccctgagcgaacggctcgacgagatgtatgtttccaacgccgtgcgcagacccatctaccggacactggacatcgtcaaggatctggagaaggctttcggcaagccggagaaaatttttatcgaaatgacccgcggagccatgcctgaacttaagggcaagagaacgaaatctcggcagcagcagctcctggagtactatgacaagtgtaaagaagaggatgtgcgcgacctgaagcaacagctcgaggcgctgggggaatacgtcgataataaacttcagagcgacagactgttcctctattttatgcagttcggaaagtgcgcctactccggcatgcccattagcctggagcggctgatggctgggtctaaggaatatgatatcgaccacatttaccctcaagcctatgtgaaagatgactccatcatcaacaataaggttcttgtgctcagcgtcgctaacggagagaaaaaggatgtgtaccccattaaatctgaaatccgcaataagatgcagaaaacatggtccttttggcatcacgttggcaccattagcgacgagaagtacaagagactgatccggtctacccccttcacagaggacgaaaaatatgggtttattaacagacagctgaccgagacaagccaatccacgaaggtggtcgccgaactcctgaaagagcgctaccctgaagcggagatcgtgtatagcaaggccggccttatctctgatttccggcatgagtttgacctgtacaaatccagaagctataatgatctccaccacgctgtggacgcctacctgaacattgttgtcggaaatgtgtatcatatgcgcttctcccggcagtggtttaacgtcaattctagctactccatcaagaccaagacactgttcacccacacagtgaactgcaatggcaaagaagtgtggaacaaggatatgcttccgggggttctgaaaaccgctaagaaaaatacggcccattttaccaagcacgccacattcaagaccggaggcctcttcgaccagaaccccgtgaaaaaggctcctgggctgacacccctcaaagcgggactgcctaccgagaagtacggcgggtataacaaagccggcgtcatgtttttcattcccgtgagatacaagtctggaaagaaaacggttcttatggtgctgagcgtcgaactcctgtatggcaatcgctttctggaggatgagatcttcgctaaggaatacgccaaagaccggcttcagagaatgattgggaagtccgtggatgagatcgactttccgattggaatgcgcccttggaaagttaacacaatcctgtctctcgatggcttccggatctgtattaccgggaatgccagcggaggcaagtgcctgatcgctcaacccattatgcagttttccagcgacgaatattggaagtactatctcaaaaaggtggagaaattcgtcgaaaaggtgaaaaacaattcttcctacgtgtacgatgtcgactatgacgccgttcagcatgaggataacctgaaactttacgacctgtatctcgataaactgcagaatagcatctacagaaagcggattaacgcgcctatccaaacactgatcgaggggcgcgaaaagtttattgactgttctgtgatcgagcagtgccaggtgcttctgaatattcaccaggtcttcggcagaatgacctccggatgtgatctcaccctgatcggcgggaaaacacggagcgcttctacggtgaacttttccagcattatcctcaattggaagaaaaactataccgacgttcgcatcattgatcaatccgccagcggactgtgggaagtggtctctgagaatatccttgaatacctgtga

SEQ ID NO: 4218 - RNA, 4077 nt, synthetic construct
  misc_feature 1..4077: note = Cas9 variant
  source 1..4077: mol_type = other RNA
atgggcaagatgtactatctggggctcgacatcggaaccaacagcgtgggctacgccgtcacagatccctcctatcaccttcttaaattcaagggggagcctatgtggggagctcatgtttttgccgcgggcaatcagtctgctgaaagacggagcttccgcacgtccagacggcgcctggacagacggcaacagcgcgtgaaactcgtgcaggagatttttgccccggtcatctctcccattgatcctagattctttatccggctgcacgaaagcgccctttggcgcgacgatgtggctgagaccgacaagcatattttctttaacgatcccacatacaccgacaaagaatattactccgattatcctacaatccaccatctgatcgttgacctcatggagtctagcgagaagcacgatcccagactggtgtacctggccgtcgcttggctcgtggcccaccgggggcatttcctgaatgaagttgacaaggataacattggagacgtgctttcctttgacgcgttctaccctgagtttctggccttcctcagcgataatggcgtctctccgtgggtgtgcgaatccaaagctctgcaggccacccttctgagccgcaactctgtgaatgacaagtataaagctctcaagtccctgatctttggcagccaaaaacccgaggataacttcgacgccaatatttctgaggatgggctgatccagctcctggcgggaaagaaggtcaaagttaacaagctgttccctcaggaatccaatgacgccagctttacactgaacgataaagaggacgctattgaagagatcctcggcaccctgacgcccgatgaatgtgagtggattgcccacatcagacggcttttcgactgggctatcatgaagcatgccctgaaagatgggcgcaccatttccgagtctaaggtgaaactctacgaacagcaccaccatgacctgacacaactgaagtattttgtgaagacctacctcgccaaagagtatgacgatatcttcagaaatgtcgacagcgaaacaaccaagaactacgtggcttattcctaccacgttaaagaggtgaagggaacgctgcctaaaaataaggcgacacaggaagagttttgcaagtacgtccttggcaaagtgaagaacattgagtgtagcgaagccgataaagttgacttcgatgagatgatccagcggctgaccgacaactcttttatgcccaaacaggtgtccggggaaaatagagtcattccgtatcaactctactattacgagctgaagacaatccttaacaaggctgccagctatctgcctttcctcacccagtgcggaaaggatgccatctctaatcaggacaaactgctgagcattatgacctttcgcatcccctacttcgtgggccctctccggaaggataactccgaacatgcttggctggagagaaaagccggcaagatttatccctggaattttaacgacaaagtcgatcttgacaagtctgaggaagcgttcatccgccggatgacaaatacgtgtacctactaccccggggaggatgtgctgcctctcgacagcctgatttatgaaaagtttatgatcctgaacgagatcaataacattagaatcgacggatacccgatttccgttgatgtgaaacaacaggtcttcggccttttcgagaagaaacgccgggtgacagttaaggacatccagaatctcctgctgagcctcggggctctggataaacacggaaaacttaccggcattgacacaaccatccattctaactataatacgtaccaccactttaagtccctgatggaaagaggggtgctcacacgcgatgacgtcgagcggattgtggaaagaatgacctatagcgatgacaccaagcgcgtgcggctgtggctgaacaataactacggaacacttaccgccgatgacgttaagcatatctctagactccggaaacacgatttcggccgcctgtccaagatgtttctgacaggcctcaaaggggtccataaggagacgggagaaagagccagcatcctggacttcatgtggaacaccaatgataaccttatgcagctgctctccgagtgctatacattttctgacgagattaccaaactgcaagaggcttactacgccaaggctcagctgagccttaatgacttcctcgattccatgtatatctctaacgccgtgaagcggcccatttacagaacactggcggtggtcaatgacatccgcaaagcctgtggcaccgctcctaagcggatttttatcgagatggccagagatggggaaagcaaaaagaaacgctccgtgacgagacgggagcagatcaagaacctgtatcgcagcattagaaaggacttccagcaagaagttgattttctcgagaaaatcctggagaataagtctgacggacagcttcagtccgatgctctgtacctctatttcgcccagctgggccgggacatgtacaccggggatcccattaaactggaacacatcaaggaccagagcttttataacattgatcacatctaccctcaatctatggtgaaagacgactcccttgataataaggtcctcgtgcagagcgagatcaacggcgaaaagtctagccgctaccccctggacgcggccattagaaataaaatgaagccgctgtgggatgcttattacaaccatggactcatctccctgaaaaagtatcagcggcttacacgcagcacccctttcacagacgatgagaaatgggactttattaatagacaactggttgaaacccggcagtctacgaaggccctcgctatcctgctgaaacgcaagttccccgatacagagattgtgtactccaaggccggccttagctccgacttcagacacgagtttgggctggtcaaatctcggaacatcaatgatctccatcacgccaaggacgctttcctggcgatcgtgaccggaaacgtttatcatgaaagatttaaccgccggtggttcatggtgaatcagccttacagcgtcaaaacaaagaccctctttacccactccattaaaaacggcaatttcgtggcctggaacggggaggaagatctgggaagaatcgtgaagatgcttaagcaaaataaaaacacaattcactttacgcgcttctcttttgaccggaaggagggcctgttcgatatccagcccctcaaagctagcaccgggctggtccctagaaaggccggcctggacgttgtgaaatatggaggctacgacaagtccacagccgcttactatcttctggtgcgctttaccctcgaggataagaaaacacagcataagctgatgatgattcccgtcgaagggctctacaaagcccggatcgaccacgataaggagttcctgaccgactatgcgcagacgacaatttctgaaatccttcaaaaagataagcagaaggtgatcaatattatgttcccgatgggaaccagacatatcaaactgaacagcatgatttccatcgacggcttttacctcagcattgggggaaagtcttccaaaggcaagagcgttctgtgccacgctatggtgcctctgatcgtcccccataaaatcgagtgttatattaaggccatggaatctttcgcccgcaagtttaaagagaataacaaacttcggatcgtggagaagttcgataagattaccgttgaagacaatctgaacctctacgagctgtttctccagaaactgcagcacaatccctataacaagttcttttccacacaattcgatgtgcttaccaatgggagaagcacatttacgaaactgtctcctgaagaacaggtccagaccctgctcaacatcctgtccattttcaagacatgccggagctccggctgtgaccttaagagcatcaacggatctgctcaggccgcgcgcatcatgattagcgctgatctgaccggcctctccaaaaagtactctgacatcagactggtggaacaaagcgcctccgggctctttgtttctaaaagccagaatctgcttgagtacctgtga

SEQ ID NO: 4219 - RNA, 4083 nt, synthetic construct
  misc_feature 1..4083: note = Cas9 variant
  source 1..4083: mol_type = other RNA
atgaccaagctgggcaaaccctacgggatcggagtggacattggcagcaactccatcgggttcgccgctgtcgatgaaaattctcacctcattagactgaagggaaaaacagttatcggcgcccggctttttgaagaggggaaggcggctgccgaccgcagagccagccggacgacccgcagacggctgtcccgcaacagatggcggctctctttcctgcgcgatttcttcgaaagccatattacacctaccgacccgaactttttcatgagacagaaatattccgagatctctcccaaggataaggctcggtacaaatatgaaaagcgcctttttaatgacagaacagatgccgagttctaccaacagtatcctaccatgtaccatctgcggacacgcctcctgaccgaccccagcaaagctgatgtgagagagatctattttgccattcaccacatcctgaagtcccggggacatttcctcacgagcggctacgcgaaagactttaataccaacaaggtggccctgaatgaaattttccctgcccttcaggatgcttacgctcaggtctatcccgacctggatatcacatttgacgagaacaaggtgaatgaatttaaaaccgttctcctggacgagaaggccacaccttctgatacccaaagagcgcttgtgaacctgctcctggccgaggacggcgataaagacattctgaagcagcagaaacaggtcctcacggagttcgctaaggccgtggttgggctgaaaacaaaacttaatgtggctctgggaaccgaggtcgattccagcgaagccacagcctggaacttttctctcggccaactggacgataagtgggctgggatcgagtccgcgatgaccgacgaaggaaccgagattcttgatcagatccgcgacctgtaccgggccagactcctgaatggcatcgtgccggctgggaaaacactgagccaggccaaggtggatgactatgagcagcaccacgaagacctcgagctgttcaaagattaccttaagcaactggaagacgatggaatggccaaagctattcgccagctctatgaccggtacatcgatggcgacgatgccaagccctttgtcagagaggacttcgttaaggcgctgacgaaagaagtgaccgctcatcctaacgccaagtctcccgagcttctggagcgcctcgtgcagcctgattttatgctgaaacaacggaataaggccaacggcgctattcccgtccagatgcagcagagagaactggaccaaatcattaaaaaccagtccgtgtattacgattggctcgccgctccgaatcctgttgagaagcaccgccagagcatgccctaccagttcgacgaactgcttaactttcggatcccttattacgtggggcccctggtcacagccaaggagcaaaaagcggcccagggaggcgtgttcgcttggatggttagaaaggatcccgacgggaatatcaccccttataactttgacgaaaaagtggatcgcgaggcctccgctaatacattcattcagcggatgaagaccacggacacatacctcatcggagaggatgtcctgccgaaacagtctctgctttatcaaagctacgaagtgctcaacgagctgaataacgtcagagtgaatgacaacaagctgtcctttgatcagaagcagcaggttctcggcgaactgttcgagcggcataataccgtgaccattaaacaatttgtcgacaaccttctggcccacggggattatgaccgcatccccgaggtgagaggactcgcggatgaaaagcggttcctgagctctctgtccacatacaatcagcttaaaggcattctccacgaggccatcgacgatagcgacaagcagaccgatatcgaaaagattatcgcttggtctacaattttcgaggacaaggccatctttaaaacgaagctgaacgaaattagctggctgaatgctggcatgatcaactccctcgccaacattagataccgcgggtggggacaattctctcataagctgcttaatgagctgaccctcagcacaggccggaccgtttttgaggaactgctgatctccagccacaaccttatgcagatcctcacagacgaggtgctgaaacagaagattgccgaactgaatgctcatgagctcaaagcgtctgggatctatgccgctattgatgacgcctacacctcccctagcaacaagaaagccctgagacaggtcctttctgtgatcgatgacattacgaatgctgccggacaagcgcccaactggctgtatatcgaaaccgctgatggcgacggggtgcctggcaagcgcacaaattccagacagcggaagatccaggagatttacgttaacgccgcccaggagctcatcaccggaagcgtccgcggcgaactggaggataaaattgcttccagagccgacttcacagatcggctggtgctttattttatgcaagggggacgcgacatctacaccggcgaacccctcaatattgataacctgtctagctatgacatcgaccacatcctgccgcagtccctcattaaggataattctctggacaacagagtgcttgtccatcctctggtgaatcgggagaaagatacgatcttcgcgagcacacgctttgctaagcagatgaacgggatgtggagacagtggcacgccgccggactcatttccagccggaaactgcgcaatctgcaaatgagacccgacgaaatcgataagtacgcttctggcttcgttgcccggcagcttgtggagaccagacagattatcaagctgacagagcaaatcgtcgctgaccagtaccctgatgccaaaattatcgcggtgaaggccgggctctccagccagctgcgcaaagaactcgactttcccaagaaccgggaggttaaccactatcatcacgctttcgatgcctttctggctgccagaattggcacctaccttctgaaacgctatcctaatctcgaacccttctttacctacggaaagttcaagaaaacagaggtgaagaaactgaagtctttcaactttatccgggacatgacgcatgccaaagataagattgtcgctaaagagaccggcgaaatcgtgtgggacaatgcgtccgatattaacgagctggacagaatctataatttcaagcgcatgcttatcacacacgaagttcggtttgagaccgccagcctgttcaagcagacactctacgctgccaaaaactctaagaatagagggggaagccgccaactgattccgaaaaagaaaggctatctcgtggacatctacgggggatacacccaggaaacgggctcctatctgagcgtcgtgcggcttacaaagaaggccatgtacgctgtggtcaaagtttctaccagagatgccgcgaagctggctgtggccaaatccattagcgagcagaaggagaacgaaaccctcaaaaagatcattgacgggaagctgtccaaaacatctaagaaaggcaagaccacacaccagctgtttgagatcgtgcttcctcgggtcggacagaaaacgctgttcaagaatagcaagtataaccaatttctcgttaattccgatacctacatgcataactatcaggaactgtggatgccccgcgagtaccagagaatgtggaaagacatcctcctgtctaatcacggcgatgcccaacttgaagggcagctggaccagattttcaagtttatcgtgagccaggtgaactcctatttcaatctgtacgatattaaccaatttcggaaaaagatcgctgacgccacagataaattcgcgaagctccccacccatgacacagataacgctcgcggaaagattgccaccatcggccagctgcttatcgggctgcaggccaatgctatgagatctgacctccggaacctggatattaaaacgcctttcggactcctgcaaatcggcaccgggattacacttgacctggacaccagcatcatttaccagtccccgacaggcctgtttgagagagaggtccccctcaccgatctgtga

SEQ ID NO: 4220 - RNA, 4083 nt, synthetic construct
  misc_feature 1..4083: note = Cas9 variant
  source 1..4083: mol_type = other RNA
atgaccaagctgaaccagccctacggcatcgggctcgacattggaagctcctctatcggcttcgccgtggtcgatgctaatagccatctgcttagactgaaaggggagacagccattggagcgcggctctttcgcgaaggcgagtccgctgccgggagacgggcctctcgcacgaccagacggcgcctgagccacaacagatggcggcttcgcttcctgcaagactttttcgatcctcacatctcctctattgacccggactttttcctcagacagaagtatagcgaaatctcccccaaagataaggagcggtttaaatacgaaaagcgcctgttcaatgatagaacagacgctcagttttataagcagtaccctaccatgtatcatctgcggctccacctgatgaacgatgccagcaaagctgacccccgcgagatcttctttgccattcatcacatccttaagtctagaggacacttcctgacacctggcgatgcgaaaaattttaacaccgacgatgttgacctcaagcatattttccccgccctgacagaggcttacgcccaggcttatcctgaccttaccctgtccttcgaaccgagcaaagccgagaagtttaagtctatcctcctggatgaagacgcgacgtccaatgatacccaaaaagccctggtgaagctcctgcttagcgacgatggcgacaaagaggtgctgaagcagcagaaaaaggtcctcacagagttcgctaaagccgtggctgggctgaaggttaagtttaacgtggcccttggaattgaagtcaccgatgccgacgtggagaaatggcacttcggcatggctcaactggaagataagtggtctgacatcgagccctccctcacagatcaggggatggaaatttttgagcagatccaggacctgtaccgggcgagactgctcaatggaatcgttcctgccggcaaaaccctgagccaagctaaggtggacgattacgaccagcattgcaaagatcttaagctgttcaaggagtatctcaaacagctgaacgaccacgatcttgccaagcgcattcggctgctctacgacagatatatcgatggggacgatgccaaaccctttctgcgcgacgatttcgtcaaggctctgaaaaaggaagtgacggcccaccctacagagctcgcggaatccctgcttgagcggatggaacaagacaattttatgctgaagcagagaaccaaagctaacggatctattcccgtgcagatgcagcaacgcgagctcgataagatcattgccaatcaggccgagtactatagctggctggctgccgaaaacccggtcaaagagcatcgggactccaagccttaccagctggacgaacttctcaatttcagaatcccctattacgttggccctatgatcacaaagaagcagcaagagaaaagcggccagaacgtgtttgcttggatggtgcgcaaagatccctctgggaacattaccccctacaatttcgacgaaaaggtcgatcgggaggcctccgcgaacgcctttatccagagaatgaaaaccacagacacgtatctgattggagaggatgtgctgcctaagcagagcctcctgtaccaaaaatatgaagttcttaatgagctgaacaatgtgcgcgtcaacggcgaatctctcagcaccgaccagaagaaacggctgatcagagagctgttcgagcggcactcctctgtgacacttaagcagttcgttgaaaatctcgtggctcatggggatgtcgccaagcgcccggacgtgagaggactggctgatgagaaacggtttctgagctccctcagcacctaccaccagctgagaggcattcttcatgacgccatcgatgaccgcgggaagcaatctgatatcgaaaacattatcacatggtccaccgtcttcgaggacgcgagcatttttaaatctaagctgggagaaatctcctggctcgacagcaaaacgcggacaaccctgtccaatattagatatcgcggctggggccagttctctagaaagctgcttgatgggctcaagctgggaaacggccacaccatcattcaggagctgatgctcagctcccggaatctgatgcaaatccttacagacgagaccctgaaaaaggaaatggccacactcaaccaggagcgcctgaaacccgattctatcaatgaagctattgacgccgcttacacgagcccttccaacaagaaagccatcagacaggtgctgaaggttgtggatgacattaagcacgccgctaatgatcaggcgcccagctggctttatatcgagaccgccgacgggggaggccatcctgggaaacggacactctctcgccaaaagcagattcaggctatctacgaaaacaccgccaaagagctgatcgattccgccgtcagaggcgagctgaaggacaaaattgctgataagacaaactttagcgaccggctcgtgctgtacttcatgcagggaggccacgacatctataccgggacggcccttaatattgatcaactgtcttcctacgacatcgatcatattctcccccagagcctgatcaaggacgattctctggacaaccgcgttcttgtgcacgcgaaaatcaatagagaaaagaacgctgagtttgccagcaccctgttcgccgctaaaatggcctccacatggcaccggtggcgcgatgcgggactcattagcggcagaaagctgaaaaatctcctgatgcggccggacgaagtcgataagtatgctaaagggtttgtggccagacagcttgtggagacccgccagatcattaagctgacagaacaaatcgttgccgctcagtaccctgacaccaagattatcgccgtcaaagctggactctctcatcagctgcggcaagagctggatttccccaagaacagagacgtgaatcactatcatcacgcctttgatgcgttccttgccgctcgcatcggcacgtacctgctcaaacggtatcctaacctggccccctttttcacatacggggagttcaccaagacaaatctcaaaaagctgcagtcctttaacttcattggcgctcttacccataccgacggaaagatcacaagcaaagacacgggcgaagtgctgtgggataatcagagagacattgaggaactcgatcagatctacaactttaagcgcatgctgattacccacgaggtctatttcgagacagccgggctgtttaaacaaaccgtgtacgccgctaaggactccaaagaacggggaggctctagacagcttatccctaagaagaaagggtatagcacaggaatttacggcgggtatacccaggagacgggctcctacaatgcgctggttcgcctcacaaaggccggaaaagtggtctatcgggtgttcaagatctctacccagaacgctgccgaaatcgccgctgccagaagcctgtccgcggaggaaggcaatgagcggctctgtcaaattctggagcagtctcttctgaaaaccaacaaggataagaaaaacacagttgacctgtttgatgtggtcatcccccgcctcgggaaggaagctctgttccacaatagcaaatacggactttttctggtgaactccgacacctactatcataattaccaggagctctggctgagcagagaaaaccagaagattctcaaaaagctgttctctacaaagtatgatcaatccgagatggaccgggatgcccttcacctgtttgaaacgatcgccaaacaggttgagcagttcttcaagctgtacgacattaatcagtttcgcaccaaaatcagctctgctttcgatgcctttgagaagctcccggtggaaggcgaggaagggaaagtcgagacactgaagcaacttctgatcggactccatgcgaaccctgtgagatccgacctgaaaaatctcggcattaagacccccttcgggtttctgcaggctggcaagggaatccaccttgacgatgacacagaaattatccagcaaagccccgccggcctgttcaaacggagagtgcgcctggccgatctctga

SEQ ID NO: 4221 - RNA, 4086 nt, synthetic construct
  misc_feature 1..4086: note = Cas9 variant
  source 1..4086: mol_type = other RNA
atgaccaagctgggcaaaccctacgggatcggagtggacattggcagcaactccatcgggttcgccgctgtcgatgaaaattctcacctcattagactgaagggaaaaacagttatcggcgcccggctttttgaagaggggaaggcggctgccgaccgcagagccagccggacgacccgcagacggctgtcccgcaacagatggcggctctctttcctgcgcgatttcttcgaaagccatattacacctaccggaccgaactttttcatgagacagaaatattccgagatctctcccaaggacaaggctcggtacaaatatgaaaagcgcctttttaatgatagaacagacgccgagttctaccaacagtatcctaccatgtaccatctgcggaatcgcctcctgacagatcccagcaaagctgacgtgagagagatctattttgccattcaccacatcctgaagtcccggggccatttcctcaccagcggctacgcgaaagattttaacacgaataaggtggccctgaacgaaattttccctgcccttcaggacgcttacgctcaggtctatcccgatctggacatcacctttgatgagaataaggtgaacgaatttaaaacagttctcctgaatgagaaggccaccccttctgacacacaaagagcgcttgtgaacctgctcctggccgaggacggggataaagacattctgaagcagcagaaacaggtcctcaccgagttcgctaaggccgtggttggactgaaaacgaagctgaatgtggctctgggcacagaggtcgattccagcgaagccaccgtgtggaacttttctctcgggcaactggacgataagtgggccggaatcgagtccgctatgacagacgaaggcaccgagattcttgatcagatccgcgacctgtaccgggcgagactcctgaatgggatcgtgccggccggaaaaaccctgagccaggctaaggtcgatgactatgcccagcaccacgaggatctcgaactgttcaaagactaccttaagcaactggaggacgatggcacagccaaagctattcgccagctctatgaccggtacatcgatggcgacgatgccaagccctttgttagagaagacttcgtgaaggcgctgacgaaagaggtgaccgctcatcctaacgccaagtctcccgaacttctggagcgcctcgcccagcctgattttatgctgaaacaacggaacaaggctaatggggccattcccgtccagatgcagcagagagagctggaccaaatcattaaaaaccagtccgtgtattacgattggctcgctgccccgaatcctgttgaaaagcaccgcaagagcatgccctaccagctggacgagcttctgaacttccggatcccttattacgtgggacccctcgtcacagcgaaagaacagaaggccgctcaaggcggggtgtttgcctggatggttagaaaagatcccgacggaaatatcaccccttataacttcgatgagaaggtggaccgcgaggcttccgccaatacatttattcagcggatgaaaaccacggacacatacctgatcggcgaggatgtcctgccgaagcagtctcttctctatcagagatacgaggtgctgaacgaactgaataacgtccgggtgaataacgagaagctcagcattgaacaaaaacagcaggttatccgcgagctgttcgagagacataattccgtgaccattaagcagtttgcggaaaaccttcgggcccacggggactatgctcacatccccgagatcagaggactggccgatgaaaaacgcttcctcagctctctgtccacctaccggcaacttaagagccttctccctgacgctattgatgaccccgccaaacaggccgatatcgagaatattatcgcttggtctacagtctttgaagacgcggccattttcaagaccaaactgaaggagatcaactggctggatagccagacaattacgaagctctccaacatcagataccgcggctggggccaattctctcataaatttctgaatgggcttaccctgggaaacggccacacaatcattcaggaactcttcctgagcaataacaatctgatgcagatccttaccgacgaaacactccagaagaaaatgaccgagctgaacgctgataagctgaaagccgccaatattaacgacgctatcgatgacgcctatacgtcccctagcaataagaaggcgctcagacaagtgctgcgggttattgaagacatcaaacgcgctgccgatgggcaggacccctcttggctttacgtggagaccgccgatggaggcgggacaccgggcaagagaacccgggctcgccagcatcagctgcaagaaatctatgccaacgcggctcacgagctcattgactccgccgtcagaggagagctggaagataaaatcgccgacaaggctgattttaatgaccggctggtgctttacttcatgcagggcgggcgcgatatttatacaggaacccctctcaacatcgaccagctgagctcttacgatattgaccatatcctgccccagtccctcatcaaagacaatagcctggataacagagtgcttgttcacgccattatcaatcgggagaagaacgctacgtttgcctccacaatttatgcgcaaaagatgaacgccacctggcgccagtggcacgaagctggcctgatctctgggagaaaactccggaatctgcagatgagacctgaccaaattgataagtacgccagcggattcgtcgctcgccagctggtggagacacggcagatcatcaaacttaccgaacagattgtggccgcccaataccccgagaccaagatcattgctgtcaaagcgggcctgtcccatcagctcagagaggaactggagtttcctaagaaccgcgacgtgaatcactatcatcacgccttcgatgcttttctcgccgcccggatcgggacatacctgcttaagagattccccaacctgcaggcctttttcacgtatggcaaatttaagaaagctgacgttaagaaactccgcggattcaatttcattcgggatatcacccacgcggaagacaagattgtggtcaaagatacaggcgaggtgatctgggacaagaagagagatgttgacgagctggatcgcatctacaactttaaacggatgctgattacccatgaagtgcacttcgagaaggctgacctttttaaacagacagtctatggggccaaggactctaaagaagccggaggcaagaagcaactgatcagcaaaaagaaagggtacccggtggatatttatggaggctacacccaggagacggggtcctacctcagcgttgtgagactgacaaagaaagctatgtatgccgtcgtgaaggtgtctacccgggacgcggctaagctcgccgtcgccaaatccatcagcgaacagaaggagaatgagaccctgaacgatattatcgacgaaaaactttctaagatctccaaaaatggcaagattacacatgagctgttcgaagttgtgctccctcgcgtgggacagaagaccctgtttaaaaacagcaagtacaatctgttccttgtcaactctgatacatatatgcacaattaccaagagctgtggatgcccagagaatatcagaaaatgtggaaggacatcagcctctccaaatacggcgatgctcagacggaggaccagctggatcaaatttttgggttcatcgtgagccaggttaactcttattttaatctctacgacattaaccagttccggaagaagctgaacgatgccgctgacaaatttgccacccttcccatgcgcgatacagacgacatgcaaggaaagatcgcgaccatcggccagctgctgattgggctccaggccaatgctgccagatccgatctgcggaaccttgacatcaaaacacctctgggactcctgcagattccgaatggcatcagcctcgattccgacacctctgtggtctaccaaagccccacggggctgcttgagagagaagtgcatctgtccgatctgtga

SEQ ID NO: 4222 - RNA, 4086 nt, synthetic construct
  misc_feature 1..4086: note = Cas9 variant
  source 1..4086: mol_type = other RNA
atgaagaaaccctacagcatcggcctggacattgggaccaactccgtgggatggtctgtcgttacagatgactataaggtgcctgccaaaaagatgaaagtgctgggcaatacggataaggagtacatcaagaaaaacctgattggggcccttctgttcgacagcggagaaaccgctgaggcgacaagaatgaagcggaccgctcgcagacggtatacacgcagacggaatcgcatcctctacctgcaggatattttctccccggaacttaaccaagtcgacgagtctttcctgcacagactcgatgacagctttctggtggccgaagataaacggggcgagcgccatgttatcttcgggaatatcgccgacgaggtgaagtatcacaaagaatttcccaccatttaccatctgagaaagcacctcgctgattcctctgagaaggccgacctgcggcttgtctatctggctctcgcccatatcattaaataccgcggacacttcctgatcgatgaacctattgacatcagaaacatgaatagccagaacctttttaaggagttcctgctcgcgtttgacggcattcaggtggattgctacctggcctccaaacacacagacatcagcggcatcattaccgctaagatctctaaatcccggaaggttgaggccgtgctggaacagttccccgatcaaaagaagaatagctttttcgggaacatggtctctctcgtgtttggactgatgcctaatttcaagtccaacttcgagcttgacgaagatgctaaactgcagtttagccgcgactcttatgatgaggacctcgaaaatctgcttggcattatcggggatgagtacgccgacgtgttcgtcgcggccaagaaagtttatgattccattctgctcagcggaatcctgacgaccaacaatcattccacaaaggctcccctgtctgccagcatgatcgacagatacgacgagcacaactccgataaaaagctcctgcgggactttattagaaccaacatcggcaaggaagtgttcaaagaggtgttttatgatacaagcaagaatgggtacgctggatatattgacggcaaaaccaaccaggaagatttctacaagtaccttaaaaatctgctccagaaggtcgacggcggggattattttatcgagaagattgaacgcgaggacttcctgcggaaacaaagaacgtttgataacggatctatccctcatcaggtgcaccttgacgagatgaaggccatcctgcgccggcagggcgaattttacccgtttctcaaagagaatgccgaaaagattcagcaaatcctgacattcaaaattccctattacgttgggcctctggctagaggaaactcccgctttgcgtgggccagctataattctaacgagaagatgaccccctggaatttcgataacgtgatcgacaagacaagctccgctcaggccttcattgaacggatgaccaataacgatctctacctgcctgaccagaaagtccttcccaagcactctctgctctatcaaaaatttgccgtgtacaatgagctgaccaagatcaaatacgttacagagacgggcgaagctagactgttcgacgtgtttcttaagaaagagattttcgatgggctctttaagaaggaacgcaaagtcaccaagaaaaagatcctgaacttcctggacaaaaattttgatgagttccggatcacagacattcagggactcgataacgagaccggcaactttaatgccagctatggcacataccatgacctgcttaagatcattggggataaggagttcatggactccagcgataacgtggacgtcctggaagatatcgtgctctctctgaccctgtttgaagacagagagatgattaaacagcgccttctcaagtatgaagatatcttctccaaaaaggttatcgcgaatctgacgcggagacactacacaggatggggccggctgagcgctaaactcattaacgggatcaaggacaagcattctcgcaaaaccattctggactatcttatcgatgacggacactccaatagaaactttatgcagctgattaatgatgacaacctcagcttcaaggatgagatcgccaattcccaagtgatcggcgacggggatgacctgcatcaggtcgtgcaggagctggccggctctccggctattaaaaagggaatccttcagagcctcaaaattgttgatgaactggtgaaggtcatgggctacaaccctgagcaaatcgtggtggaaatggcccgggagaatcagaccacagctagagggcgcaacaattcccagcagcggctgggatctctcaccaaggccattcaagacttcggcagcgatatcctgaaaagatatcccgttgaaaacaatcagcttcagaacgaccagctgtacctctactatctgcaaaacgggaaggacatgtacacaggagatacgctggacatccacaatctttcccagtatgatattgaccacatcattcctcagagctttatcaaagataactctctcgacaatcgcgtcctgaccaactccaagagcaatagaggcaaatctgataacgtgccctccaatgaggtggtcaagcggatgaaagggttctggctgaagcaactcgacgcgaagctgattagccagcgcaaatttgataaccttacaaaggccgagagaggcggactgtctgctgaagacaaagccggcttcatcaagcggcagctcgtggagacccgccagattacaaaacatgttgctagaatcctggatgaacggtttaatcgcgacttcgataagaacgacaagagaatccggaatgtgaaaattgtcacccttaagagcaacctggtgtccaattttcgcaaagagttcgggttttacaaggttagagaaatcaacaatttccaccatgcccacgacgcgtatctgaacgccgtggtcgctaaagccctcctgattcggtaccccaagctcgagcctgagtttgtgtatggagaatacccgaagtacaacagctatagagagcgcaaatctgctacggaaaagatgttcttctactccaatatcatgaacatgtttaaaaccacaattaagctggccgatggccgggttgtggagaaacccgtcatcgaggccaatgaagagaccggggaaatcgcttgggacaagacaaagcacttcgcgaacgtgaaaaaggtgcttagctatcctcaagtctccattgttaaaaaggtggaggaacagaccggaggcttttctaaagagagcatcctgcccaaagggggctccgataagctcattgccagaaaaacgaagaataactacctgtctacacagaaatatggaggcttcgacagccctaccgtggcttactccatcatgtttgtcgccgatattgagaaggggaaatctaagcgcctgaaaacagtgaaggaaatgatcggaatcaccattatggagcggagcagattcgaatccaatagcgttacctttcttgaggaaaagggctatcgcaacatccgggagaatacaattatcaaattccccaagtactctctgtttgagctcgaaaacgggagacgccggctgctcgcctccgctattgagctgcagaaaggaaatgaaatgttccttccgcaacagtttgtgaacctgctctaccatgcccagcacgcgaataaggaggacagcgtcatctatctggaaaaacatagacacgagctgtctgagcttttccatcacattatcggcgtgtccgaaaagacgatcctgaagcctaaagttgagatgaccctcaacgaggcttttgaaaagcacttcgagttcgatgaagtgagcgagctggcccagtcttttatttccctcctgaaattcacagcctttggggctcccggcggattcaagtttcttgacgccgatatcaaacaaagcaatctgcggtaccagaccgtcacagaagtgctgtccagcaccctcattcatcagtctgttacgggcctgtatgagacacgcatcgaccttagcaagctcgggggagaatga

SEQ ID NO: 4223 - RNA, 4086 nt, synthetic construct
  misc_feature 1..4086: note = Cas9 variant
  source 1..4086: mol_type = other RNA
atgggcaactactatctggggctcgacatcggaaccaatagcgtgggctgggccgtcacagatgagaactacaatattgaaagattcaagaaaaagaacatgtgggggatccggctgtttgacgaggctaaaacggccgaatcccgccggattcacagacaggcgcgcagaatgcggcaacgcaagatccagagacttaatctgctcatggagctgttcgatgttgaaatttctaaagtggacgagagctttttcatccggaagaaggagtccgatcttcattatgaagacaaatctcaggatagccgctacgctctgtttaacgacaaggagttcaatgataaagactatcacaacaagtaccccaccatctttcatctcattatggatctgatcgaaaatgacgagaaaaaggatattagactgctctatctggcctgccactaccttatcaagaaccggggacatttcatttttgagggccagaaattcgacgtcaattcctctctgaacaataacatcaataagctcaaaagccacctggaccaattttacaacatttgtcttgatttcgacaacgataagctgatcgaaatcctcgtgaatcagaacctgaatatttccgagaaaagcaagaaaatcaaggaactgctccgcaagacaaacctggaggtggggattgccaatcttatcgctggaggctctattaaactgtccaacatgtttgacgatgacgaactcaagaatctggattataacagcctttctttcaaaaattccaacttcgacgagggcagagagctgtttgaagaggttctcgaagatcggttcgagctggtggaaatcctgaaggacatccacgatgccagcgtcctcgagaccatgctgtcttccgctagcatttcccctgacgggggaaaatacatctctagctccatgattaatagctataacaagcataagcgcgaccttaaactgctcaagaaaatcattaagaaatacaagaagtctgagtatgataatatctttagagacgaaaacatcaaaaataactacctgtcctatacacggaccggcattaacaagaataaaaaggtgcaggccgaggataacacagacagcgatgggttctacaaatacatcgttaagattcttaaggacatcaaagaaaatgattctgacgaggatattaagtatatcctgagcgaaattgacaaaaagaactttgtgccgaaacagagaaccaaggaaaattccgtcatcccctaccaactccgcgagatcgaactgcggaaaattatcgataaccagtctaagtatcacaagttcctgaatgaggtggacgaaaaaggaattagcgtgaaggagaaaatcatttccctcctgacgtttagaatcccttactatatcggcccccttaaccctagctacaatgaggaaaagaacttcaccacatcttgggtcaaacgcctggcgaaggggaaggttaccccctggaattttgaggatatggtggacattgacgcctcccgggaggctttcatcgagaacaaactcaataagtgcagctttctgctggatgaaacagtgcttcctaaagactctctcctgtatcaggagtacatggtcctgaacgagctcaataacctgaagattaacggacagtccatcaataccgatcttaaaaagagcatttacgaagaactgttcaagaaatataagaaagtgacgagaaagcgcctcatctcctacatcaaagaaaaggagaacatgtctggcgacattgttatcacaggcattgatggggactttaagcaaggactgaaaagctatatcgccttcaaggatattatcggcgaaaagatcgacgatgacatttaccggaaggaggtggagaaaatcattagagatatctccctgtatggggacgataagtctttcattcagaaaaagatcaagaatgaaaacaaacttgacctcagcgacgatcagatttccaagatcgctaaactgaagtttaaagactggggacgcttcagcaagaagctgctcgtcggcatcaaagcctctgataagaataccggggagattgacaacatcattggatttatgcggaattacaactataatatcatgcaactgatggcgaacgtgttcacatttaaagatgaaattgagaaacttaattccaaatactacaccgacgaaaagatcaacatcgattatctggacgatctctacctgagctctccggccaagagaatgctgtggcagtccttccagattgttgacgagatcaaaaatattaagaacagcgatcccaaaaagatctttattgagatggctcgctctaaagaagacaagcctacccggaagatgagcagaaaatcccggcttgagaagctctatacagacagcaaaaagcagttcatcaaactgtttggccccgatgaatacgacaagctgaataacgagatcaagaacaaatctgagtccgatttccgctgggacaatctctatctgtactatacgcaatttggcagatgtatgtacagccttgatcctattgacctggaggagctctccaacaagaatctgtacgatcaggaccatatctatcccaaatctaagatttacgatgacagcatcgaaaaccgggtgctggtcaaaaagcagcttaatctcgataaatccaacgagtatccgattcctgacagagtgctgaataaggataagaacaaactgctcgccttctggaagatgctgaatgaaaaagagcttatcggggacaagaaatacgctcgcctgattcggaagtctccctttaccgacgaggaactcggagatttcatcgccagacagctggtcgagacacgccaagccaccaaggaaacagctaacatgctgaaaagactttgccctgacagcaagatcgtgtatgttaaagcgaagaatgtgtccgatttccggcgcaaatttgacattctgaagtgtagatctatcaacgatctccaccacgcccatgacgcttacctgaatattgtcgtgggcaacgttttcgataccaagtttacgagcaatcccctcaacttcatcaaaaataactccaagaaccggagctataatctggagaaaatttacgactacgatgtgatccgcaacgaaaagatcgcctggcttgccgagagaaaagaggaaaatcaggacgggtctattgctacagtcctgaagaacctctccaagaatgatatccgggtgacccgcagaacctatattaaatgcgaggacctgtttgatgaaaacatcgtgcggaagggaaatggcaaattccccattaaggagaacaataacaaaagcgacacaaataagtacgggggctattctggaatcaaaaacgcctactttgttctgcttgaagacgagaagcacaatcgcatcctggaggcgattccttccttcatctataagaaagaaaagaacggcgagaaagggagcgtcattaattacctccagaacatcctgggaattaagtctgctaaaatcctcagagataagattaagatcggctccctgcttaaaatcgacaagtttccgtataacctggccgggaaaagcggaaatggcattctcatctccgggggcgtgcagctgattctggataagaacaccagcaaatacatcaagaagattgaaaattacaaatataaacttgacgagaacaaggattaccaaatcaatatcttcgacaagctgtctaaagaggaaaacattaagctctttgatctgttcgtggacaagttcgagaatagcatctataaaaaccgggtcaatattaagctcaaagaaatcaagctggccagacccaaatttgagcatctttccattgaggaacagatcaagacactgacgcagatgctgatcctcttcggacgcgagaacaatgctgtgaacctggaatacattggccttcctaaaaataccgggaagacaaagatcaacaaaaagattaataacaaagatatcaagattatcaaccagtctattaccggactgtatgagacagaagaggacctcgccaatatctga

SEQ ID NO: 4224 - RNA, 4086 nt, synthetic construct
  misc_feature 1..4086: note = Cas9 variant
  source 1..4086: mol_type = other RNA
atgaccaagctgaaccagccctacggcatcgggctcgacattggaagcaattccatcggcttcgccgtggtcgatgctaactctcaccttcttagactgaaaggggagacagccattggagcgcggctctttcgcgaaggccaaagcgctgccgagagacgggaatcccgcacgaccagacggcgcctgtctagaacacggtggcgccttagcttcctgagagactttttcgcccctcatatcaccaagattgatccggactttttcctccggcagaaatattccgagatctctcccaaggataaagaccgctttaagtacgaaaagagactgttcaatgatcggacagacgctgagttttatgaggattaccctagcatgtatcaccttcgcctccatctgatgacccacacacataaagccgaccccagagaaatcttccttgctattcaccacatcctgaagtcccgggggcattttctcacccctggagccgcgaaagatttcaacacggacaaggttgatctggaggacatttttcccgcccttaccgaggcttacgcccaggtgtatcctgacctggaactcacattcgatctggctaaagccgacgatttcaaggcgaagctgctcgacgagcaggccaccccgagcgatacacaaaaagctctggtgaatcttctgctctcttccgacggcgaaaaggagatcgtcaaaaagagaaaacaggtgctgaccgaatttgccaaggctattacgggccttaaaacaaagttcaacctggccctcgggaccgaggttgatgaagccgacgctagcaattggcagttttctatgggacagctggatgacaagtggtccaacatcgagacaagcatgaccgatcaaggcaccgagattttcgaacagatccaggagctgtaccgcgcgcggctcctgaatgggatcgtgcccgccggaatgtctctttcccaggctaaagtcgccgactacggccaacacaaggaagacctggagctctttaaaacatatctgaagaaacttaacgatcatgaactggccaagacgattagagggctctacgaccgctatatcaatggagatgacgctaagcctttcctgcgggaggattttgtgaaagccctgaccaaggaggttacagcgcaccccaacgaagtgagcgagcagctcctgaatagaatgggccaggctaacttcatgcttaaacaacgcaccaaggccaatggcgccattcctgtccagctgcagcagcgggaactcgaccaaatcattgctaaccagtccaaatactatgattggctggccaagcccaacccggtggagaagcacagagcttctaaaccttaccagctggacgaacttctcacatttcgcatcccctattacgtggggcctctgatcacccccaaggagcaggccgagagccgggaaaatgtcttcgcgtggatgattagaaaagatccctccggaaacatcacgccttacaattttgacgagaaggttgattgcccggccagcgctaacatgttcattcaacgcatgaaaaatacagacacctatctgatcggcgaagatgtgctccccaagcggtctctgctttaccagaagtatgaggtgctgaacgagctcaataacgtctccattgacgggagacggctgggagccgaccagaaacagcgcctgatcagagaagtgtttgagcggcatagctctgttaccatcaagcaagtggctgaaaatcttgtcgcccacggcgatttcgcgaaaagacctgagattcgcgggctcgccgacgaaaagcggttcctgagctccctgtctacataccatcagctcaaaaagatcctgcacgaggctattgatgaccccaccaaagagcatgatatcgaaaacattatcacatggagcacggtgtttgaggacgccgctattttcaagaccgaacttgccaagatctcctggctggatagcgacacaatcaaagccctctctaatattagatatcgcggatggggccagttttccagaaagctgctggatggccttaaactcgggaacggacacaccgttatccaggagctgatgctgagcaatcacaacctcatgcaaattctgacagacgaaacccttaagacgaccatggctgagctgaatcaggataaactcaaggcggacgatatcgaggacgtgattaacgacgcctacacatctccttccaacaagaaagctctgcggcaggtcctgcgcgtggtcgaagatatcaagcatgccgccaatggccaagaccccagctggctttatatcgagaccgctgatgggccgggaacagccggcaaaagaacccagtcccggcagaagcagattcaaacggtgtacgcgaacgctgcccaggaactcatcgactctgccgttcgcggggagctggaagataaaattgctgacaaggccagcttcacagatagactggtgctctactttatgcagggcggacgggacatctataccggcgcgcctctgaatattgatcagctttcccactacgacatcgatcatatcctgccccaatctctcattaaggacgacagcctggataaccgcgtcctggtgaatgctacaatcaacagagagaaaaataacgttttcgcctccaccctttttgccagcaagatggctgccacctggcggaaatggcacgaggctgggctgatttctggacgcaagctcagaaatctgatgctccggcctgacgaaatcgataaattcgcccacggctttgtggcgagacagctggtcgagacacgccagattatcaagctgacggaacagatcgccgctgcccaatatcccaacaccaagattatcgctgtgaaagccgggctgtcccatcagctccgggaggagctggacttccctaagaatagagatgtgaaccactaccatcacgcctttgacgctttcctggcggcccgcattggaacatatcttctgaaacggtaccccaagctcgctccgtttttcacctatggcgaatttgccaaagttgatgtcaagaaattcagagagttcaattttatcggggccctgacacatgctaagaagaacattgtggccaaagacaccggcgaaatcgtgtgggataaggagcgcgacattcaggaactcgatcggatctacaatttcaaaagaatgctgatcacgcacgaggtctactttgagacagcggaccttttcaagcaaaccatttatgctgccaaagatagcaaggaacgcggaggctctaagcagctgatccctaaaaagcaggggtaccccacccaggtgtatggaggctacacacgggagaacaccgcctatctcgctgttgtgaaaacagtcgaaaagaaagccgacgtgtacagagttgtgcggattgcgacgtcccaagtcgctgccctgaaggaggcccgcgctcagagcaccgtgaaggaaagagagctgcttaaaaagtttctgacaaccaaattcacaaagatcgggaaaaacggaaagaaggccattaccccctttgacatcgttatccctcgggtgccgcgcgagcaactcttccacaataaaagatatggctttttcatggtcaactctgatacgctgatgcataattaccaggaactctggatgagccggtccgaccagcagattctgagcaagctggtgaaatctgctaagaccgtggagaacgggcaggtcggcagactgttcgaaaatatcgttgagcagattaacaaatactttcccctgtatgatatcaatcaattccgcaagaagctcgaccagtccaaagatatttttagcaagctgcctcttgaaggaaacggcacaacctccgggaaacgggagacaatccagaatatcctgaccggagccggcacaggggcgaagaacggagacctcaaaaatctgggcattaagacccccttcgggtttctccaggtgccttctggcatcgtgctggatgacgatacgacacttatttaccaaagccccaccggaatgctgaacagaatcgtccgcctgtccgagctctga

SEQ ID NO: 4225 - RNA, 4086 nt, synthetic construct
  misc_feature 1..4086: note = Cas9 variant
  source 1..4086: mol_type = other RNA
atgaagaacgaggaaaatatctacctgggcctcgacattgggaccgatagcgtgggatatgccgtcacagacgataaatacaagatcatgaaatatcacggcaacgctgcctgggggtccacgattttcgacgcgggagctctgggcgccgatagacgggtttttcgctctgccagacggcgccttgacagacggcaggagcgcatccaactgctccaggaaattttcgctaatgagatcgccaaggtggatgaaagatttttcatccggctgcttgagagcgggctgtggcgcgctgacgccgaggatagatacgtgtttttcaacgacaaagaatataccgatgtccagtacatgcgggactatcccacaattcatcacctcatctgcgagctgatttacaatcctaacaagcatgatgtgcgcctggtttacctcgcgtgtgcctggctggtgacccacagaggacattttctttccaatatcaacacagaaaatattgctgacctggtcgacatccacaacgtgtataatggcttcatgcggtttttcgaggagaacgaaattatctgcgattggcgcgaggttaatgtggaggaactcggcagagtcctggccgctaacatcgggattaatgaaaagtaccggaacctttctaccgtgctgtttgccacaagaaaaccggacaagaaagcgaaggagggattcccctatagcgaggatgccatcgtgcgcctcctggctggcgggacctgtaaactgaaggacgtctacattaaggaagagtatgatgaatttggatccatcacgctcggcatggacgatgagaaaatgaccgaaattatggccgacatcggggatgacttcgatctgatcaaggctctgcggtctctgtacgactgggggattctcgccaacatcctggttaatgagaacaatagccctcttatttcccagagcaaagtgaaggtgtatgagcaacacagagaagacctggccaacctcaaatacctggtccataagtacatcccccacaaatataatgagattttccgcgaaatccggggcgataactacgtggcttattcttaccattatgagctgaagaatgacgaaaagatgggcaaaaaggcggatgttgagaaattttccaagttcctcctgaaaatccttgaggggattagcgtggacgaacaggataaggtcgtgtacgacaacatgatcgagagactgacactccgcctgtttcttcctaagcagaaaaataccgataaccgggttattccccaccagctgtatgaatacgagctcaagtctatcctgaaaaatacaaagaactacctgcctttcctcaaagagaaggactccgatggaattagcaatgaagacaagatcatttctatctttaaattcaagatcccgtattttgtgggccccctgaactgcaattcccaattcgcctggattcagagaaaagctgatgggaagatctttccttggaacttcgaggacaaagtcgattttgacgccagcgaacaggccttcattcagcgcatgaccaaccaatgtacgtaccttcccgaggaatccgtgctgcctaagcagtctctctattaccagaagtttatggtcctgaatgagatcaacaatattaaaatcgacggacggaagatcagcgtggctatgaaacaagagctgtataacgaaattttcgagaagaaaaagagagttcgcaaaaaggatgtgatcgacttctttgtctccaatggctaccttgaagggggaaaggaggccctcattagcggcctggatgaacagatccacacaaacctgtcttccttccatgcgtttcggagactcctgcagaatcacattcttagcgtggaggacgttgagtctatcatcgaacgggctagctattccgatgacaaacgcagagtgcttctcttcctgaagaacaaatactcttttctgaccgatgaggacattaagtacatctgcaaaattaagatcaaggatttcggccggcttagcaaaaagtttctcgtcgacttcgaagggacatgtaaagagaccggagaaatttccaccgtgctgagactgatgtgggagacaaataacaatctcatggagctgcttagcgataagtatacgtttgccaacggcatcaaagaaaatcgcaagaagtactataccgagcagcaaaagacactggacgatcggctcgacgaaatgtacatctctaactccgtgaagagaaccatttatcgcacactgagcgttgtcaaagacgtgaccaaggccttcggggtgcccaaaaagatctttgtcgagatggctagaacgaataacccggatctgaagggaaaacggacacgcaccagacagcaacaggtgattgagctttacgccaagtgcgacgaagaggatgttcgggaactcaaacatcaaatggagtctctgggcgaatatgtggacaacaagctgcagtccgataaactcttcctgtactttatccagttcggaaagagcgcttactccggcaaaatgattgaccttgagaagctgatgtctggaagcaaggtctatgatatcgagcacatttaccctcaggcctatgtgaaagacgattccatcatcaataacaaggttctcgtgttctctgaagagaatggcgcgaaacaagacatttaccccatcaagaccgaaattcgcaaacagatgagcgggatctggacaacctggcatcacgtcggagccatttccgatgagaagtataagagactgacacggagcacgccttttaacgaagacgagaaatacggcttcatcaatcgccagctgaccgagacatctcagtccaccaaggctatcgcccaaattcttaacgaaaaatatcccgagacagaaatcgtgtacgttaaggctgggctcgtgagcgactttagacacgagttcggactgtgtaaatgccggtcttacaatgatctgcatcacgccattgacgcgtatctcaacgtcgtggtgggcaatgtctacaacatgaagtttaatcgcaagtggttctccgttgatagcaaatattctatcaagaccaaaacgatttttagccattccctggtgtgtaacgggaagatcatctgggacaaagaaaagatgcttcccatggtgctgaagaatgccaaaaagaacaatgctcacttcaccaaataccagtttatgaagacaggcggattctttgatcagatgccttgcaaaaaggccagcggcctcgtcccgagaaagaaagggctggacaccgagcggtatggaggctacaacaagtctgggattatgttcctgacacccatgagatataaaatcggaaagaaatccgatattatcattcttagcatcgagctgctctacggcaagctgttcctcaaagacgaagtgtttgctaagaagtacgccgaggaacgcctgcagaaaattatcgggaagaaagccgatgaggtttccttccctatgggcatgaagccctggaaaatcaacaccgtgctttctctggacggatttaatgtctgcattacgggcatcgggggaggcgggaagtgtctcagcgctcagcctattatgcagctgtccctgccctatgagcttgcgaagtacctgaaaaagatcgaaaaattcgtggagaagaacaaaaataacgccaattatatttacgatgaacagtatgactctgttagcgtggatgagaacatcaagctctacgacgtctatctggacaagctcgaaaattccatctacaacaaacggattaattctccggaggctatcctgaagaacggaagagagaaattttgcaaacttaatgtgctggaacaagccgttacactcattaacatccagagcattttcggccgcatgaccgggggctgtgatctggagaatatcggaggcaaaaagcactccgccgctacagtgaactttagctctaatgtctccaactggaagaaatactataatgacgtgcgggtggtctaccagagcccttctgggatctgggaaagacgctcccagaacattctggagcttctgtga

SEQ ID NO: 4226 - RNA, 4086 nt, synthetic construct
  misc_feature 1..4086: note = Cas9 variant
  source 1..4086: mol_type = other RNA
atgaacgagccctacggcgtggggctggacatcggaaccaatagcgtcggctggacagttgtggatatgaacgggagagtgcggaaggtcaaaggaaagacggccctcggcgctcgcctgttcaaagaaggggccaccgcggaggacagacggggatttcgcacaaccagacggcgccttaagagagtgaaatggcggctgcgcctcctgagagagttctttgatcagcctatttccaagatcgacccgaatttctttgctcggcgcaagtattctgatattagccccagagaccctaactacaatggccttgccaaaacactgttcaacgatcggaccgacaaggaattttatgatgactacgccacaatctatcacctccgcgataaactgatgacctccaatagaaagttcgacattcgggaaatctacctggctatccatcacattgttaaatatagaggcaactttctccgcacggggcccgcctctcaatacggaagcgcttccctgcatcttgccacctctttccagaagctgaatgatctctttgcgcagagcgaggagacactgaaccttaagctggtgaccgacgaagccctcctgcagcaaatccagcagattctggtccggacagacctctccagaagcgagcagcaacgccagatctggcctctgatggctgtgcttaccggcgcctctgctgccgaaaagaagcggcagaaaaatgttgtggtcgagctgtccaaggcgctcgtggggctgaaagccaagatgaacgtggtcacgcttacagaggttgatgctgccgtggtgaaagactggaccttcacaatggaagagagccaggataagctgcccgaaattgaggaacaactctctgaggtcggacagcagatcatggacgaggtgattcaactgtacgcttccgttaatctggcccagctcatccctgccggcaagagatttagccagcacatggtggaaaaatataagcatcacgagaaaaacctggaacttctgaaggcttacatccactctcagtccgatagcaaacgcgggcgggagattagagcgacctatgaccgctacatcgatggagtcgactccaagccggtgacccaagaaatgttctataaggatctcatgaaatacgttgaggccgacgctacatctaatcatctggccgccgagattaaggatgaaatcgacagcgagcagttcatgcccaaacttcggacgaagcagaacggctccattccttatcaggtgcaacagtacgaactggaccagatcatcagccaccagaaaaagtactatccctggctcggcgaggaaaaccctgtcgctgagagacgcgggaagtttccctacaaactggatgagctggtgggattccgggtcccgtattacgtgggccctctcattaccaaggaagaccaacaggccacatctggggcgggatttgcttggatggttagaaaagccgatggccccatcaccccttggaatttcgaccagaaggtggatcggattgcctccgctacagcctttatccagcgcatgcaaaccacggacacatatctgattggggaggatgtccttcccgctagaagcctgatctaccagcggttcatggtgctcaacgaactgaataacatgagagttgaggaccgcaaactggcgccccagcaaaagcagcggctttataatcaggtgtttaagcagcatcaacacgtctctgtgaaaaacatccagcagaatctcatggatgccggagagtacagaaagacccctcagattaccggcctggccgacccgaaaggcttcaacagctccctgtctacataccacgattttaagaaaatcctcctggaagctattgccgacgagcataagcgcgctgatatcgagaaaattatcctttggagcaccacattcgaagactccgccatttttaagcaaaagctggaagaggtggcgtggctcacggacgcccagagaaaacagctgagcgggctgcggtatcgcggatggggccagctttctcacaagctcctgaccgctttcaaagatgacaaggggagatccatcatggatggactgtgggagacaagcgacaattttatgcaactccggaaacagcccgccatcgaaacccagattaaggaggctaaccaagccaatctgacagatgccgacatccaggataccattaacgaactttacacgtctcctcagaataagaaagctatccgcgaggttatgctggtcctcgacgatattaagaacgcgatgcatggccagaccccctcctggatcttcgtggaagccgctagagggggcggagtggccggccggcgcacacaaagcagatcctctcagatcgtcgaggcctataaagggaccgctaaggagattgtgagcgaaaaagttcagcacgagctgaatgaaaagatcaaggccaaagcggacttcaacacacggctggtgctttactttctccagaacggacgcgatctgtataccaatgaggctattaacatcgacagactgtccgaatacgatattgaccatatcctccctcaatctctggtcaaggacgatagccttgacaatcgggtgctgacgtccgccagaatcaaccgcgagaaaaatgatacattcgccagcgagaagtttggccggaaaatgggggctcagtggagagaactccaccgcaacggactgatgacccagcggaagctgaagcaccttctcatgagacccgacgagatttctaaacatgccacagatttcatcaatcgccagctggttgaaacccggcaagtgattaagctggtcgaggagctcatctccagcgaatatccggcggcttctattgtggccgttaaagccaacctgacccaccagtttagacagacattcaattttcctaaacttcgcgaggtgaacgactaccatcacgctttcgatgcctccctgacggcttttatcggcatgtacctcctgaaacagtatcccaagctggaacggttctttgtctacgggaaattcgccaagcaacctatcaatcttaccagatttaacattatccggaagctggcggtggccgagaaacccattgctaatatcgaaacaggcgagattctctgggacaagaccgccgatatcaaatatttcgagaagctgtacaactataaacgcctcctggtgacacacgaagtcagagagaattacggagctatgttcaagcagaccctttttaaggccagctataacaaatctaagacgctggttcctaaaaagaaccatatggaaacaagcgtgtacggcgggtactccaatcaggagaccgcctatctcgctattgtgcggatccccttcaaaagcggatttaagttcatcgtcgtgggcattccgacccgcatggttgcgaagatcaaacactaccaatctctgggggccacactgaaccaggctacccataaggtgattgaacctaaatttacaaagatctccagaaaaacgaagcagaccgtcattagcgactatgaggtggttcttcccaaggtgtacctggatcaggtcgtgcgggaccaagttaaaggacagatgtatagattctccctcggctctgacaaggagtaccacaatgtgcaggaactgtatctccccctgagcatccagcaagcctttgtcgggcattacgatgagtccgacgatcagcgctctaacgaccttgtgaaagtgtacgatgccgctctgaagcagctccagcggtatttccctctgcacctgagcagaaattttgaccaagtcgcctcccaggcgcaccagtctttcgaaggccttaaaaacaatgttcaaacaagcgataagcagctgggaaagaaagaggtgctcaactccctgtttgtgggcctccatgctaatgccacccgcagcaacctgtctgtccttgggatgtccaaggacttcggacggatcaaaagcaatggcattacactgaccgatcaggccgaaatcatttaccagtctccgacggggctgttcgagagaaaggtggctctcaaagacctgtga

SEQ ID NO: 4227 - RNA, 4086 nt, synthetic construct
  misc_feature 1..4086: note = Cas9 variant
  source 1..4086: mol_type = other RNA
atgggcaactactatctggggctcgacatcggaaccaatagcgtgggctgggccgtcacagatgagaactacaatattgaaagattcaagaaaaagaacatgtgggggatccggctgtttgacgaggctaaaacggccgaatcccgccggattcaccggcaggcgcgcagaatgcggcaacgcaagatccagagacttaatctgctcatggagctgttcgatgttgaaatttctaaagtggacgagagctttttcatccggaagaaggagtccgatcttcattatgaagacaaatctcaggatagccgctacgctctgtttaacgacaaggagttcaatgataaagactatcacaacaagtaccccaccatctttcatctcattatggatctgatcgaaaatgacgagaaaaaggatattagactgctctatctggcctgccactaccttatcaagaaccggggacatttcatttttgagggccagaaattcgacgtcaattcctctctgaacaataacatcaataagctcaaaagccacctggaccaattttacaacatttgtcttgatttcgacaacgataagctgatcgaaatcctcgtgaatcagaacctgaatatttccgagaaaagcaagaaaatcaaggaactgctccgcaagacaaacctggaggtggggattgccaatcttatcgctggaggctctattaaactgtccaacatgtttgacgatgacgaactcaagaatttcgattataacagcctgtctttcaaaaattccaactttgacgagggcagagagcttttcgaagaggttctggaagatcggtttgagctcgtggaaatcctgaaggacatccacgatgccagcgtcctggagaccatgctctcttccgctagcatttcccctgacgggggaaaatacatctctagctccatgattaatagctataacaagcataagcgcgacctgaaacttctgaagaaaatcattaagaaatacaagaagtctgagtatgataatatcttcagagacgaaaacatcaaaaataactacctctcctatacacggaccggcattaacaagaataaaaaggtgcaggccaaagataacacagacagcgatgggttttacaagtacatcgttaagattctgaaagacatcaaggagaatgattctgacgaagatattaaatatatccttagcgagattgacaagaaaaacttcgtgccgaagcagagaaccaaagaaaattccgtcatcccctaccaactgcgcgagatcgagctccggaagattatcgataaccagtctaagtatcacaaatttctgaatgaagtggacgagaagggaattagcgtgaaagaaaagatcattgcgctgctcacgttcagaatcccttactatatcggccccctgaacccttcctacaatgaggagaaaaactttaccacaagctgggtcaagcgccttgccaaggggaaagttaccccctggaatttcgaagatatggtggacattgacgcttctcgggaggcctttatcgaaaacaagctgaataaatgctccttcctcctggatgagacagtgctgcctaaggacagccttctctatcaggaatacatggtcctgaacgagctgaataacctcaaaattaacggacagtctatcaataccgatctgaagaagtccatttacgaggaactttttaaaaagtataaaaaggtgacgagaaaacgcctgatcagctacatcaaggagaaggaaaacacatccggcgacattgttatcaccggcattgatggggacttcaaacaaggactcaagtcttatatcgctttcaaagagattatcggcgaaaagatcgataatgacatttaccggaaagaggtggagaagatcattagagatatcagcctgtatggggacgataaatcctttattcagaagaagatcaaaaacgaaaataagctggacctttctgataaccagattagcaaaatcgccaagctcaaattcaaggactggggacgcttttccaagaaactgctggtcggcatcaaggcgagcgacaaaaatacaggggagattgataacatcattggattcatgcggaattacaactataatatcatgcaactcatggccaacgtgtttaccttcaaggacgaaattgagaaacttaattctaagtactacacctatgaaaagatcaacgttgattaccttgacgatctgtatctctccgctccggccaaaagaatgctgtggcagagctttcagatcgtggacgagattaagaatatcaaaaactctgctcccaagaaaattttcatcgagatggcccgctccaaggaagataagcctacacggaaaatgagcagaaagtctcggctggagaaactttacacggacagcaagaaacagtttattaaactcttcggccccgatgaatatgacaagctgaacaatgagatcaagaacaagtccgagagcgattttcgctgggacaatctgtacctctattacacccaattcggcagatgtatgtactctctggaccctatcgatcttgaagaactgtccaacaaaaatctctatgaccaggatcatatttaccccaagagcaaaatctatgacgattccattgaaaaccgggtcctggtgaagaaacagctgaatcttgacaagtctaacgagtacccgatccctgatagagtcctcaataaggacaaaaacaagctgctggccttttggaaaatgctcaatgaaaaggagctgattggggataaaaagtatgctcgccttatcagaaagagccccttcacagacgaggaactgggagatttcattgcgagacagctcgtggagacccgccaagccacaaaagaaaccgctaacatgctgagacggctgtgccctgactccaagatcgtttacgtgaaagccaagaatgtctctgattttcgcagaaaattcgacatccttaagtgtcggagcattaacgacctgcaccacgcccatgatgcttatctcaatatcgtggttggcaacgtgtttgacacgaagttcacatccaatcccctgaactttattaaaaacaattctaagaaccgcagctacaatctcgagaaaatctacgattatgacgtcattagaaacgaaaagatcgcctggctggcggagcggaaagaggaaaatcaggatgggtccatcgctaccgtgcttaagaacctgagcaagaatgacattcgcgtgaccagacggacatacatcaaatgcgaggatctcttcgacgaaaacattgttcgcaagggaaatggcaaatttcccctgaaggagaacaataacaaatctgataccaataagtatgggggctactccggaatcaaaaacgcctatttcgtcctgcttgaagacgagaagcacaatagaattatcgaggccatccctagctttatttacaagaaagaaaagaacggcgagaaagggtctgtgatcaactatctgcagaatattctcggaatcaagtccgctaaaattctgcgggataagatcaagattggcagcctcctgaaaatcgacaagttcccgtacaaccttgccgggaaatctggaaatggcatcctgatttccgggggcgtgcagctcatcctggataagaacacaagcaaatacattaagaagatcgaaaattataaatacaagctggacgagaacaaagactatcaaattaatatctttgataagctgtccaaagaggaaaacatcaagctgttcgacctcttcgtcgataagtttgagaatagcatttacaaaaacagagtgaatatcaagctgaaagaaattaagctcgctcgctctaaattcgagcatctgagcatcgaggagcagattaagacgcttacccagatgctgatcctgtttggacgggagaacaatgccgttaacctcgaatatatcggcctgcccaaaaatacagggaagaccaagattaacaaaaagatcaacaataaagacattaagatcattaaccagtccatcacaggactttacgagaccgaagaggatctggcgaatatttga

SEQ ID NO: 4228 - RNA, 4089 nt, synthetic construct
  misc_feature 1..4089: note = Cas9 variant
  source 1..4089: mol_type = other RNA
atgaagaaaccctacagcatcggcctggacattgggaccaactccgtgggatgggccgtcatcacagaggattataaggttcctgctaaaaagatgaaagtgctcggcaatacgtctagagacttcattaagaagaacctgcttggggccctgctctttgatagcggagaaaccgcggaggctcggcgcctgaaaagaacagcccggcgcagatacacccggcgcagaaatcggcttcgctatctgcaggaaatcttcctcgacgagatgaacaagctggattccggctttttccacagactggacgattcttttctcgtgccggaagagaaacgggggagccgctaccccattttcggaacactgcaagaggaagtcaattatcatgagaactttcctaccatctaccaccttagaaagaaactggccgactccaaggaaaaggctgatctccggctgatctatcttgccctggctcatatgattaaataccgcggccacttcctctacgaggagtcttttgacagcaataacaattccatccaggaaattttcaacgagtttacagccgaatatcataataccatcgagggcagctgcctgtctgggcagattgaacaggtggaggcgatcctgacggataagatttccaaaagcgccaagagagagcggatcctcaaactgttccccgctgaaaagtctaccggacttttctccgagttcctgaaactcatcgttggcaaccaagccgacttcaagaagcactttgatctggaagagaaaacacctcttcagttcagcaaggacacctacgaagaggacctggagaatctcctggaacagattggggatgagtttgctgacctgttcctcctggccaaaaagctgtatgatgcgacactgctcgccggaatcctgaccgctacggacgtgtctacaaaagctcccctttccgccagcatgattaacagatacgaaacccaccagcaagatctggccgccctcaagcagtttatcaagaataaactgcctgagaagtattccgaagtcttctctgacctgagcaaagatggctacgctgggtatattaacggaaagacaacccaggaggcgttttacaaatacatcaagaacctcctgatcaagttcgagggcgccgtggactttcttgagaaaattgagcgcgaagatttcctgcggaagcagagaacctttgacaatggctccatcccgcatcaactccaccttcaggagatgaacgctattctgcgccggcagggggatcattatcccttccttaaagagaatagagaaaagatcgagaaaattctcacatttcgcatcccttactatgttggacccctggcccggggcaacagagacttcgcctggctgacgcgcaatagcgaccaagctatccggccttggaacttcgaagaggtggtcgataagacctcttccgccgaagactttattaataagatgacaaactacgatctctatctgcccgaggagaaagtgcttccgaagcacagcatcctgtacgaaaccttcgcggtgtataatgagctcacaaaagtcaagtttattgctgaagggctgagagactaccagttcctggattctggacagaaaaagcagatcattaaccttctctttaaagacaagcgcaaggttaccgagaaagatatcattcactacctgcatacggtggacggctatgatgggatcgaactgaagggaatcgacaaacaattcaatgccagcctctccacataccacgatctgcttaagattatcaaagacaaggattttatggacgacgccgataacgaggctattctggagaatatcgtgcataccctcaccattttcgaagaccaggagatgatcaagcagtctctggcccagtatgatgctatctttgaccggaaagtcatgaaggccctgacaagacggcactacaccggctggggcgaacttagcgcgaaactcattaacgggatccgcgataagcaaacaggaaaaatgattctggagtatctgaaggacgatggcgaaatcaatagaaacttcatgcagctcattaacgacgattccctgagctttaaggagacgatccagaaagcccaggtgatcggggagaccgaaaatattaagcaaatcgttcaggagcttcctggatctcccgctattaaaaagggcatcctgcagtccattaaaatcgtggacgaactcgtcgagatcatggggtacaaccctgagagcattgtggttgaaatggcccgggagaatcagttcacaaaccaaggcagacgcaattctcagcagcggctgaagaagctgaccgattccatcaacaaacttggaagctccattctcgaagaacatcccgtggacaattctcaactgcagaacgatagactgtttctctattacctgcagaatggcaaggacatgtacacaggggaagctcttgagctgagcaaactctcctcttatgacgtcgatcacatcattccccaggccttcatcaaggacgatagcctggacaaccgcgtgctggtctcctacgcgaaaaatagaggaaagagcgatgacgtgccttctcttgagattgttcaaaaacggaaggccttctggcgccagctgctcgattcccagctgatcagcgaaagaaagtttaacaatctcaccaaagctgagcggggcgggctgacggaagacgataaggccggattcatcaaacgccagcttgtggagaccagacaaattacaaagcacgtcgctcagatcctggacgcccggtttaacaccgaagtgacagagaaaggcaagaagaaacgcgccgttaagattatcaccctcaaatctaatctggtgtccaacttcagaaaggattttgagctgtataaagtccgggaaattaacgactaccatcacgctcatgacgcgtatcttaatgccgtggtggggacggctctgctcaagaagtacccgaaactggagcccgaatttgtttatggcgattaccctaagtacaacagctatcgcgagagaaaaacagccaccgaaaaggtctacttttattctaatatcatgaacttctttaaaacaaccgtgaagctcgccgacggaagcgagaagaaacggcaccagatcgagaccaatgaagagacaggcgaaattgtgtgggataagacgaaacacttcgagatcgtcagaaaggtgctgtcctacccccaggttaacattgtgaaaaagaccgaggaacaaacagtcgggcagaatggaggcctttttgacaacaatatcgtgagcaagaacaaagttgtggatgcttctaagctgattcctatcaaatccgggctcagccccgagaagtatggaggctacgcccgcccgaccatcgcgtattccgtcctggtgattgctgacatcgaaaaagggaaggccaaaaagctgaagcggattaaagagatggttggcatcacaattcaggataagaaaaagttcgaagccaatcctatcgcttaccttgaggagtgtggattcaaaaacattaattctaaccatatcatcaagctgcccaagtacagcctctttgagttcgacgatggccaaagacgcctgctcgcctcctctattgaactgcagaaagggaatgaacttatcctgccttatcacctgaccgcgctcctgtaccatgctcagcggattaacaagatcagcgagcccattcacaaacagtatgtggaagcccatcaaaacgagtttgaggaacttctgacgacaatcatctccctctctaagaaatacattcagaagcctaatgtcgagagcctgctccagcaggccttcgaccaaaccgatgaagacatctatcagctgtccgagagctttatttctcttctgaagctgatctccttcggagctcccggcgcctttaaattcctcggggtggatattagccagtctaacgtgagataccagtccgtcagctcttgctttaatgctaccctgatccaccaatccatcacaggactttatgaaacccgcattgacctgagcaagctcggcgaggactga

SEQ ID NO: 4229 - RNA, 4089 nt, synthetic construct
  misc_feature 1..4089: note = Cas9 variant
  source 1..4089: mol_type = other RNA
atgaacgagccctacggcgtggggctggacatcggaaccaatagcgtcggctggacagttgtggatatgaacgggagagtgcggaaggtcaaaggaaagacggccctcggcgctcgcctgttcaaagaaggggccaccgcggaggacagacggggatttcgcacaaccagacggcgccttaagagagtgaaatggcggctgcgcctcctgagagagttctttgatcagcctatttccaagatcgacccgaatttctttgctcggcgcaagtattctgatattagccccagagaccctaactacaatggccttgccaaaacactgttcaacgatcggaccgacaaggaattttatgatgactacgccacaatctatcacctccgcgataaactgatgacctccaatagaaagttcgacattcgggaaatctacctggctatccatcacattgttaaatatagaggcaactttctccgcacggggcccgcctctcaatacggaagcgcttccctgcatcttgccacctctttccagaagctgaatgatctctttgcgcagagcgaggagacactgaaccttaagctggtgaccgacgaagccctcctgcagcaaatccagcagattctggtccggacagacctctccagaagcgagcagcaacgccagatctggcctctgatggctgtgcttaccggcgcctctgctgccgaaaagaagcggcagaaaaatgttgtggtcgagctgtccaaggcgctcgtggggctgaaagccaagatgaacgtggtcacgcttacagaggttgatgctgccgtggtgaaagactggaccttcacaatggaagagagccaggataagctgcccgaaattgaggaacaactctctgaggtcggacagcagatcatggacgaggtgattcaactgtacgcttccgttaatctggcccagctcatccctgccggcaagagatttagccagcacatggtggaaaaatataagcatcacgagaaaaacctggaacttctgaagacctacatccactctcagtccgatagcaaacgcgggcgggagattagagctacctatgaccgctacatcgatggagtcgactccaagccggtgacacaagaaatgttctataaggatctcatgaaatacgttgaggcggacgccacgtctaatcatctggctgccgagattaaggatgaaatcgacagcgagcagttcatgcccaaacttcggaccaagcagaacggctccattccttatcaggtgcaacagtacgaactggaccagatcatcagccaccagaaaaagtactatccctggctcggcgaggaaaaccctgtcgccgagagacgcgggaagtttccctacaaactggatgagctggtgggattccgggtcccgtattacgtgggccctctcattacaaaggaagaccaacaggctacctctggggccggatttgcgtggatggttagaaaagctgatggccccatcacaccttggaatttcgaccagaaggtggatcggattgcctccgccaccgcttttatccagcgcatgcaaacgacagacacctatctgattggggaggatgtccttcccgccagaagcctgatctaccagcggttcatggtgctcaacgaactgaataacatgagagttgaggaccgcaaactggctccccagcaaaagcagcggctttataatcaggtgtttaagcagcatcaacacgtctctgtgaaaaacatccagcagaatctcatggatgccggagagtacagagaagcgcctaagattaccggcctggccgacccgaaaggcttcaacagctccctgtctacataccacgattttaagaaaatcctccccgaggctattgccgacgaacataagcgcgctgatatcgagaaaattatcctgtggagcaccacattcgaagactccgccatttttaagcagaagctggaggaggtggcgtggctgacggacgcccaaagaaaacagctcagcgggctgcggtatcgcggatggggccagctgtctcacaaacttctcatcgctttcaaagatgacaatgggagatccatcatggatggactgtgggaaaccagcgacaactttatgcagctgcggaagcaacctgccattgagacacagatcaaagaagctaatcaggccaacctcaccgatgccgacattcaagatacaatcaatgagctgtacacctctccccagaacaagaaggctattcgcgaagttatgcttgtcctggacgatatcaaaaatgcgatgcatggccagacgccttcctggatcttcgtggaggccgctagagggggcggagtggccggccggcgcacccagagcagatcctctcaaattgtcgaggcctataaggggacagctaaagaaatcgtgagcgagaaggttcagcacgaactcaacgagaaaattaaggccaaggcggacttcaacacccggctggtgctgtactttcttcagaatggacgcgatctctatacaaacgaagctatcaatattgacagactgtccgagtacgatatcgaccatatcctgccccagtctctcgtcaaagacgatagcctggacaaccgggtgcttacctccgccagaattaatcgcgagaagaacgatacgttcgccagcgaaaaatttggccggaagatgggggctcaatggagagagctgcaccgcaatggactcatgacacagcggaaactgaagcaccttcttatgagaccggacgaaatctctaagcatgccaccgatttcattaaccgccagctcgttgagacaagacaggtgatcaaactggtcgaggaactgatttccagcgagtatcctgcggcttctatcgtggccgttaaggccaatctcacccaccaatttcggcagaccttcaactttcccaaactgcgcgaagtgaatgactaccatcacgctttcgatgcctcccttacagcttttatcggcatgtacctgctcaagcagtatcctaaactggagcggttctttgtctacgggaagttcgccaaacagcccattaacctgacgagatttaatatcattcggaaacttgcggtggccgaaaagcctatcgctaacattgagaccggcgagatcctgtgggacaaaacagccgatattaagtatttcgaaaaactctacaattataagcgcctgctcgtgacccacgaggtcagagaaaactacggagctatgttcaaacaaacactgtttaaggccagcgacaacaagtctaaaacccttgttcccaagaaaaatcatatggagacgagcgtgtatggcgggtactccaaccaggaaacagcctacctggctatcgtgcggatcccgttcaagagcggatttaaattcattgtcgtgggcatccctacccgcatggttgcgaagattaagcactatcagtctctcggggccaccctgaaacaagctacacataaggtgatcgagcccaaatttaccaagatttccagaaaaacaaagcagacggtcatcagcgattacgaggtggttctgcccaaggtgtatcttgaccaggtcgtgcgggaccaggttaaaggacaaatgtacagattctccctgggctctgataaggaatatcacaatgtgcaggagctctacctgcctctcagcatccagcaggcctttgtcgggcattatgacgaatccgatgaccaacgctctaacgatctggtgaaagtgtacgacgccgctcttaagcagctgcagcggtacttcccgctccacctgagcagaaattttgatcaggtcgccaaccaagcgcaccagtccttcgagggcctgaaaaataacgttcagaagtctgacaagcaacttggaaagaaggaagtgctgaatagcctctttgtgggcctgcatgctaccgccacacgctccaacctcagcgtcctggggatgtctaaagatttcggacggcttcagtccagaagcggcattaccctgacagaccaggccgagatcatttatcagtctcccaccgggctgttcgagcgcaaggtggctctcaaagatctgtga

SEQ ID NO: 4230 - RNA, 4089 nt, synthetic construct
  misc_feature 1..4089: note = Cas9 variant
  source 1..4089: mol_type = other RNA
atgaccaagctgggcaaaccctacgggatcggagtggacattggcagcaactccatcgggttcgccgctgtcgatgaaaattctcacctcattagactgaagggaaaaacagttatcggcgcccggctttttgaagaggggaaggcggctgccaaacgcagagccggacggacgacccgcagacggctgagccgcaacagatggcggctctccttcctgcgcgactttttcgaatctcatattacacctaccgatccgaactttttcatgagacagaagtatagcgagatctcccccaaggacaaagctcggtacaagtatgaaaaacgcctttttaatgatagaacagacgccgagttctaccaacagtattctaccatgtaccaccttcggaatcgcctcatgacagatcctagcagagctgacgtgcgggagatctattttgccattcatcacatcctgaagtccagaggccatttcctgacccccggcgatgcgaaagactttaacacgaatgatgtggccctcgacgaaattttccctgctctgcaggatgcctacgctcaggtctaccccgaccttgggatcacctttgacgaggataaggccaacgagttcaagacaattctgctcaatgagatcgcgaccagcattgacacacaacgcgccctggtgaaacttctgctcgctgaggaagatgacaaggatatcctgaaacagcagaagcaggttctgaccgagttcgccaaagctgtggtcggactcaagacgaaactgaaccttgccctgggcacagaagtggactcttccgaggccaccgcttggaattttagcctcgggcaactggatgacaagtgggcgggaatcgaatctgccatgacagatgagggcaccgagattcttgaccagatccgggatctgtatagagctcgcctcctgaacgggattgttcctaccggaaagacactgtcccaggccaaagtggacgactacacgcagcaccacgaagatctccaactgttcaaggcctatcttaaacagctggaggacgatggcaccgctaaggccatccggcagctctacgacagatatattgatggcgacgatgcggctccgtttctgcgcgaaaatttcgtcaaagcccttacaaaggacgtgaccgcccatcccaacacaaagagccctgagctgctcgaacggctggctcaacccgattttatgctgaaacagagaaataaggccaacggggctatccctgtgcagatgcagcaacgcgagctcgaccagatcattaaaaaccaggccgtctactatgattggctggcggcccccaatccggttgagaagcaccggaaatctatgccttaccagcttgacgaactgctcaacttcagaatcccctactatgtgggacctctggtgaccgctaaggagcaaaaggccgctcagggcggggtctttgcctggatggtgcgcaaagatcccgaaggaaatattacgccctacaacttcgacgagaaggttgaccgggaagcgtccgccaatacatttatccagagaatgaaaaccaccgatacatatctgattggcgaggacgtgcttcctaagcagagcctcctgtaccaacggtatgaggtcctgaacgaactcaataacgtgcgcgttaataacgagaaactgtccatcgaacagaagcaacaggtgatcagagagcttttcgagcggcataattctgtcaccattaagcaatttgctgaaaacctgagagcccacggggattacgctcacatcccggagattcgcggactcgccgacgaaaaacggttcctgagctccctgagcacatatagacagcttaagtctctcctgcccgaggccatcgatgaccctgctaaacaggcggatattgaaaatatcattgcctggtccacggtgtttgaggacgctgccatcttcaagaccaaactgaaggagatcagctggctcggctctgaagccattacaaaactgagcaacatccgctacagaggctgggggcaattctcccggaagtttcttaatggactgaccctcggcaacgggcatacaattatccaggagctgctgctttctaccaacaatctcatgcagattctgacggatgaaaccctgcagaagaaaatgacagagctcaacgctgacaagctgaaaaccgccaatatcaacgatgcgatcgacaatgcttacacaagcccctccaacaagaaagcccttcgccaagtcctgagagtggttgatgacattaagcgggccgctgacggacaggatcctagctggctctatgtggaaaccgccgacggcgggggcacgcccggaaagcgcacaagagcgcggcagcaccagctgcaagagatctacgctaatgccgcccatgagctgattgataccgctgtccgcggcgaacttgaggacaaaatctctgataaggccgacttcaacgatagactcgtgctgtattttatgcaagggggacgggacatttacacaggcgctccgctgaatatcgatcagctctccagctatgacatcgatcacattctgcctcagtctcttatcaaagacaactccctggacaatcgcgttctcgtgcatgccattatcaacagagaaaagaatgcgaccttcgccagcaccatttacgctcagaaaatgaacgccacatggcggcagtggcacgaggctgggctgatctccggaagaaagctgcgcaatcttcagatgcggcccgatcagatcgacaagtatgcctctggctttgtcgccagacagctggtggaaacgcgccagattatcaaactcaccgagcagattgtggctgcgcaataccctgatacaaagatcattgccgttaaagctgggctgagccaccagctccgggaggaactggagttccccaagaacagagacgtcaaccattaccaccatgcctttgatgccttccttgctgcccgcatcggcacctatctgctcaaacggtttcctaatctgcaggcgttctttacatacggaaagttcaccaaggctgacgtgaaaaagctgagaggctttaacttcattcgcgatatcacgcacgccgaagacaaaatcgtggccaaggatacaggggaggtcgtgtgggacaaacagcgggatgttgacgagcttgatagaatttataatttcaagcggatgctgatcacccacgaagtgcgctttgagaccgctgacctcttcaaacaaacagtctacggagccagagactccaaggaagcgggcgggtctaagcagctgattcccaaaaagaaaggatatccggtggatatctacggcgggtattttcgggagaacaccgcttacctcgccgttgtgaaggtcacgaaaaagacagaaaccattttcaaggtggttaaaatcgccacaagccaggtggctgccctgaataaggctcgctccagaagcaccgccgaggagctttctgtcctgacagaactcctgaaacctaagttttccaaagtgggcaagaacggaaagatcaccgacacgcccttcgaggtggtcctgccccgggttcctagagaacagctgttttacaatgcgaaatatggcttctttatggtgaacagcgataccatgttccataattttcaagagatttgggtgtctcgctccgaccagaagatcctgcagcagattcggaaagccaagatcgattacccgaacgtcgaccaagatctcgacaatctgttccacaacctcgctgatcagattgtgaaatatttcgacctgtacagcatcgccgggtttaaggaaaagatctctcagagccaaaatacattcaacgatcttgctgttgacgataccgaccagtccgtgggaaaaattacagtcatcaatgagctgctgaagggcgcccaggccaacgggatgaccggaagcctcaaagtgctgaagatttctacaccctttggcttcacccaggacaaatccggggttcttacgaaggatagctccatcatttatcaatctcctacaggcctgtttgagagaagcgtgcgcctcaccgacctgtga

SEQ ID NO: 4231 - RNA, 4089 nt, synthetic construct
  misc_feature 1..4089: note = Cas9 variant
  source 1..4089: mol_type = other RNA
atgaccaagctgggcaaaccctacgggatcggagtggacattggcagcaactccatcgggttcgccgctgtcgatgaaaattctcacctcattagactgaagggaaaaacagttatcggcgcccggctttttgaagaggggaaggcggctgccaaacgcagagccggacggacgacccgcagacggctgagccgcaacagatggcggctctccttcctgcgcgactttttcgaatctcatattacacctaccgatccgaatttcttcatgagacagaagtatagcgagatctcccccaaggacaaagctcggtacaagtatgaaaaacgcctttttaacgatagaacagacgccgagttctaccaacagtattctaccatgtaccatctgcggaatcgcctcatgacagatcctagcagagctgacgtgcgggagatctattttgccattcaccacatcctgaagtccagaggccatttcctgacccccggcgatgcgaaagactttaacacgaatgatgtggccctcgacgaaattttccctgctctgcaggatgcctacgctcaggtctaccccgaccttgggatcacctttgacgaggataaggaaaacgagttcaagacaattctgctcaatgagatcgccaccagcattgacacacaacgcgcgctggtgaaacttctgctcgccgaagaggatgacaaggatatcctgaaacagcagaagcaggttctgaccgaatttgctaaagccgtggtcggactcaagacgaaactgaaccttgctctgggcacagaggtggactcttccgaagccaccgcctggaattttagcctcgggcaactggatgacaagtgggctggaatcgagtctgcgatgacagatgagggcaccgaaattcttgaccagatccgggatctgtatagagcccgcctcctgaacgggattgttcctaccggaaagacactgtcccaggctaaagtggacgactacacgcagcaccacgaggatctccaactgttcaaggcctatcttaaacagctggaagacgatggcaccgccaaggctatccggcagctctacgacagatatattgatggcgacgatgccgcgccgtttctgcgcgagaatttcgtcaaagctcttacaaaggacgtgaccgcccatcccaacacaaagagccctgaactgctcgagcggctggcccaacccgattttatgctgaaacagagaaataaggctaacggggccatccctgtgcagatgcagcaacgcgagctcgaccagatcattaaaaaccaggctgtctactatgattggctggccgcgcccaatccggttgaaaagcaccggaaatctatgccttaccagcttgacgagctgctcaacttcagaatcccctactatgtgggacctctggtgaccgccaaggaacaaaaggctgcccagggcggggtctttgcttggatggtgcgcaaagatcccgagggaaatattacgccctacaacttcgacgaaaaggttgaccgggaggcctccgcgaatacatttatccagagaatgaaaaccaccgatacatatctgattggcgaggacgtgcttcctaagcagagcctcctgtaccaacggtatgaagtcctgaacgagctcaataacgtgcgcgttaataacgaaaaactgtccatcgagcagaagcaacaggtgatcagagagcttttcgaacggcataattctgtcaccattaagcaatttgccgagaacctgagagctcacggggattacgcccacatcccggaaattcgcggactcgctgacgagaaacggttcctgagctccctgagcacatatagacagcttaagtctctcctgcccgaagccatcgatgaccctgccaaacaggctgatattgagaatatcattgcgtggtccacggtgtttgaggacgccgctatcttcaagaccaaactgaaggaaatcagctggctcggctctgaggccattacaaaactgagcaacatccgctacagaggctgggggcaattctcccggaagtttcttaatggactgaccctcggcaacgggcatacaattatccaggaactgctgctttctaccaacaatctcatgcagattctgacggatgagaccctgcagaagaaaatgacagaactcaacgccgacaagctgaaaaccgctaatatcaacgatgccatcgacaatgcgtacacaagcccctccaacaagaaagcccttcgccaagtcctgagagtggttgatgacattaagcgggctgccgacggacaggatcctagctggctctatgtggagaccgctgacggcgggggcacgcccggaaagcgcacaagagcccggcagcaccagctgcaagagatctacgcgaatgctgcccatgaactgattgataccgccgtccgcggcgagcttgaagacaaaatctctgataaggctgacttcaacgatagactcgtgctgtattttatgcaagggggacgggacatttacacaggcgccccgctgaatatcgatcagctctccagctatgacatcgatcacattctgcctcagtctcttatcaaagacaactccctggacaatcgcgttctcgtgcatgctattatcaacagagagaagaatgccaccttcgcgagcaccatttacgcccagaaaatgaacgctacatggcggcagtggcacgaagccgggctgatctccggaagaaagctgcgcaatcttcagatgcggcccgatcagatcgacaagtatgcttctggctttgtcgccagacagctggtggagacgcgccagattatcaaactcaccgagcagattgtggccgctcaataccctgatacaaagatcattgcggttaaagccgggctgagccaccagctccgggaggagctggagttccccaagaacagagacgtcaaccattaccaccatgcttttgatgccttccttgccgctcgcatcggcacctatctgctcaaacggtttcctaatctgcaggccttctttacatacggaaagttcaccaaggcggacgtgaaaaagctgagaggctttaacttcattcgcgatatcacgcacgctgaagacaaaatcgtggccaaggatacaggggaggtcgtgtgggacaaacagcgggatgttgacgaacttgatagaatttataatttcaagcggatgctgatcacccacgaggtgcgctttgaaaccgccgacctcttcaaacaaacagtctacggagctagagactccaaggaggccggcgggtctaagcagctgattcccaaaaagaaaggatatccggtggatatctacggcgggtattttcgggaaaacaccgcgtacctcgctgttgtgaaggtcacgaaaaagacagagaccattttcaaggtggttaaaatcgccacaagccaggtggccgctctgaataaggcccgctccagaagcaccgctgaggaactttctgtcctgacagagctcctgaaacctaagttttccaaagtgggcaagaacggaaagatcaccgacacgcccttcgaagtggtcctgccccgggttcctagagagcagctgttttacaatgccaaatatggcttctttatggtgaacagcgataccatgttccataattttcaagaaatttgggtgtctcgctccgaccagaagatccttcagcagattcggaaagcgaagatcgattacccgaacgtcgaccaagatctcgacaatctgttccacaacctcgccgatcagattgtgaaatatttcgacctgtacagcatcgctgggtttaaggagaagatctctcagagccaaaatacattcaacgatcttgccgttgacgataccgaccagtccgtgggaaaaattacagtcatcaatgagctgctgaagggcgctcaggccaacgggatgaccggaagcctcaaagtgctgaagatttctacaccctttggcttcacccaggacaaatccggggttcttacgaaggatagctccatcatttatcaatctcctacaggcctgtttgaaagaagcgtgcgcctcaccgacctgtga

SEQ ID NO: 4232 - RNA, 4089 nt, synthetic construct
  misc_feature 1..4089: note = Cas9 variant
  source 1..4089: mol_type = other RNA
atgaccaagctgggcaaaccctacgggatcggagtggacattggcagcaactccatcgggttcgccgctgtcgatgaaaattctcacctcattagactgaagggaaaaacagttatcggcgcccggctttttgaagaggggaaggcggctgccgaccgcagagccagccggacgacccgcagacggctgtcccgcaacagatggcggctctctttcctgcgcgatttcttcgaaagccatattacacctaccgacccgaatttcttcatgagacagaaatattccgagatctctcccaaggataagagccggtacaaatatgaaaagcgcctttttaacgacagaacagatgctgagttctacaaatatgagaattgccctaccatgtaccatctgcggaaccgcctcatgacagacccctccaaggccgatgtgagagaaatctattttgctattcaccacatcctgaaaagccggggacatttcctgacccctggcgacgccaaggattttaatacgaacaaggtggcggtcaataaaattttccccgccctccaagacgcttacgcccaggtgtaccctgatctggacatcacctttgacgagaacaaggttaatgaatttaaaacagtgcttctgaacgagaaggctaccccgtctgatacacagagagccctcgtcaatctgcttctggcgaaagagggcgaccgcgatattctcaagcagcaaaaacaggccctgaccgaatttgctaaggccgtggttgggctgaagacgaaactcaacgtggctctgggaacagaggtcgactccagcgaagccaccgcctggaatttttctcttggccagctggatgacaagtggacagggatcgagtccgctatgaccgatgaaggaaccgagattctcgaccagatccgggatctgtatagagcgcgccttctgaacggcatcgtgcccgccgggaaaacactcagccaagctaaggtggacgattacgcccagcaccacgaggacctggaactgttcaaagactatctcaagcagctggaggatgacggaacggccaaggctattcggcagctttacgatagatatatcgacggcgatgacgccaaaccttttgtccgcgaagatttcgttaaggcgctgaccaaagaggtgacagctcatcccaacgccaagtctcctgaactcctggagcggcttgcccaacccgactttatgctgaaacagagaaataaggctaacggcgccattccggtgcagatgcaacagcgcgagctcgatcagatcattaagaatcagtccgtctactatgactggctggctgcccctaaccccgtggaaaaacacagaaagagcatgccttaccaactggatgagctcctgaatttccggatcccctactatgttgggccccttgtgaccgcgaaagaacagaaggccgctcagggaggcgtctttgcctggatggtgcgcaaagaccctgatgggaacatcacaccgtacaatttcgacgagaaggttgaccgggaggcttccgccaacacctttattcagagaatgaagacgacagatacctatctgatcggagaggacgtgctccccaaacaatctctgctgtaccagagctatgaggtccttaatgaactcaacaatgtgcgggtcaacgataataagctgtccttcgaccagaaacagcaagtgctgggcgagctctttgaacgccataacaccgttacaattaagcagttcgtggataatctgcttgcgcacggggactacgatagaatccctgaggtccggggactggccgacgagaaaagatttctcagctctctgtccacctataaccagctgaagggcattcttcacgaagctatcgatgacagcgataaacagacagacatcgagaacattatcgcctggtctacgattttcgaagataaggctatcttcaagaccaaactcaatgagattagctggctgaacgccggcatgatcaattccctggccaacattcgctaccgggggtggggacaattttctcataagctcctgaatgaacttacactgagcaccggcagaacagtgttcgaggagctcctgatctccagccacaacctgatgcagatccttaccgacgaagttctcaaacagaagattgctgagctgaatgcgcatgaactgaaagcctctgggatctacgctgccattgacgatgcctatacgtcccccagcaacaagaaggctctccgccaagtgctgtctgtcatcgacgatattaccaatgccgcgggacaggctcctaactggctttacatcgagacagccgacggcgatggggtgcccggcaaaagaaccaattcccggcagcgcaagatccaggaaatttatgccaacgctgcccaagagctgatcacaggaagcgtgagaggcgagctcgaagacaaaattgcgtcccgggctgattttaccgaccgcctggttctgtacttcatgcaagggggaagagatatctatacgggcaagccgcttaatattgacaacctctctagctacgatatcgaccacatcctgcctcagtccctgattaaagacaattctctcgataaccgggtcctggtgcatccccttgtgaaccgcgagaaggacacaatctttgccagcaccagattcgccaagcagatgaatgggatgtggcggcagtggcacgctgccggactgatttccagccgcaaactcagaaacctgcagatgcggcctgatgaaatcgacaagtatgcttctggctttgtcgccagacagctggtggagacacgccagattatcaaacttaccgaacaaatcgttgcggatcagtaccccgacaccaagattatcgccgtgaaagctgggctgtccagccagctccggaaggagctggatttccctaagaatagagaggtcaaccactaccatcacgcctttgacgctttcctcgccgcccgcattggcacatatctgcttaaacggtaccccaatctggaaccgtttttcacgtatggaaagtttaaaaagaccgaggtgaaaaagctcaaatctttcaacttcatcagagatatgacacatgctaaggacaagattgttgcgaaagaaaccggcgagatcgtgtgggataatgcctccgacattaacgagctggatcgcatctacaattttaagcggatgctgatcacacacgaagtcagattcgagaccgctagcctttttaaacaaacgctgtatgccgccaagaactctaaaaatcgcgggggaagccggcagctcattcctaagaagaaaggctacctggtggacatctatgggggatacacacaggaaaccggctcctacctcagcgttgtgagactgaccaagaaagctatgtatgccgtcgtgaaggtgtctacacgggacgcggctaaacttgccgtcgccaagtccattagcgagcagaaggaaaacgagaccctgaaaaagatcattgatgggaaactctccaagacatctaaaaagggcaagacgacccaccaactgttcgagatcgttctgccccgcgtgggacagaaaacactttttaagaatagcaaatacaaccagttcctggtcaattccgacacctatatgcataactaccaggaactctggatgcccagagagtatcaacggatgtggaaggatatcctgctctctaaccacggcgacgctcagctggaagggcagcttgatcagatttttaaattcatcgtgagccaagttaattcctactttaacctgtatgacattaatcagttccgcaagaagatcgccgatgcgacagacaaatttgctaagctgcctacccatgatacggacaacgccagaggaaaaattgccaccatcggccagctcctgatcgggcttcaggctaatgccatgcggtctgatctgagaaacctcgacattaagacaccgttcggactgctccaaatcggcaccgggattacactggatcttgacaccagcatcatttaccagtcccccacaggcctgttcgagcgcgaagtgcctctgaccgacctctga

SEQ ID NO: 4233 - RNA, 4089 nt, synthetic construct
  misc_feature 1..4089: note = Cas9 variant
  source 1..4089: mol_type = other RNA
atgaaccaggagccctacgccatcggcctggacattgggaccagctccctcggatgggctaatgccgatatggacggctatatcgcgagagtgaaggggcaaacaggactgggcgtccggcttttcgaagaggggcagcctgctgccgatcgcagatcttttcggacgacccgcagacggctgagccgcagacggtggcgcctcagactgcttcgggaaattttcgacgagccgatctcctctattgatcccaactttttcgcccgccagaaagctagctccatctctcctaaggacgatagatttgaaacaacctaccagctgttcaatgacaaaacagatcaagagttttatagcaagtaccccaccatctatcacctccggtgggccctgatgacagagcatcgcaaattcgacctgagagaaatttacctcgctgttcaccatatcgtgaagtatcggggaaactttctgagatccggcaatcctaagagcttcaaaccctctgagcttgatttttcccagcgcttcaaggaagtgaacggcctgtggcacctcatttttgacgaggtcgcccctcagctgccgaccgataatcttgaggaaatcacgaaactggtgctcgacaccacacggaccagagcggaccgccagcgggagagcgttaagctgctgatggccgctacagataaccataaagactggaagccctacctcaccgagttcacgaaggccattctggggcttaaaacaaagctgtacctcctgaccggagtggatgtcgctaaagccgaccaaaagacatggaccttctctcttgaagatatcgaagaccacagagcggatctggagaccgcctttgacgatcgctccctcgagctgattgaaaaactggtggacctccaggctgccatccagctgacagagatcatgcctagcggccagtatttctctcaatccatgatttaccggtatgatcagcacaaggaacatcttagatggctgaaagactacgctgagcagcaaacggacgccaataagcgcaaggccgttcggctcgcttatgatcactacatcgaaggggacgcgaaaggaaagcccgagattgccgatgacttttataaagagctgaacagaatccttaagggcgataccagcgaactggctaaaaagattaatcatgagatcgccctcgaacacttcatgcctaagcagcgcacaaaagagaacggggtgatcccctaccagattcaccagcaagaactggactccatcattgataatcagaagaaatactatcagtttctgggagaggacaacccggtcgtgtctcatcacggcagccagccttacaagatcgatgagctcgtgtccttccgggtcccctattacgttggccctatgattaccgccgaccaacagaaaaagacagctgccgggcagtttgcgtggatggtgagaaaggatagcggagacatcaccccctggaatttcgatgacaaagtggaccggacggcttctgccacaaactttatccagcgcatgaagaccaccgatacatatctgattggcgaagacgtccttcccctgcaatccctcacctaccagaaattcatggtgctgaacgagctgaataacatcagaattaatggggaacttctcacacgggagcagaagcagagaacgtataacgatgtttttaaaggacatggcaccgtgaatgtcaagagcctgatcaagtctctggagtgccacagcgaagtgacaggggccattaaagttgagggactcgctgaccctaagcgcttcaactccgccctgaccacataccgggattttaaaaagatccttccggtggctattgaccaaccccagagacaggccgatatcgaacgcatcattaattggtctaccatcttcgaggacgcggatattttcaaagccaagctgcaagaaatcgactggctcacggatacccagagagaccggctgagcacaaaacgctacagaggctggggccggctgtccgctaagctgctcctgaacattaaggatacccaggggctgagcatcatggaccagctctggaatacacaacataactttatgcagatcgtccacgagcctgactatgccgagaaaattgaaaagaccaatgctaaaggactgaagcagcaggatatcttcgagacgattaacgaaatgtacacatctccccaaaataaaaaggcccttcgccagatcctggcggtggtcagagacattcagaaggcccaccatggccaggctccttcccggatctttatcgaggccgctcgcggggccgaacaaaacccccagagaacccggcagcgccaaaaacagctcgccgatctgttcgctgaccaggcgaaggagattgtgaatgagacagttgcccaggaactgaacgatgagaccgacaacaaagctagatttaccgatcggcttatgctctatttcctgcaaaatggacaggacatgtacacaggcgaaaagctgaacatcgataaactcagcacgtatgacattgatcacatcctgccgcagtctcttgtgaaggacgactccctggataatagagtcctcgtgagcaaggttgagaacctgaaaaagaatgaccattttgcctccgaactgtacgcccgcaaaatgcaggggacctgggagctttggcggtctgctggcctcattagcgccagaaagctgaaacaccttctcatgcgccctgatgagatcaacaagtatgcgacaggattcatccggagacaactggtggaaacccgccaggtcattaagctggtgacagacgtgctgtccaatgagtacgattctgacaaaaccaagatcattagcgttaaagctggcctctcccaccagctgcggatggaactggatcttcccaaggtcagagagctgaacgactaccatcacgcctttgatgccttcctcgctgtgcgcatcgggacgtatctgctcaaacggtaccctaagctggagagatttttcgtgtatggacagtaccaagtcgcgccccagcttgacctgcggcgctttaatttcattcatgatctcgtgagcggcaaacaggaaaagatcgttgccgaggaaacaggggagattgtgtggaacagagaaaaggacgtctcttatatgaaacaccttctgtcccttaagcatctgctcgtgacccacgaggttaaagaggatcacggagctctgttcaatcagaccatctacaaggccaaaaaggacaacggcaatgtcgggggcaagatgaaactcctgcctacaaagagcaaccggcccaccgaaatctatggaggccattcttcccaagccattgcttaccttgccatcgtgcgcgtgaatgggaaagagccgagctacagagttatgggagtgcctattcggatcctggaccagctcaagcaggctaaaaagcaaggcgaatatgccgagagactggcgctgaagcagtttttcacacccgattttacgaaagggaagggaaaaattgtctctgacttcgatgtggtgatcccccacatccctcttctgcagccggtcattgacgaaatcagcggccagtcccatcgctttgccctcgggaccaacacatactatcggaacctgcaacagctcattctgacccttgctgatcagaaggttctgatcagcaaagagacaggcgtggacgaggaaaagaagctggtggaggtctactctcacatttgtcagcaagtgatgaaattctttcccctctatgatagaaataagttccgcgaactgcttgttgactcccggagccattttgagcagctgcctatcgtgaacagatactccgatgccggaaaactcgaaatcgctggcaagcgcgggattctgcagcagatcatggtcggactccacgccaatgccacccccggcgacctgaaagagcttggggtgaagacgcctttcggaaagctgcaagttcccggcgggattaaactgaccgagaacgctaagctcatctatgaatctcctacaggcctgtttaaacgggaggtgaagattaccacagaatga

SEQ ID NO: 4234 - RNA, 4089 nt, synthetic construct
  misc_feature 1..4089: note = Cas9 variant
  source 1..4089: mol_type = other RNA
atgaagaaaaaggccgagaaaatctacctgggcctcaacgtggggaccaatagcattggatatgctgtcacagacgaacagtacagactgcttaagttcaacggcaatgatgcctgggggtccatcgtttttgacgcggcttctagcaacgaggatcggcgcaatcacagactggcccggcgcaacctcgacagacggcaacagcgcattgtgtggctgcaggaaatcttcgccaaagagatttccaaggtggatgacagatttttcatccggctttctgagagctttcgctggagagaggatgtccaggaccggtatgtgttctttaatgataaggagtacacggacgttcaatatatgaaagaataccccaccatccatcacctgatttgcgagctcatggataacaagacacctcatgacgtgcgcctggtctatctggcttgtgcctggctcatcacccacagaggacatttcctgaataaccttaatgtggaaaaactggatgagattatggacttttcctctgtttaccagaacttcatcaattactttacagagaacggctataagcggccgtggggagaaattgacgtgagcgctctctccgaggtcctgaaacagaagaccgggatcacagtgaagaataaagaacttcagaacattctgctcgagggcaagaaacccgaaaagagcggcaccgaggagttccctttttctcaagattccatcatccgcctgctggccgggggacagtgcaaactcaaggacgtgttctgtaaagaagagtacctggatcttggcagcgtctctctggggatggacgaagagaagttcgatgaaatttccggaagcatcggcgaggactatgatctcctgattgcgcttagagggctgtacgactggtctgttctcgccaacctgctgaatggacactccgagacgatcagcatggctaaggtgcagatgtatgaacagcacggcaaagatctccaaattctgaagtactttgtgcggaaatatgtccccgacaagtacaacgaggtgttcagaaaagccaaggctgataattacgttgcctataccggccatatggacaaggacacagcgtcccagatcaaaaagaaagccaaggctgaagagttttctaaatacgtgcttaagctgatgagccctatcaagcccgagaaaaccgatctccagtcctatgaagacatgtgcgagcgcctgaaacttaaccggttcctgcctaaacaaaagaatacagataacagagtcattccgcaccagctctacgaatatgagctgatccagattctgaaaaatgccagcgtgtacctcccctttctgaacgacaccaataacgggatctctgaagctgataaggttctttccgtgttccgctataagattccttactacgtcggacccctgaatgaggagagctcttttgcctggatcagccggaaacagggcaagatcacgccttggaacttcaaagaaatggtggacgaggatgcctccgaaaatgcttttattagacgcatgacaaacaagtgtacctatctccccacagaggacgtcctgccgaaagattctctgtgctaccaaaagttcatggtgcttaatgaaatcaacaacctccagattgacgggctgaaaatccctgttaaggcgaagcagggaatttatcatgagctgtttgagaaaaataagaaagtgaagcggaaagatatcgaagagtacctcattagaaacaattatctggacaaggatagcaccgaacttatctccggcatcgacgagcagattcacagcgggctgtcttcctactgtgccttctttaacctcctgaataagaaaatcctgagcgaagacgatgtcgagcgcattatcgagcgggcttcttatgccgaagacaagtccagagtgattaaatggcttcgcaaggagtaccccggactcagcgaagatgacatccggtacatcgccagaattaaaatccgggatttcggccgcctgtccaagaccttcctgacaggcctcaaggggtgcgacgtttctaaaggatttgatggccaagacgtggagatgattagcatcctgcagacgatgtgggaaaccaacgataatcttatggagattctgtccgacaagtatacattcctcgaggctctggaagcctttacccaggagtactatacagggaaaaagaaatctctgaaggaaagacttgatgagatgcgggtcagcaactccgtgagacgccctgtgtaccggaccctcgcggttgtcaaggacatcgagaaggctttcggaaagcccaataaaatctttgtggaaatgacgagaggcgggcaggccgatcaaaagggcaaacgcattaagagcagaaaacagcagatcctggacctgtatgacaagtgtaaggatgacgtgcacgatctcatgtggcagctggagtctcttggagaatacgccgactcccggctgcaaagcgatcgcctctatctgtacttcatgcagtttggcaaatgcgcttactctggggcccatattggattcgagcagctgatggctggctccgtcgaatatgacatcgatcacatttacccccaaagctatgtgaaggacgattctcttaacaataaagttctcgtgctgagcgacctgaacgggacaaaggataatatctaccctgtctccccggagatcagaggaaaaatgcagggcctctggagctggtggaaccatgtgggggccatttctgacgagaagtataagcggctgatccgctccgcgccctttaccgacgaagagaaaatgggcttcattaatagacagcttaccgaaacaagccagtccaccaagtttatcgccgatctgctcaaagagcggttccctgacgctgaagttgtgtacgtcaaggccggactggtgtctgattttcgccacgagttcgacctgcccaaaagcagatcctataacgatcttcataacgctgccgacgcgttcctgtctgttgtggccggcaatgtctacgatatgcggtttagcaagaagtggttccgcattgacgagaaatactccgtgaaggtgaaaacaatctttacgcacgaagtcaagtgtagaggggatattatctgggacggaatgcctatgctcgagaaagttgaagataccgctcggaagaacacagcccacttcgtgaagtatgctgcctttaaaaccggcgggctgttcgaccaaaatcccgtgaagaaaggaacaggcctcatcccgctgaaggccgggcttcctaccgagaaatacggcggatataacaaggctggcattatgtttctgatccccgtcagatacaatattgggaagaaatctgaaatcctcattctgcctgtggagctgatgcatggaaagcacttccttgaggataaagtttttgcgcgcaactatacgttcacccggctggaaaatatcctcggcaagaaagtgggggaggtcagctttcccatgggaatgagaccttggaagatcaacacaatgctgtccttcgacggcttccgcgtgtgcctcaccgggacaagcggccggggaaaatgcctggttgcccagcccgtgatgcagttttctgctgacgaacattggagattctacgtcaagcgccttgagcggtttgtggagaagattggcatcaatccggatctgctctatgacaaagatcacgacaaggtttccaaagatgaaaacctgaagctgtacgagctttacgtggacaaactgcagaataccatttataagaagagagtcaacagccctgtgcaaacgctcctgaaagggaaggaagagttcaaaaagctctctatcgaagaacagtgtcaggtgctgcttaatattcagtccgtctttggacgcatgacaggcgggtgcgatctgaccctgatcggaggcagcgcccactctgccgctacaggctccctcagcaccaccatctccaactggaaaaagaagtacagcacagttcggattatcgaccaatctcccagcgggatgtgggagaaatcctctgaaaatctgcttgatttcctgtga

SEQ ID NO: 4235 - RNA, 4092 nt, synthetic construct
  misc_feature 1..4092: note = Cas9 variant
  source 1..4092: mol_type = other RNA
atgaccaagctgggcaaaccctacgggatcggagtggacattggcagcaactccatcgggttcgccgctgtcgatgaaaattctcacctcattagactgaagggaaaaacagttatcggcgcccggctttttgaagaggggaaggcggctgccgaccgcagagccagccggacgacccgcagacggctgtcccgcaacagatggcggctctctttcctgcgcgactttttcgaaagccatattacacctaccgatccgaactttttcatgagacagaaatattccgagatctctcccaaggataaggctcggtacaaatatgaaaagcgcctttttaatgacagaacagatgccgagttctaccaacagtatcctaccatgtaccatctgcggaatcgcctcctgacagaccccagcaaagctgatgtgagagagatctattttgccattcaccacatcctgaagtcccggggacatttcctcaccagcggctacgcgaaagactttaacacgaataaggtggccctgaacgaaattttccctgcccttcaggatgcttacgctcaggtctatcccgacctggatatcacctttgacgagaataaggtgaacgagttcaaaacagttctcctggacgagaaggccaccccttctgatacacaaagagcgcttgtgaatctgctcctggccgaggacggcgataaagacattctgaagcagcagaaacaggtcctcaccgagttcgctaaggccgtggttgggctgaaaatgaaacttaacgtggctctgggaacggaagtcgattccagcgaagccacagcctggaatttttctctcggccaactggacgataagtgggctgggatcgagtccgcgatgaccgacgaaggaacagagattcttgatcagatccgcgacctgtaccgggccagactcctgaacggcatcgtgccggctgggaaaaccctgagccaggccaaggtggatgactatgagcagcaccacgaagacctcgagctgttcaaagattaccttaagcaactggaagacgatggaatggccaaagtcattcgccagctctatgaccggtacatcgatggcgacgatgctaagccctttgttagagaggacttcgtgaaggccctgaccaaagaagtgacagcgcatcctaatgctaagtctcccgagcttctggagcgcctcgtccagcctgattttatgctgaaacaacggaacaaggccaacggcgccattcccgtgcagatgcagcagagagaactggaccaaatcattaaaaatcagtccgtttattacgattggctcgctgccccgaaccctgtggagaagcaccgccagagcatgccctaccagctggacgaacttctgaatttccggatcccttattacgtcgggcccctcgtgacggctaaggagcaaaaagccgcgcagggaggcgtttttgcctggatggtgagaaaggatcccgacgggaacatcaccccttataatttcgacgaaaaagtcgatcgcgaggcttccgccaacacatttattcagcggatgaagaccacagacacctacctgatcggagaggatgtgctgccgaaacagtctcttctctatcaaagctacgaagtcctgaatgagctgaacaatgtgagagttaacgacaataagctctccttcgatcagaagcaacaggtgctgggcgaactttttgagcggcataacacggtcacaattaaacagttcgtggacaatctgctcgctcacggggattatgaccgcatccccgaggttagaggactggccgatgaaaagcggtttctgagctctctttccacctacaaccagctcaaaggcattctgcacgaggcgatcgacgatagcgacaagcagaccgatatcgaaaagattatcgcctggtctacaattttcgaggacaaggctatcttcaaaaccaagctgaatgaaattagctggctcacagccggcatgatcaactccctggctaacattagataccgcgggtggggacaattttctcataaacttctgaatgagctcacgctgagcaccggccggacagtgttcgaggaactgcttatctccagccacaacctcatgcagatcctgaccgacgaggtcctgaaacagaagattgccgaactcaatgcccatgagctgaaggcttctgggatctatgcggccattgatgacgcttacacatcccctagcaacaagaaagcccttagacaggtgctgtctgtgatcgatgacattaccaatgccgctggacaagcccccaactggctctatatcgaaacggcggatggcgacggggttcctggcaagcgcaccaattccagacagcggaagatccaggagatttacgctaacgccgcccaggagctgatcacaggaagcgtccgcggcgaactggaggataaaattgcttccagagccgactttaccgatcggcttgtgctctatttcatgcaagggggacgcgacatctacacaggcgaacccctgaatattgataacctgtctagctatgacatcgaccacatcctcccgcagtccctgattaaggataattctcttgacaacagagtgctggtccatcctctcgtgaatcgggagaaagataccatctttgcgagcacgcgcttcgctaagcagatgaacgggatgtggagacagtggcacgccgccggactgatttccagccggaaactgcgcaatcttcaaatgagacccgacgaaatcgataagtacgcttctggctttgttgcccggcagctggtggagacaagacagattatcaagctcaccgagcaaatcgtcgctgaccagtaccctgatgccaaaattatcgcggtgaaggccgggctgtccagccagctccgcaaagaactggacttccccaagaaccgggaggttaaccactatcatcacgcttttgatgccttccttgctgccagaattggcacatacctgctcaaacgctatcctaatctggaaccctttttcacctacggaaagtttaagaaaaccgaggtgaagaaactgaagtctcttaaatccttcaacttcatccgggacatgacacatgccaaggataaaattgtcgctaaggagacgggcgaaatcgtgtgggacaatgcgagcgatattaacgagctggacagaatctataattttaagcgcatgctcatcacccacgaagttcggttcgagacagcctctctgtttaaacagaccctctacgctgccaagaacagcaaaaatagagggggatcccgccaactgattccgaagaaaaagggctatcttgtggacatctacgggggatacacacaggaaaccggcagctatctgtctgtcgtgcggctcacgaagaaagccatgtacgctgtggtcaaggtttccacaagagatgccgcgaaactggctgtggccaagagcatttccgagcagaaagagaacgaaaccctgaagaagatcattgacgggaaactttctaagaccagcaaaaagggcaaaacaacccaccagctgttcgagatcgtgctccctcgggtcggacaaaagacactgtttaaaaattccaagtataaccagttcctcgttaattctgatacgtacatgcataactatcaggaactgtggatgccccgcgagtaccagagaatgtggaaggacatccttctgagcaatcacggcgatgcccaactggaagggcagctcgaccagatttttaaattcatcgtgtcccaggtgaactcttattttaatctgtacgatattaaccaattccggaagaaaatcgctgacgccaccgataagtttgcgaaacttcccacacatgacaccgataacgctcgcggaaagattgccacaatcggccagctgctcatcgggctgcaggccaatgctatgagaagcgacctccggaacctggatattaagacccctttcggacttctgcaaatcggcacggggattaccctggacctcgacacatccatcatttaccagagcccgaccggcctgttcgagagagaggtcccccttacagatctgtga

SEQ ID NO: 4236 - RNA, 4092 nt, synthetic construct
  misc_feature 1..4092: note = Cas9 variant
  source 1..4092: mol_type = other RNA
atgagaggcaactaccacatcgggctggacattggaaccagctccatcggctgggccgtgattgatgacaatgctaaggtcatgcgggccaaagggaagacagcgatcggagctcgcctctataacgagggccagacggccgccgatagacggctgttccgcaccacaagacggcgccttaatagacggaaatggcgcctgaagctcctggacgaaatttttgatccctacatcacccctgttgacgctgccttctttgctagacttaaacaatctaacctgagcccgaaggatcagaatcgggactggacagggtccatgcttttccccgatcgcaccgacagaaagtttcataaagattatcctacaatctaccacctgagacataagctgatgaccgaggaccaccagttcgatattcgcgaaatctatctcgccattcatcacatcgtgaaatacagaggaaactttctgaatacgacccccgtgtctagcttctccgtctctgacgtgaagtttgacgagcagttcgatcggcttaacgaactgtatgcggccgttagccctgacgagccctttgctattaatggcgataactccaaagccatcgagacactcctgcttagcgacgaaaccaagaagttcgataaacaaaagcagtctgctaaactgattctctccgagacaggcgacaaggccctggataaagaaaataccaaggtggcgacgcagatcagcaaagccatcctggggtacaagacacagctcgacgtcctgcttaagtacgatgctattaactcttccgcctggaaaatcgagctggacgatgagaatattgacgacaccctccctggactgcttagccaactggatgaaaacagacaggagatggtgtctatcattcagaatctctatgctcaggttacactgaaccaaatcgtgccgaacggcatgtccctgagcgaatccatgatcgagaagtacaatgcccaccgcgaccatctcaaactgcttaagcagctggaagataaaattgacgatcccaagaagaaaaaggggctcgaggccgcttatgacgcgtacgtcgggaaaaacatgaaggtggccaatcaggatgtgttttatgcttctgtcaaaaagaacctggacgatagcgaccttgccaagcaaatcgccgatctgattgaggctcagaaattcatgcctaagcagcggacctcccagaatggcgttatcccccaccaactccatcagctggaactggaccagattatcgagaaccagagcaaatactatccttggctcaccgccgcgaatcccaacccgaagagaatccaccaagctaaatacaagctggatgaacttgtggccttccgcattccttactatgtggggcccctggtcacacctgaggaacaggagaagtctgccaatcaggtgtttgcttggatgaaacggaagcagcccggaacgatcaccccctggaacttcgaccaaaaagttgacagaatggcctccgctaatcgctttattcggagaatgacaaccaaggatacatacctcatcggcgaggacgtgctgcctgatgccagcctgatttatgaacgcttcaaagtccttaacgagctcaatctggtgaaggcgaactaccaccggctggccccggctcagaaacaggccgcttatagagacctctttgaaaatcagaagtctatcagcaccaagaaactgcaaaactaccttgttgatcagggctatttcacggccaagcccaaaattacagggctgtccgaccctgagcgctttaactctagcctcggaacctacatcgatttcaaggaaatctttggcgaccaggtggataatcccgaccggcaagatgactacgagaaaattatcgagtggtccaccgtcttcgaagatagacagatttatgaggcgaagctgcggacactggactggcttaccgaagaccagatccaggccctcaagacaaaacgctacaacgggtggggaagactgagcaagaaactgctcacgggcattgtggatgagaatggggagcggatcatcgacgtcctgtggaacaccaatcaaaactttatgcaagtgcagtctcaggaatccttcgctaagcggattcatgaggccaatgctaaacagatgaaggttacaggagtggaagatatccttgccgacgcctataccagccctcagaacaagaaagctattcgccaggtcatccgggtggttgatgacattcagaaggcgatgggcggcgtggcccccacatctgtctccatcgagtttaccagaagcgaagatcaaaatccgcgcagaacgcagtcccgggagtctcagctgcaaaacaccttcaaagtggacgctaaggagatcgtggatagcgacctcgttacagaactggagaccgtctccaaatctaagaaggggctgacagatcgcctttacctctatttcacccagctgggaaaagacatgtacacgggcgaccctctgaatattgatgaactcagcacatatgacatcgatcacattctgccccaggcctttatcaaggacgattcccttgacaacagagtgctggtgagcaaagccgtcaataacgggaagtctaataacgtgcctgttaaactcttcggaggcaagatgggaggcttttggaaagagctggctgatcatcggctgatttccaagcgcaagctcaaacacctcctgaccgaccccgatacaatcgacaagtacaccatgagaggattcatccggcgccagctggtggaaaccagccaagtcattaaactcgtggcccagatcctgggcgataagtaccagaacgacgatacaaaaattatcgaggttacggcgaagatgaatcatcagatgagagagaactttaaacttattaagaatcgggaagtgaacgactatcaccacgctgtcgacgcctacctgaccgccttcgtggggcaatatctctacaagcgctatcctaaactgagaccctactttgtttatggaaatttcaagaaatttaacgaggatcatgtgtctttccggtactttaatttcctgcacgaacttatggacgagaacaataagagaatcgtcgaaccggagacaggcgaggtggtgctggaacgcgagcctgctattgcctacatgaagcgggtctatcattttaaattcatgctcatctcccaggaagtttacaccagacgcgatgcgatgttcaaccagacaatctatcccgctaaggaggccaatcggagaaaactgattgccatcaagcacgggaaacccgtggacgtgtacggaggctatagcgggtctgtcgatgcttacatggccattgtgcgcatccacgacaagaagggcgataaatataaggttgtgggagtccctatgcgggctctcgagattctgaacgccacccatgacaaaaaggattacgacgcgaaacttaagcagatcctggtgccgaagtttacgaaagttaagaaaagcagaaagacaggcgaaatcaccaaaaaggtggaggatttcgaaattgtcctcgggaaagtgatgtaccgccaactggttatcgacggagataagaagtttatggtgggctccagcacctatctgtacaatgcccggcagcttgtcctgtctgactccagcctcgacacactggcttccaaagggaccctcgattctgacgccgatagcaagagactggtggctgtgtatgacgagattgtcgaaaaagttgataagtacttccccctttatgacaaaaacgcctttcggtccggactgcacaagggccgcgataagtacctcctgctgcctaatagatctacattcaacggggccaaaaaggtgcatagcggcaaacgggagatccttaacgagattctgaatggactccacgctaacgcgacgctgggcgggctcaaggacctgaaaatctccaccccctttggaaagatgcagggccagtctgggatccctcttagctccaatacaattatctgctatcaaagccccaccggactgttcgaacatcgcgtgtctctgaaggatctctga

SEQ ID NO: 4237 - RNA, 4092 nt, synthetic construct
  misc_feature 1..4092: note = Cas9 variant
  source 1..4092: mol_type = other RNA
atggagaacaatagatacaacgtgggcctggacatcgggaccagctccattggattcgccgtcacagatgaacaggacgagctcgttcaagtgaagggcaaaaattatatcggggtgcggctgtttaaggaaggacagacggcttctgagcgccggagcttcagaaccacacgcagacggcttaaacgcagaaagtggcggctgggcctcctggaagagatttttgccccctaccttgcgcagggggatccttatttcctggctcgcatgaaagagtccaacatctctccgagagacgaacggaagaagtactatggaagcctcctgttttccgatgacaccgtcttctacgataaatatcccacagtgtaccatctgcgccacgccctcatgaccgaggacagaaagtttgatattcgggaaatctacctggccgttcaccatatcattaaatatcgcggcaatttccttatcaacacactgattaatgagttttctagcaaggctgtggacttcaaaaaggatgccgacatcctcaacgatctgtttgagcagttctacatttccgacatcaatgacagctttcaacttaacaccgctgatatgaatgaaatttctgagctgctcctggacaactccaagacgagactggatcggcagagagaaagcctcaaaaagctggccaaaaaggtcgacgatatctctgtggcgaaaaagcaccagaaaatcgccaccgagttctccaaggctattcttggcaataaggccaaattcgacgttatcctgaacgtgacaaccgatagctctaatgactggtcctttaagctcgaagatgaggacgctgatgagaaaattgtcgtgctgcttgaggaactgaacacacctcagcaagaagccctcaacatcattcatcagtggtatagccagatctccctgaatgggatcgtgcccgacggaaagtctattagcgaggcgatgatctccagctacgaactgcacaaagagcacctcgccctgcttaagcagcaaattaacaataccaaggacaaaaagaaagctcatggcctgcacgaggcctataacgaatacgtccatgggaataacaataagaaactcaaccaggctgatttctattctaaggttaagcagaatctggagtccagccttatcacggacgaaattctggagctcatcaacgccgaaaattttatgcctaaacaacgcacatctgccaacggagtgatcccccaccagctgcaccagcaggagctggatcggattatccaaaatcaggctaagtactaccctttcctcgcggagaccaacccgaatgaaaagagaagcaaggtggccaaatataagctggacgagcttgtcgcttttcgcgtgccctactatgttggccctctgattacagccaccgatcagaagaaaacctccgggaaggagttcgcctggatggtgcggaaacagcccggaagaatcacaccttggaactttgacgaaaaggtcaacaaaatggagtctgctaatacgttcattcgccggatgaccacaaaggatagctacctcatcgccgaagacgtgctgcccgatgagtccctgctttatcaaaaatttaaggttctcaacgaactgaataacctgagagcggacggccgcaagctcaaagtgagcgtcaagcagaaagtgttcaaggagctgtttcagcagcaaaagaccattacaatcgtcaaacttcagaattacctgaaggctgaatgctctttcctcaccacgccggagatctccggcctgagcaaacctgagcattttgtgtcttccctggccacatatattgatcttaagaaaatcttcggggaagacattgataaccccgcccggcagaatgacttcgagagaatgatcgaatgggctaccatttttgaggacaagaacatctacagcgaaaaactcaatgagatcaagtggctgaacgatcgccagaagaaagagctgaagaataaaaactaccacggatggggcaagctctccgccaaactgcttaaggggctgcgggactctgatgaatgtagcattatcgagcatatgtggaatacccaacagaacttcatgcaggttcaagctgaagaggactttgcccagcggattcaggaagagaataaccagcacctcaagggaaacacactggaggaagtgctggcggatgcctatacctcccctcaaaataaaaaggctatcagacaggtcgtgaaagttattgaggacatccagaaggccatgggcgggatcgctccccagaaaatttctatcgagttcacacgcgcccccgaagagaagcctagacggagcgtggaaagacaacagcagattgagaaaatctacaagtccgtcgcgaacgaagtggagaatgccggagtgaaggatgaacttcagcgctttagcgaccggaaacaaacgctcaccgataagtatttcctgtactttacacagctgggcaaagacatgtataccggcaagtctattaacatcgatcagatcgggaattaccaaattgaccatatcctcccgcaggctttcattaaagatgactccctggacaacagagttcttgtcagcgccgctgtgaataacggaaagtctgataatgtgcccacaaagaacgaccgctataaagtcagagagcacggccagcggctgtacgatcaggggctcatctccaagcgcaaatttaataacctgattaccgaccctgatagcatcaataagttcacggccagaggatttgtgaaacggcaactggttgagacctctcaggtgattcgccttgtcgccgagttcctctacaacaagtatcagagcaagtccgaaatcatcgaagtgagagctaaaatgaatagccagctgcggaaggactttggcctgattaaaaaccgcaacgttaatgattaccaccatgcgctcgacgcctatctgacaaccttcatcgggaactacctttatagacggtaccccaagctgcgcgcttatttcacatacggctgctttaaaaaggtggatgactctcaactcaagtacttcaattttctgcacgatattgaggacgacaaaaagaaaatcattaaggataacgacaccggagaaatcctgtggcatagagatgagggcatcgcccggttcaaaagaatttataattttaagtacatgcttgtcacgcacgaggtgctgacacgccagggggccatgttcaagcagaccgtttattccgctgccgtggcgggaagcaaaaagctcatccctgtcaaagaagaccggcccattgatatctacggcgggtatacaaacaataacgacgcttttctggccattgtgaaggtgaccaaaaagaaacagtacatggtcgttggaatcccgcaaagagccgtggtgaagctcaatgatgctgccaagcagggctccaaagcgtatcagaaggtcctgtacaacgtgatcaaacctcagttcattaagaaaaagaaggaccgcaaaaccgggaagatcacacaaaaacttgagaattttgaaattgttgtgtctaagacgctgtaccggcagctcatcattgatggcgaccagaaatatatgctgggaagctccgcttacaagtataacgccaagcaactggtcctttctgagtacgccctggaagtgctcgatagaagcatcttcgagaaaaaggagtataccacagttgacctggataatgtgtacgacgaaattctcgctcaggtcgacaaatatttttccctgtacgataagaacaaattccgccagaaacttcacgagtctcggaagatcttcaccgaactgcccatcaataacctctttagcggcacaaaactgctgaagtccgggaaaagagagacccttaatgagattctggaaggactccatgccaacgctacgaagaaagacctcaagagcctgaaattctctacacctctgggcatgatccagtacccctccgggattatccttagcgagaacgccattctgtgttatcaatctcctaccggaatctttgaacgccgggtgaccctgaaggatctctga

SEQ ID NO: 4238 - RNA, 4092 nt, synthetic construct
  misc_feature 1..4092: note = Cas9 variant
  source 1..4092: mol_type = other RNA
atgaccaagctgggcaaaccctacgggatcggagtggacattggcagcaactccatcgggttcgccgctgtcgatgaaaattctcacctcattagactgaagggaaaaacagttatcggcgcccggctttttgaagaggggaaggcggctgccgaccgcagagccagccggacgacccgcagacggctgtcccgcaacagatggcggctctctttcctgcgcgactttttcgaaagccatattacacctaccgatccgaactttttcatgagacagaaatattccgagatctctcccaaggataagagccggtacaaatatgaaaagcgcctttttaatgacagaacagatgctgagttctacaaatatgagaattgccctaccatgtaccatctgcggaaccgcctcatgacagacccctccaaggccgatgtgagagaaatctattttgctattcaccacatcctgaaaagccggggacatttcctgacccctggcgacgccaaggattttaatacgaacaaggtggcggtcaataaaattttccccgccctccaagacgcttacgcccaggtgtaccctgatctggacatcacctttgacgagaacaaggttaatgagttcaaaacagtgcttctgaacgagaaggctaccccgtctgatacacagagagccctcgtcaatctgcttctggcgaaagagggcgaccgcgatattctcaagcagcaaaaacaggccctgaccgagttcgctaaggccgtggttgggctgaagacgaaactcaacgtggctctgggaacagaagtcgactccagcgaagccaccgcctggaatttttctcttggccagctggatgacaagtggacagggatcgagtccgctatgaccgatgaaggaaccgagattctcgaccagatccgggatctgtatagagcgcgccttctgaacggcatcgtgcccgccgggaaaacactcagccaagctaaggtggacgattacgcccagcaccacgaggacctggaactgttcaaagactatctcaagcagctggaggatgacggaacggccaaggctattcggcagctttacgatagatatatcgacggcgatgacgccaaaccttttgtccgcgaagatttcgttaaggcgctgaccaaagaggtgacagctcatcccaacgccaagtctcctgaactcctggagcggcttgcccaacccgactttatgctgaaacagagaaataaggctaacggcgccattccggtgcagatgcaacagcgcgagctcgatcagatcattaagaatcagtccgtctactatgactggctggctgcccctaaccccgtggaaaaacacagaaagagcatgccttaccaactggatgagctcctgaatttccggatcccctactatgttgggccccttgtgaccgcgaaagaacagaaggccgctcagggaggcgtctttgcctggatggtgcgcaaagaccctgatgggaacatcacaccgtacaatttcgacgagaaggttgaccgggaggcttccgccaacacctttattcagagaatgaagacgacagatacctatctgatcggagaagacgtgctccccaaacaatctctgctgtaccagcggtatgaggtccttaatgaactcaacaatgtgcgcgtcaacaatgagaagctgagcattgaacagaaacagcaagtgatcagagagctgttcgagcggcataactccgttaccattaagcagtttgcggaaaatctcagagcccacggcgattacgctcacatgcctgagatccgcgggctggccgacgaaaaacggttccttagctctctgtccacatatagacagctcaagagcctgctgcccgaggctatcgatgaccctgccaaacaggccgatattgaaaacatcattgcttggtctaccgtgtttgaggacgcggccatcttcaagacaaaacttaaagagattaactggctcgatagccaaacgatcaccaagctgtccaatattcgctacagaggatggggccagttctctcataaatttctgaacggcctcacactggggaatggacacaccatcatccaggaacttttcctgagcaacaataacctcatgcaaattctgacagacgagaccctgcagaagaaaatgacggaacttaatgctgataagctcaaggccgccaacatcaatgacgctattgatgacgtctacacctcccccagcaacaaaaaggccctgcgccaggtgctgcgggttatcgaggacattaaaagagcggctgatggccaggacccgtcttggctctatgtggaaacagccgatgggggaggcacccctgggaagcggacacgcgccagacaacatcagctgcaggagatctacgctaatgccgcgcacgagcttatcgactccgctgtccggggcgaactggaggataaaattgccgacaaggccgattttaacgaccgcctcgtgctgtatttcatgcagggaggcagagatatctacaccgggacgcccctgaatattgaccaacttagctcttatgatatcgaccatattctccctcagtccctgatcaaggacaacagcctggataatcgggtgctcgttcacgctatcattaaccgcgaaaagaacgccacatttgcttccaccatctacgcccagaagatgaatgcgacatggagacagtggcacgaggccggactgatttctggccggaaacttagaaacctgcaaatgcgccccgaccagatcgataagtatgctagcgggttcgtcgcccggcagctcgtggaaaccagacaaattatcaaactgaccgagcagatcgtggctgcccagtaccctgagacaaagattatcgccgtcaaggctggactgtcccatcagcttcgcgaggaactggaatttcccaaaaatcgggacgtgaaccactaccatcacgcgttcgatgcctttctcgctgccagaattggcacgtatctgctcaagcgcttcccgaatctgcaagcctttttcacctacgggaaatttaagaaagctgacgttaagaaacttcggggcttcaacttcatcagagatattacacacgccgaggacaagatcgtggtcaaggataccggagaggtgatttgggacaaaaagcgcgatgttgacgaactggatcggatctataattttaaaagaatgctcatcacacatgaggtgcacttcgaaaaggcggacctgtttaaacagaccgtctacggcgctaaggactctaaggaggccgggggcaaaaagcagctgattagcaaaaagaaaggatatcctgtggatatctacgggggatatacgcaggaaacaggctcctaccttagcgttgtgcggctgaccaagaaggccatgtacgctgtcgtgaaagtgtctacccgcgacgccgcgaagctcgctgtcgccaaatccattagcgagcaaaaggagaacgaaacactgaatgatatcattgacgagaaactctctaagatctccaagaacgggaaaatcacccatgaactgttcgaggttgtgcttcccagagtgggccagaagacactgtttaaaaatagcaagtataacctcttcctggtcaattctgatacgtacatgcacaactatcaggaactgtggatgccccgggagtaccagaaaatgtggaaggacattagcctttccaagtatggagatgcccaaaccgaggaccagctggatcagatctttggcttcattgtgagccaggttaattcttactttaacctctatgacatcaaccaattccgcaaaaagctgaatgatgctgccgacaaatttgctacactccctatgagagataccgacgacatgcaggggaagattgccacaatcggacagctgcttatcggcctgcaagcgaacgccgctcggtccgatctgagaaatctcgacattaaaaccccgctggggcttctgcagatccccaacggaattagcctcgattccgacacgtctgtggtctaccagagccctaccggcctgctcgaacgcgaggtgcatctgtccgatctttga

SEQ ID NO: 4239 - RNA, 4092 nt, synthetic construct
  misc_feature 1..4092: note = Cas9 variant
  source 1..4092: mol_type = other RNA
atgaccaagctgaaccagccctacggcatcgggctcgacattggaagcaattccatcggcttcgccgtggtcgatgctaactctcatctgcttagactgaaaggggagacagccattggagcgcggctctttcgcgaaggccaaagcgctgccgacagacgggagtcccgcacgaccagacggcgcctgtctagaacacggtggcgccttagcttcctgagagactttttcgcccctcacatcaccaagattgatccggactttttcctccggcagaaatattccgaaatctctcccaaggataaagatcgctttaagtacgagaagagactgttcaatgaccggacagatgctgaattttatgaggcctaccctagcatgtatcatctgcgcctcagactgatgaccgacgcttcccaggccgatccccgggagatcttccttgcgattcaccacatcctgaaaagcagagggcattttctcacacctggagccgctaaggacttcaacaccgatgaagttgacctgaaacacatttttcccgcccttgctgaggcctacgctcaggtgtatcctgacctggaactcaatttcgattctgccctggctgacgatttcaaggccaaactgctcgacgaggatgctaagccgtccgacatccaaaaggccctggtgaaccttctgctcagctctgatggcgagaaagaaattgtcaagaaacgcaaacaggtgctgacggagtttgccaaagctatcaccggccttaagacaaaattcaatctggcgctcgggaccgaagttgacgaggccgatgcttccaactggcagtttagcatgggacagctggacgataagtggtctaatattgaaacatccatgaccgaccaaggcacggagatcttcgagcagatccaggaactgtaccgggccagactcctgaacgggattgtgcccgccggaatgagcctttcccaggctaaggtcgccgactacggccaacacaaagaggatctggaactctttaagacatatatcaaaaagctgaatgaccatgagcttgcgaaaaccattcgcgggctgtacgatcggtatatcaacggagacgatgctaagcctttcctcagagaagactttgtgaaggccctgacaaaagaggttaccgcccaccccaatgaggtgtctgaacagctgctcaaccgcatgggccaggctaatttcatgctgaagcaacggaccaaagccaacggcgctattcctgtccagcttcagcagagagagctggatcaaatcatcgccaaccagagcaagtactatgactggctcgcgaaacccaatccggtggaaaagcatcgcgcctccaagccttaccagctggatgagctgcttacatttcggattccctattacgtggggcctctcatcacgcccaaacagcaagctgaaagcggagagaacgtcttcgcctggatggttagaaagaatccctctggcaacattaccccttacaattttgacgagaaagtggatcgcgaagcgtccgccaacacattcatccagcggatgaagaccacagacacctatctgattgatgaggacgtgctgccgaaacagagcctcctgtaccagaagtatgaagtccttaatgagctgaacaatgtgagaatcaacaatgaggcgctctctacggaccaaaagcagcggctgatccgcgaagtttttgagagacacagctccgtgacaattaaacaggtcgccgataacctggtggctcacggggacttcgcccagcggcccgaaatcagaggacttgctgatgagaagcgcttcctctctagcctgtccacctaccatcaactgaaagaaattctccacggcgccatcgacgatcctaccaagctgcatgacattgagaatatcattacatggagcaccgtttttgaggatgccgctatcttcaaaacaaaacttgcggaaatcgactggctggatcccgccacgattaagaagctctctaacatccggtatagagggtggggacagttttcccgcaagctgctggacggccttaaactcggcaatgggcacaccgtgattcaggagctgatgctgagcaaccataacctcatgcaaatcctggctgatgaaacacttaaggagaccatgacagaactgaatcaggacaaactcaagaccgatgacattgaggacgtcatcaacgatgcctacacgtctccttccaataaaaaggccctgagacaggtgctgcgggtcgtggaggacatcaagcacgctgccaacggacaggatcccagctggctttatattgaaaccgcggacggcccggggacagctggaaaacgcacccaatccagacagaagcagatccagacagtttacgccaatgccgctcaagagctcattgattctgccgtgcggggcgaactggaggacaaaatcgcggataaggctagcttcaccgaccgcctggtcctctactttatgcaagggggcagagatatttatacgggagcccctctgaacatcgaccagctttcccactacgatatcgaccatattctgccccagtctctcatcaaagacgatagcctggacaatcgggtgctggttaacgccacaattaatcgcgaaaagaacaatgtgttcgcttccaccctttttgccggcaagatgaaagctacatggagaaagtggcacgaggccgggctgatcagcggacggaaactccgcaacctgatgctcagacctgatgagattgacaagttcgcgaaaggctttgtcgcccggcagctggtggaaaccagacagatcatcaaacttaccgagcagattgctgccgctcaatatcccaatacaaagatcattgccgtgaaggccgggctgtctcatcagctccgcgaggaactggatttccctaagaaccgggacgttaatcactaccaccatgcttttgatgcgttcctggccgctagaatcggaacgtatcttctgaaacgctaccccaagctcaccccgtttttcacatatggcgagttcgccaaagtcgacgtgaagaaatttcgggagttcaactttattggggccctgacccacgctaagaagaacatcattgccaaagatacaggcgaaatcgtgtgggacaaggaaagagatatccaggagctcgaccgcatttacaatttcaaacggatgctgatcacccatgaagtccactttgatatggcggaccttttcgaccagacgatttacgctgccaaggattccaaagagagaggaggcagcaagaacctgatccaaaagaaacaggggtatctcacaggaatttacggcgggtattctaccgagcgcggatcctacgtgagcatcatccggacctttaagaaaggcgcccctatttataatatcgttaacatttctacagctgacgtgagcctgctgtccgataagcagagagtcagcgaagcctctgcggacgtgcttctgaaagagctcatcaagaagaaactggctaagcggaaatccggggaaaataccaagagcggcgccttcgagattgttctcccccgcgtgggaaagaacacactgtttaagaataagaaatacggccttttcctggtcgaatccacgaccgagtttcataactatcaggagctgtggctccccagaaatgatcaaatgctgatcaagtctatccagagccacaaaattgaagagtccaaggccgactacgaacttacacggatgtaccgcaacatcgcttctcaggtggatcactatttcgggctgtacaccattagaaaattcagcgagaagctcacagcctccatcaatgactatggagctctgcctgtttacaagtctgaaaccacggatggcaaatatgaggtgctcagcaacctgtttgaggggcttggatccggcaccagcacagggaatctgaccgccgtcaagctgcagccgaacttcggccgggtgtacctcacatctggaattgtgctggaagacgatacctccatcatttatcaaagccccacaggcctttttgagagatctgtcaaactggcggacctctga

SEQ ID NO: 4240 - RNA, 4092 nt, synthetic construct
  misc_feature 1..4092: note = Cas9 variant
  source 1..4092: mol_type = other RNA
atgaccaagctgaaccagccctacggcatcgggctcgacattggaagcaattccatcggcttcgccgtggtcgatgctaactctcatctgcttagactgaaaggggagacagccattggagcgcggctctttcgcgaaggccaaagcgctgccgacagacgggggtcccgcacgaccagacggcgcctgtctagaacacggtggcgccttagcttcctgagagatttcttcgcccctcacatcaccaagattgacccggactttttcctccggcagaaatattccgagatctctcccaaggataaagatcgctttaagtacgaaaagagactgttcaatgaccggacagatgctgagttttatgaagactaccctagcatgtatcatctgcgcctccacctgatgacccacacacataaagccgatcccagagagatcttccttgctattcaccacatcctgaagtcccggggacattttctcacccctggcgccgcgaaagacttcaacacggataaggttgacctggaggacatttttcccgcccttaccgaggcttacgcccaggtgtatcctgatctggagctcacattcgacctggctaaagccgatgacttcaaggcgaagctgctcgatgaacaggccaccccgagcgacacacaaaaagctctggtgaatcttctgctctcttccgatggcgagaaggagatcgtcaaaaagagaaaacaggtgctgaccgaatttgccaaggctattacggggcttaaaacaaagttcaacctggccctcggaaccgaggttgacgaagccgatgctagcaattggcagttttctatgggccagctggacgataagtggtccaacatcgagacaagcatgaccgaccaagggaccgaaattttcgagcagatccaggagctgtaccgcgcgcggctcctgaatggaatcgtgcccgccggcatgtctctttcccaggctaaagtcgccgactacgggcaacacaaggaagatctggagctctttaaaacatatctgaagaaacttaacgaccatgaactggccaagacgattagaggactctacgatcgctatatcaatggcgacgatgctaagcctttcctgcgggaggactttgtgaaagccctgaccaaggaagttacagcgcaccccaacgaggtgagcgagcagctcctgaatagaatgggccaggctaacttcatgcttaaacaacgcaccaaggccaatggggccattcctatccagctgcagcagcgggaactcgatcaaattatcgctaaccagtccaaatactatgactggctggccgctcccaacccggtcgaggcccacagatggaagatgccttaccagctggatgaacttctcaattttcatatcccctattacgtgggacctctgattacacccaagcagcaagcggagtctggcgaaaacgtgttcgcctggatggtccgcaaagaccccagcgggaatatcaccccttacaactttgatgagaaggttgaccgggaggcttccgccaatacgttcattcagagaatgaaaacaaccgatacctatctgatcggagaagacgtgctcccgaagcagagcctgctttaccagaaatatgaggtgctgaacgaactcaataacgtccgcattaataacgagtgcctgggcacagaccaaaagcagcggctgatcagagaggtgtttgaacggcactcttccgttaccatcaaacaggtggctgataatcttgtcgcccatggggacttcgcgcgcagacccgagattcggggactcgccgatgaaaagagattcctgagctctctgagcacataccaccagctcaaggagatcctgcatgaagctattgacgatcctacgaaacttctggacatcgagaacattatcacctggtccacagtgtttgaggatcacaccattttcgaaacaaagctcgccgagatcgaatggctggaccccaaaaagatcaatgagctgtctggcattcgctatcggggctgggggcaatttagcagaaaacttctcgatggactgaagctgggcaacgggcacaccgttatccaggaactcatgctgtccaatcataaccttatgcagattctggctgacgagacgctcaaggagaccatgacagaactgaaccaagataaactgaagaccgacgatatcgaggacgtgattaatgacgcctacacaagcccttctaacaaaaaggcccttcgccaggtcctcagagtggtcgaagatatcaaacacgctgcgaatggacaggacccctcctggctgttcatcgagaccgccgatggcacggggacagctggcaagcggacccagagccgccaaaagcagattcagacagtgtatgccaacgccgctcaggaactgatcgactctgccgttagaggagagctcgaggataaaattgcggacaaggcttcctttaccgatcggctggtgctttacttcatgcaaggcgggcgcgacatctacaccggagccccgctgaatattgatcagctcagccattatgacatcgatcacatcctgcctcagtccctgattaaagacgactctcttgataacagagtcctggtgaatgccacaatcaaccgggaaaagaataacgtttttgctagcacgctctttgccggcaaaatgaaggcgacctggcgcaagtggcacgaggctgggctgatttccggaagaaaactccggaatctgatgcttcgccccgacgaaatcgataagtttgccaaaggcttcgtggccagacagctggtcgagacacggcaaattatcaagctcaccgagcagatcgctgccgctcagtaccctaacacaaaaattatcgccgtgaaggcggggctgtctcatcaactgagagaagaacttgactttcccaagaatcgcgatgtgaaccactatcatcacgccttcgacgcttttctggccgctcggattggcacctacctcctgaaaagatatcctaagctcgcccccttcttcacgtacggagaatttgccaaagttgatgtcaagaaattccgcgagtttaatttcatcggcgctctgacacatgcgaagaaaaacattatcgccaaggacaccggggaaattgtgtgggataaggagcgggacatcagagagcttgatcgcatctataactttaaacggatgctgattacccacgaagtgtacttcgagacagctgacctctttaagcagaccatctacgccgccaaagatagcaaggaaagaggaggctccaaacagctgattccgaagaagcaggggtatcctacacaagtctacggaggctatacgcaggagagcgggtcttacaatgctctggtgcgcgttgccgaagcggacaccacagcttatcaggtgatcaaaatttccgcccagaacgccagcaagatcgcttctgccaatcttaaatcccgggagaagggcaaacaactgctcaacgagatcgtcgtgaagcagctggcgaagagacggaaaaattggaagcccagcgctaactctttcaaaattgttatcccccgctttggaatgggcaccctcttccagaatgccaagtacgggctgtttatggtgaacagcgacacatattacagaaattaccaggaactttggctgtcccgggagaaccaaaaactgctcaagaagctgttcagcattaaatatgaaaagacccagatgaatcacgatgcccttcaggtctacaaagctatcattgaccaggtggagaagttctttaaactgtatgatatcaaccaattccgcgccaagctctctgacgctatcgaaagatttgagaagctgcctattaatacggatggaaacaaaatcggcaagaccgagacactccggcagattctgatcgggcttcaggccaatggaaccagatccaacgttaaaaacctgggcattaagacagacctggggctcctgcaagtgggcagcggaatcaaacttgataaggacacccagattgtctaccagtccccgtctggcctgttcaaacgccggatccccctcgcggatctgtga

SEQ ID NO: 4241 - RNA, 4095 nt, synthetic construct
  misc_feature 1..4095: note = Cas9 variant
  source 1..4095: mol_type = other RNA
atgggcgacagaaagtacaacctggggctcgatatcggaaccagctccattggcttcgccgctgtggacgagaataaccagcccatccgggtcaaagggaagacagccattggagttcgcctgtttgaagagggcaaaacggcggctgatagacgggggttccgcaccacaagacggcgcctttctagacggcgctggagaatcaatctgctcaacgaaatttttgacgcccacctggccgaggtggatcctaccttccttgctcggctgaaggaaagcaatcgctccaacctcgacccgaaaaagtcttttcaaggaagcctgctgttccccgagagaaaggattatcagttttacgaggaatatcctacaatctaccatctccggaaagccctgatggagaaggaccgcaaattcgattttagagaaatctatcttgctgtgcaccatattatcaagtaccggggcaatttcctgaacggcacccccatgagatcctttaaagtcgagaatattgagctcgacacactgttcgatcagcttaaccagctgtatgccgaaatcgtgcctgacaatgagctcgcgtttgatctggcccaagttgctgacgtgaaggacgtcctgtctagcaccacgatttacaagatggataaaaagaaacagctcgtgaagatgatgctgcttcccgcctccaacaaagctctgcagagcgaaaataagaaaatcgttacccagttcgtgaacgccattctcaattacaagttcaagctggacgtccttctgcaagtggagacagatgcggactggtctctcaaactgaacgatgaaggggccgacgataagctggaggagtttaccggagacctcgatgaaaaccgcctggagatcatcgaccttctgcagcggctccacaattggttctccctgaacgaaattacaaaagatggcaatagcctttctgctgccatggtggagaagtatgaaaaccatcaccaccatctggggctcctgaaaaaggtcatcgagaatcaccctgacgctaagaaagccaaggccctgaaagagacctacacggcttatgttggaaagacagacgataaaacccagaaccaggacgatttttacaaggcggtggaaaagaatctcgacgattccccggacgccaaagagattaagagactgatccaacttgatcagttcatgcccaaacagcgcacaggccaaaacggggctattcctcatcagctgcaccagcaggaactcgaccaaatcatcgagaagcagagcaaatattacccctttctggccgaacctaatcccaacgtgaagcggagaaaggatgccccgtataaactggacgagcttattgctttcaagatcccttactacgtcggacccctcgtgacccctgaggaacaggcccagaatggcgagaacgtttttgcgtggatgaaacgcaaggctgccggccccattaccccctggaatttcgatgaaaaagtggaccggatggagtctgccaacagatttatccgccggatgacaacgaaggatacctatctgttcggggaggacgtcctgcctgctgaatccatgatttaccaaaaatttgtggttctcaatgagctgaacaaccttaagatcaatggaagacacctgagcctcaaggacaaacaggatgtgtataacgacctgttcaagcagcagaaaacagtctccatcaaggccctgcaaaattactatgtgaccaaaaagaaggctgccacagcgccgaccgtcggcgggcttgccgatcccaaaaagtttctctctagcctgtccacgtacattgacttcaaaaacatgttcggagaacgcgtgaatgatcctcagtttcaggaggacctggaacagatcgttgagtggagcacaattttcgaggatcggggcatctttaaggctaaactccaagccctggggtggctttctgaaaagcagattcagcaactggtggctaagagatataaaggatggggccggctctccaagaaactgctgaccggccttaagaacgccgaggggtacagcatcctcgacgaaatgtggcgctctaccggaaatttcatgcagattcagagcagacccgagtttgcggccctgatccagcaagctaacgaaaaacagttcgagggcaatgatcctgacaacgtctgggagaatatcgaaaacattctgggggatgcctacacatctccccagaataagaaggctatcagacaggtggttaaagtggtccaagacattgagaaggccgtgggaaacccgcctgaaaagatcgccattgagtttacccgggaagctgcggccaatccccagcgcacacagtcccggctcagaacgctggagaaactttatgagagcgctgaagaggtggttgatgccggcctgaccgccgaactcgctgagttcaaagagaacaagcatgtcctgtccgacaaatactatctgtactttacacagcttgggcgcgacgtgtataccggcgatacaatcagcctcgacaagctgaacgattacgacgtggatcacatcctgcctcaatctttcattaaggacgattccctcgacaatagagtcctgaccatccgggccgtgaacaatggaaaaagcgataacgttcccgcgaagatgtttggcaaaaagatggggtctttctggcgctatcttctggacaatggaatgatttccaaaagaaagtacaacaatctcatcacggatcctgacaacattagcaagtacgctcagaaaggctttatcaatcggcagctggtggaaacctcccaagtcatcaagctgacagccaacattcttaatgggatctatgacaaagataccgagattatcgaagtgcccgccaagatgaactctcagatgcgcaaaatgttcgacctggttaaggtgagagaggtcaatgattaccatcacgctttcgacgcctatctcacaatttttatcggaaactacctgtataagtgctacccgaaactccagccttatttcgtgtacgataattttaagaaattcggcaacaaggaagacatcgggcataaacggtttaacttcctgggcaagattgagcgcgagaagaaagttgtggcgcccgaaaccggagagatcctttggagcaatgtcgctcccaacgaaacgattaagcagatcaaaaaggtgtacgattataaatttatgattgtgtccagagagatcacaacccggcgcgccgaactgttcaatcaaacagtctaccctaagaactatcacggcaagctcattccgatcaaagaggacagacccaccgatctgtacgggggatattctggcaataccgacgcctacctggctatcgttgcccttgaggataagaaaaaggggaaatattttaaggtggtgggcattcctacacgggtcgctgccaaactggaaaagctcaagcagcaggacagccagcaatacctgcaggcgctccacaaagtgatcgctccccagttcacgaagtccaccaaaaagggaattaaaaagacagagtttgaaatcgttctggataaggtgcattacagacagcttgtccaagacgggcctgtgaaaatgatgctgggcagctctacctataagtacaacgccaaacagctcgttctgtccgagaaggcccttcaggtgattgctgacgatcgcaaattcgacgaaacacagaaggatgacaatctgatcgccgtctatgatgagatcctgagcattgtgaaccaatctttcgacctctacgatatcaatggatttcggaagaaactgaacgacaatagagatcagttcattgacctccccgccgagaccaagtatgaaggccgcaaagttgtggctcacgggaagcgggagatgatcctggaaattcttaaaggactgcatgcgaacgccgcttttggcaatctgaagcctatcgggttctccacggcctttggacagctccaagtccccaacggcatcattctgagcaagaatgccatccttattcaccagtctccgagcgggctgttcgagagaaaaatcaagctctccgatctgtga

SEQ ID NO: 4242 - RNA, 4095 nt, synthetic construct
  misc_feature 1..4095: note = Cas9 variant
  source 1..4095: mol_type = other RNA
atggagaagcaggaatactatctgggcctcgacatggggatcagctccgtgggatgggccgtcaccaacgataaatacgagctgcttagaaagaaaggcaaggacatgtgggggattcgggagttcgaggaagctgattctagcgccgagcgcagaacacaccgggttaatcgcagacggcgccaaagacaggtggcgcggatgggactgctcaaagagtatttttccgacgctatcgaaaaggtggattctaacttctttattcgcatcgagaatagcaagtacttctttgaagacaaagatggcagactgtcctctaagaacgggattttcgacgatgccgactataaagatgtcgactactatacggagtaccccaccatctttcatcttcggaaggccctgctcgatatcgaggacacaggaaaagaatacgacgtgcgcctggtttatctggctctcgtgaatatgttcaagcacagaggccattttctgcttaacaccgagggcgatgccctgagctccgaacaggtcaatacaacctaccaggagctcctggaaattcttgagaacaattatgacatcagcctggagtctcgggatattaaggacgtgatcgatattatctccagctctgacaacgggcgcaaaaagaaacacgaacaaattctcgagctgttcggagttaagaaatccgataagagagctaatgaactgctcaaatgcctgtgtggccttagcgtgaacgccaagctgatctttgacgagaattacgaagagaaggtcgatctctgcttccatgacttttcttatacagataaaatccctgacctgatggagaaactttccgaagaggaatactatgtggtggagcagctgaaaagcatttacgactactccatcctcgcggggaccctgaagggatatgattacctgtcttgtgcccgggtcgaactctatgagaaacacagagaggacctgaaacttctgaaggctctctaccgccggtataagacgaacgaagagtacaatgatatgttcaagagcgacaaagaaggcacctattccgcctacgttaacagcttcaactcttccgatagctctgtgaagattaaaaagtacagatggaatatgaaggggcgcacaatcgacaacctgtatggaaccattaaaaaggcttttaaagataatacagacgataaggacgtgcagagcatgatggagtccatcgataaagagcagttccttccgaagcaactgaccggcgccaacggcgtcatccccaatcaggtgcacaagaaagaaatggagcggattctcaagaaagcgcagaactacctgccttttctgaaggaaaaagacgagtctgaactcacggttagcgagagaatcctgcgccttttcacatttcagattccctattacgtggggcctctgggagaaaattccaagaccggctgggtcgtgcggagagaagggggacgcgttctcccctggaacatcgatgagaaaattgacatgagcgccacatctgaggctttcatcggcaatctgatccggaagtgcacctatctgtccgacgaaaaggtgatgcctaaagccagcctttcttacgaaagatattgtgtcctcaacgagattaataacatctgcattgatggggagcgcctggacaccgaactgaagcaaaagatctacacagagtgttttatgaagggaaaacgggtgacgagaaagcagatttgcaattacctcgtcgctcagggctgtatcaagtccgatgaacaagtgaccggcattgacatcaacgttaatagctccctgtctagctatgggaaaatgttcgccatctttggagagcatcttaaggaagatgccattcggaaagtggctgaggagatcatttactggggcacaatcttctccgactctaagaaaatgtttcgcaagcacctgaccaagtatgtcgaacaggggattctcggagagagccaggtgaaaagaatcctgggctacaagttcaaagattgggggcggttttccaaggcgctgcttacactccagggcatcgacaaaagcaccggagaactgctgtctctcgagaacgccatgtgggagtattccctgaacttcatggaacttattaatagcgatgacttcacgtttaaggatgagctggctaacagacgcacatctgccatcaagtccctcagcgagttcacctacgaagacctggaagatacctatttttctgttccggtgaaacggatgatttggcaaacaatcctggtcgtgagagagattgagcagatcatgggctacgcccccaagaaagtgttcgttgaaatggctcgcagcgaggaagagaagggggacaaaggaagaaaggactcccggggcacccagcttctcgaactgtacaaaaatatcaagaacacagagaatcatgattggaagaaagagattagcgaagccaacgagtctgggaagctgcgctccaaaaagctctatctgtactatacgcagatgggaagagacatgtacaccggcgaagagatcaatattgatatgctttatgacgatagcatgtacgacatcgatcacatttatcctcggcactacgtcaaagacgattccatcgtgaacaatctggtgctcgtcaaccgcagagcgaatcaagacatcaagaaggatctgtaccccattcctgacaaaatcatttctaaccccaaggtgcaggaactgtggaaaatgcttcataagcagaatctcatcacagacgagaaatataagcggctgatgagccgctccccgtttaccgagaagcagctgggggatttcattgctagacaactcgttgaaacacggcagggcaccaaaggaatcgccgagctgcttggccagctgtttaaggacacggaaattgtgtacgccaaagctaccaacgtctctgatttccgcagagacaatgggtttgttaagagccggctcgtgaacgatttccaccatgcccaggacgcttatctgaacatcgtggtcggaaatgtgtactatacaaaatttaccaagaacccttggaatttcatcaagaaagattttgacaaggatagaaacaaaaatggctacaacctggccaagatgttcgaccgcgatgttgtgagaggggacgatacagcgtggattgcctccaaaaaggacacccaaggaacgatcgagacagtccggaagatgatgcgcaaaaatacaccccttatgacccggatgtctttcgagcagcacggcgggattgctaacgccaccctgtatagcgctaagaaagccaaggtggaaaattacatccctctcaaatccagcgacattagactgtctgatgtgaagaaatacggcggatttacctccgcgacagtcgcctattacttcatcgttcatcacaaggagggcaagaaagaaaacacgaccatcgaggctctccccctgtattgcaagcgcaaagtggaaaatgaggagaacgggcttctgaagtactgtgaagaggtgctcggatatggcgacgtcaaaattctgtttaataagctgaagatccagagccttctggatattaacgggtaccaagcccacctctctggaaaaacaggcaatcagctgaccctccggaacgctatgaacctgtgcgtgcccgaaaagtggacagcctatatcaaaaagctggagaaacttgttgtggggcatgtcaaggaacaggagatttccagcgaggccaatatcgaactctacgacctgctgaccgataagcaccttaactctgtgtacgctaaaagacctaatgcgtatggccagaagctgatcgacaaccgctcccggttcgttaatctcaaaccggagagccaatgcgaagccattctgcagatcctcaagctgacgaaaattggaaacaatgagacaaaccttaagctgatcggcgaatccgagcatagcgggaagatgctgatttctaaaaatctcaaggataccgacaaacccgctatcatttgtcagagcgtgaccggactgtacgagagaaagatctatatctttgatgaacagcttgacaaatga

SEQ ID NO: 4243 - RNA, 4095 nt, synthetic construct
  misc_feature 1..4095: note = Cas9 variant
  source 1..4095: mol_type = other RNA
atgaacaagagatacaatatcggcctggacattgggaccaacagcatcggatggtccgtggtcaatgatcagtctcaactcgttcggattaaaggcaagctggggtatggagtgcgcctttacgacgagggccagacagccgaagatagacggctgttccgcacgaccagacggcgcctcaaaagacggaagtggcgcctggggcttctgagagagatctttgaaccctatattacacctcaggacgctaccttctttctccggcagaaacaaagcaacctgtccccgaaggatctgcagaagcagcagccccaaatcggactcttcaatgaccgcctggattctgactttcactaccagtatcctacaatctaccatcttagatatgccctgatgaccgagaaacggcagttcgatctccgcgaaatttacctggcgatgcaccatatcgtgaagtacagaggccactttcttaacgctgccgccgctagctccttcaaatctggcgagattgacctggccaaggattttgctgccctcaatcagatcttcgggacaatttttagcgaggtcggattctccctgagcgaatctaacctggacgagatcaaatccattctcctggataataaccttagcgcgtctgtgcggcaaagaaaggccctgcccctcatctatcagaccgctgcctccaaggacagcgaaaaacagtacaaggctatcgccacggagctgcttaaagcgattctgggcctcaaggccaaatttaatctgatcaccgggattgaggttgaagacgtgaaggcttggacactgtctttcaacgccgaggatttcgacgctaaactctccgatctgaatatcgccgacaacgatgacgccgtccaaattatcgaaatccttcgcgctctgtatagcggagtgctcctgaccggcattgttcctgaggggcagtccatctctcaggcgatgattgataagtacgaagcccataaggctcaccttatcatgctgcggagcattagagagcagctctccgacaaagagaataaggccctggaaaaagcctatgatgactacatcgatcaccccgaggacaagcaacatggaagccgcgaagacttttatgctgccatcacaaaagtgctgaagaaggattctgaggacaccaacattatcgaaattctcaaactgatcgagcttgatcagttcatgcctaagcagcggacgaaagacaacggcgcgattccgcaccagctgcatcaacaggagctcgatcagatcattgaaaatcagaagcaatactacccctggctggctgacatcaaccctaatgagcagagacagaaaatggccccctataagctggatgaacttgtcacatttcgcgtgccttactatgtgggccccatgatcaccgccgaggaacagttccaaacatccaacaagaaatttgcttggatgattcggaaggagccgggggccatcaccccttggaatttcgaccagaaagtcgatagacaggctagcgccaacgagtttattaagcgcatgaccacaacggacacctacctcctggcggaagatgttctgcccaaacaatctctcctgtatcagcggttcgaggtgcttaatgaactgaacggaatcaagattgacgatcagcctatcacagtggagcagaagcaagccatctttaatgacaaattcatgcagcaggctcacgtcaccgtgaagaacattcaggcctacctcgttagcgagggccaatatgcttccagacccaatatcacagggctgtctgacggagaaaaatttaacagctccctgagcacctaccacgatcttaagaaaattttcggcgacatgatcgatgaccccaataagcagacggattttgagaaaatgattgaatggtctacaatcttcgaggacgggaagatcttcgccgataagctccgcgaaattaactggctgaccgacgagcagcggcagagactgtccaataaacggtaccgcggatggggccaactcagcaccaagctgcttacaaaaatcgtggatcagaacggccagagaattatcgacattctgtggaacaccaatgataactttatgcggatcatccattctgacgatttcgaccaagcggtcacacaggccaatcagatgctcctggctgacaacgatacgcaggacgtgattaatgagctgtatacctcccctagcaacaagaaagcccttagacaaatcctcctggttgtggctgatattcagaaggccatgaaggggcaggccccggctcgcatcctgattgaatttgcgcgggagaaacaggccaatcccagactctccacacaacgcagacggcaggtcgaacaggtgtaccaggagctgaacaatgaccaacttaacaaggaactggctgatcctcagtatgccaatctctctaaagaccgcctgttcctgtactttatgcagggaggcagagatatgtataccggggagagccttaacatcgaccggctctccgagtacgatattgaccacatcctgccccaggccttcatcaaggataattctctggacaaccgcgtcctcgtgagcgctaaaatgaatagatccaagagcgaccatgttcctctggattttacagaggaacggttcggacaaaagatgcgctctcagtgggaacagatgcttagagccggcctgctcacccggcgcaaatataacaacctgacgctgaatcccgactcccttaacaagtacaccatgagcgggtttattaatagacaactggtggagacacggcaggtcatcaaactcgcgaccaacctgctcgtggatcagtacgctgacgaagatgttcagctggtgacagtcaagtctggccttacccaccaaatgagagaggacttcgattttccgaaaaatcgcaacctgaataactatcatcacgccttcgacgcctacctcacggcttttgtgggactgtatctgcttaagaagtaccctaaactggcccactatttcgtgtacggccagtatcagcaggggttcaaggcgaatgatcaatggcggaactttaatttcctcaacggactgagacaggagcagcaggttgacgctgaaacaggcgagctcatttggcaaaaagatcatgacctggcctacatgaataagatctacgattttaaaaagattcttgtcacccgcgaagtgcacacaaaccatggggccctgtataatcagaccctctacaaagctaaggacgacaaggcctccggacagggcgggcggcaactgatcgctgccaaagagaacagacccaccgcgatctatggcggatacagcggcaagacagtggcctatatgtgcctggtccgcattacggagaaaaagggggatttctaccggatctgtggagtgcagaccgcttgggttgacgaacttgagcacattgaagatgccacaatcaaactgcagagactcaccgctctgctcacacctcagttttctgccaccaagaagcaaaaagacgaggtggtcacggtggttaagcccttcgaagtgctgcttcctaaaattctgatcaaccagcgcttttatgatggcgggcaggagctgacactcgccagcgctacctacaagaataacgcgcaggagctggtccttgacaaaaaggccgtgcaagttctgaatggacagctccccaaggctgaactggaggcccaggccaccgtggtctacgatcagatcctcgaacgggtgcaaaaatatttcccgctgtacgacatgaactcctttagagagaaacttttcgtgggccgggataaatttaatgaactgccttggcaggaccagtgggagaaccacaagctgattcaggtcgggcaaaagacaatcctcgatcgcattctgatcggccttcatgctaatgccgcgatgggagacctgaaggctctcaacatgagcacccccttcggcaagctgcagaaatctaatgggatttccctcagccccgagacacagatcatttatcaatcccctacgggactgttcgaaagacgggttgcccttaaggatctgtga

SEQ ID NO: 4244 - RNA, 4095 nt, synthetic construct
  misc_feature 1..4095: note = Cas9 variant
  source 1..4095: mol_type = other RNA
atgaagaacctgaaagagtactatatcggcctcgacattgggaccgccagcgtgggatgggctgtcacagatgaatcctacaatatccccaagttcaacggcaaaaagatgtggggagttagactgtttgacgatgccaaaacggcggaggaacggcgcacccagagagggtctcggcgcagacttaatcggcgcaaggagagaattaacctgctccaagacctgttcgctacagaaatcagcaaggtggatcctaatttcttccttcggctggacaactccgatctctatcgcgaggacaaagatgagaagctgaaatctaagtacaccctgtttaatgacaaagatttcaaggacagagattatcacaagaaatacccgacaattcatcacctcatcatggacctgatcgaagacgagggcaagaaagatattcggcttctgtatctcgcctgccattacctgcttaagaaccgcgggcactttatcttcgaaggacagaaatttgacaccaagaatagcttcgataaatccattaacgacctgaagatccatctcagagatgagtacaatattgacctggagtttaacaatgaagatctgatcgagattatcacagacaccacgctcaacaagaccaataaaaagaaagaactgaagaacatcgtgggcgatacaaaattccttaaggccatttctgctatcatgattggcagctcccagaagctggtcgacctctttgaggatggggaatttgaggagaccacagtgaaaagcgttgacttctctaccacggcctttgacgataagtattccgaatacgaggaagctctgggagacacaatcagccttctgaacattctcaaatctatctatgattccagcatcctggagaatctgctcaaggacgccgataaatctaaggacggcaacaagtacatttccaaagcgttcgtgaagaaatttaataagcacgggaaagatctgaagacccttaagcggatcattaaaaagtatctgcccagcgaatacgccaacatcttccgcaataaatccattaacgacaattatgtcgcttacacaaagtctaacatcaccagcaataaaagaaccaaggcctccaaatttacaaagcaggaggatttctacaagtttatcaaaaagcacctcgacacgattaaagagaccaagctgaacagctctgaaaatgaggatcttaaactgatcgacgaaatgctcacagatattgagttcaagacctttatccctaagctgaaatccagcgacaacggagtgattccctatcaactgaagctcatggaactgaaaaagatccttgacaatcagtctaaatactatgatttcctgaacgagagcgacgagtacggcacagttaaggataaggtggaatccattatggagtttcggatcccttattacgtcgggcccctcaatcctgactctaaatatgcttggatcaagagagaaaacaccaaaattacgccgtggaacttcaaggatatcgtggacctggatagctcccgcgaggagtttattgaccggctgatcggaagatgtacataccttaaagaagagaaggtgctccccaaggccagcctgatttacaatgagttcatggtcctgaacgagctcaataacctgaaacttaatgagttcctgatcaccgaggagatgaagaaagcgatctttgaagaactcttcaagaccaaaaagaaagttacactgaaggccgtgtctaacctgcttaagaaagaatttaatctcaccggcgatattctgctgtccggcacagacggggatttcaagcagggactcaacagctatatcgactttaaaaatattatcggcgataaggtggaccgcgacgattaccggattaaaatcgaggaaatcattaagctgatcgtcctttatgaggacgataagacgtacctgaaaaagaaaattaagtctgcttataaaaacgacttcaccgatgacgagatcaagaagattgccgctctcaattacaaagattgggggagactgtccaagcgctttctgacaggaatcgaaggcgtggacaaaaccacaggggagaagggaagcatcatttatttcatgcgggaatacaaccttaatctcatggagctgatgtccggccattacacctttacggaagaggttgagaaactgaaccctgtggaaaatagagagctctgctatgaaatggtcgatgagctgtacctttctcccagcgtgaagcgcatgctgtggcagtccctccgggttgtggacgagatcaagagaattatcggcaaagatcctaagaaaattttcatcgaaatggcccgcgccaaggaggctaaaaactctcggaaggaaagcagaaagaacaaactgctggagttttataagttcgggaaaaaggcgtttattaatgaaatcggagaggagcggtacaactatcttctcaatgaaatcaactccgaggaagagagcaaattccgctgggacaatctgtacctgtattacacccaactcggcagatgtatgtactctctggaacccattgaccttgccgatctgaagtccaacaatatctatgaccaggatcacatttacccgaaaagcaagatctatgacgattctctcgagaaccgggtcctggtgaagaaaaatctgaaccatgagaaggggaatcagtaccctattcccgaaaaagtccttaacaagaatgcttatggattctggaaaatcctgtttgacaagggcctcatcgggcagaagaaatacacaagactgacccgccggacacctttcgaggaaagagagctcgccgaatttattgagcgccaaatcgtggagaccagacaggccacgaaggaaacagctaacctgcttaaaaatatttgccaggattccgagatcgtttatagcaaggccgaaaacgcgtctcggttccgccaagagtttgacattatcaaatgtagaaccgtgaacgatctgcaccacatgcatgacgcttacctcaatatcgtcgtgggcaacgtttacaatacaaagttcaccaagaaccccctgaattttattaaagataaggacaacgtgcggagctataatctggagaacatgttcaaatacgatgtcgtgcgcggatcctataccgcctggatcgccgacgacagcgaaggcaatgtgaaggctgccacaattaaaaaggttaagagagagcttgaagggaaaaactaccggtttacgcgcatgtcttatatcggaaccggcgggctgtacgatcagaatctcatgagaaagggaaaaggccagattccccagaaggagaacacaaataaatccaacatcgaaaagtatgggggctacaataaagctagctccgcctacttcgcgctgattgagtctgacggaaaggccggccgggagcgcaccctcgaaacaatccctatcatggtctataaccaagagaagtacgggaataccgaagctgtggataaatatctgaaggacaaccttgagctgcaggatccgaaaattctcaaggacaaaatcaagattaacagcctgatcaagctggatggatttctttacaatattaaaggcaagacgggggactccctgtctatcgccggaagcgtgcagctcatcgtcaacaaagaagaacagaagctgattaaaaagatggataagttcctcgtgaaaaagaaagacaataaggatatcaaagttacatccttcgacaacattaaggaggaggaactgatcaaactttataagaccctgtctgataagctgaataacggcatttacagcaataaaagaaacaatcaagctaagaacatctccgaagccctcgacaaatttaaggagatcagcattgaagagaaaatcgacgtgctgaatcagattatccttctgttccagtcttataacaatgggtgcaacctcaagtccattggcctgagcgcgaagaccggagtcgtgtttatccccaaaaagctcaattacaaagagtgtaagctgattaaccagtctatcacaggccttttcgaaaacgaggttgatctgctgaatctctga

SEQ ID NO: 4245 - RNA, 4098 nt, synthetic construct
  misc_feature 1..4098: note = Cas9 variant
  source 1..4098: mol_type = other RNA
atgtacaagaaagactataccgtgggcctggatatcgggagcacatccgtcggattcgccgctattgacgatgactaccagcccatcagactcaagggcaaacgggttattggggtgcgcctgtttgaggaaggaaagacggccgcggagagacggaacttccgcaccacaagacggcgccttaatagacggaaatggcgcctgtctctcctggaagagatctttgatccttatatggctaaggtggacccgaccttctttgccagacttaagcaaagcaacctgttccccaaagataagaataaaaagtttacaggctccctcctgttccctaaaaccacagactctaagttttacgatgaatatcccaccatttaccaccttcggtatcatctcatgaacgacagccgcaagttcgatctgagagagatctttcttgccatccaccatattgtcaaataccgggggaatttcctgaactccgctcctatcgcctcttttagcacggacaagattaatctcgtggatgacttcgagaccgttaacgctgcctacctgcagatcaattccagcaaccccgtgcagcttgacacagatcaggcggaccaagtctctcgcattctgctcgataataaactgtccaacctggacaagcagaaacaggccgctaaggccctcgctcagaaaagcggagataagaagcaagacaaaatcaataacaccacaattaagcagatctgcaaagccctgcttggctataagttcgatctggcggtggttctcaatatcgactctgatgaccacaacaaatggaagctgcagctttccgatgaaaacattgacagcagactggccgagctcaccggcgaactgaatgaggctcagctggacatcctcaacgtgctgtctcggctttactcccaaattacgctgaatgatatcgtccctagcgggatgacactctccgaggccatgattgaaaagtataaagctcataagaaacacctgaagatgcttaaagactttgccagatctctgagcaagaaggattacggacaggtgatggaggcctatgctgaatacatcggcaacatcccggagtccgcgagctctaaagcccagaagaaaatttcccaagacgatttctataagaaaatcaagcgctacctcgacgatagcaagctggggcagaaaattgctgaactgatcgccaagaatgagtttatgcccaaacagcggaccaaccagaatggagtgattccttaccaactccacctgaaggagcttaaccagatcatcgaaaatcagtctaaatattacccctggctggccgagctcaaccctaatgaaaagagacgcggcaaagctaagtataagctgagcgagctggtcgccttccggattccctactatgttgggccgcttatcacacaggaggagcaacagaaaacctccaacgcgaattttgcttggatgattagaaagtctgagggacgcatcaccccttggaacttcgacgaaaaagtggatcggattgccacagccaatagatttatcaagcgcatgacgaccaaagacacatacctcattggcgaggatgtgctgcccgctcatagcctgctctatgaacggttcaaggtcctgaacgagcttaacatgatcagagtgaataaccaccgcctgtccgttggccagaagcaggacgtgtttgaaaaactcttccaaaagcataaaaccgtcaagacacgggagctgatcaaacagctgatggccagcgggcttcctacccagcccagaattacgggactctctgatcccgctaagtttaatacatccctgggcacctacaacaatttcgccaagatcctgggggacgagattaaccagcctgaccggcaagaagattttgagaaaatcattgaatggatcaccatcttcgacgataaggacattctcaaaacaaagctgagcgagctttcttggctggatgagaaacagatcaatgcgctcattaacaagaattactccggatggggccgcctgagcagaaagctgcttaccgaactcacaaacaaaaaggggcagtccatcattgaccggatgtggaatacgcaaaaatctttcatcgagatcattaacgaaccggtgtttgccgagcagatcaaggatgctaatcaggaccagctggatgaagacgattatgagaccgttctgcacgacgcctacacaagcccccaaaacaaaaaggctattagacaggtgatcaaagtcgtggatgacattgtccgcgccgcgggacgggcccctaagttcatctccctcgagtttgctagagaagaccaggagtctcgcagaacccagagccggctgtcccgcatcaagaaaatttatgaaacaaccacgaaggagcttgtggccaatgatcaaatcagagaggaactgggcaacgttaaagacctcaacgatcggctgttcctgtactttacccagcttggccgcgacgcttatacaggggagagaattaatatcgatgacattagcaccaagtacgatatcgaccacattttcccccgggcctttatcaaagatgactctctcgataacaaggtgctggtcaagcgcgccgtgaataacggaaaatccaataacgttcctctgaaactcttcggcgctaagatgaagcccatctggaaaatgtggaaggaccatcagctgattagcaagagaaaatatgaacaccttatgacaaatccggacgcgatcgataagtacaaagccaacgggtttattaatcggcagctgatcgagacccgccaaattatcaagctcgctgccaacatcctggccaatagatactctacggaagacacaaaaattatcgaggtgaaggctaacctgaatcatcagcttcggcagtccctgcacctctataagaacagacaagtcaatgattaccatcacgccgtggacggatatctgagcgcgttcgtgggccagtacctctatcaccgctacccttctctgcagagctattttgtttacgggcagtaccaacggttctttgataaacaggtccaggaaaacatgaagttcaacagattcaattttctttatgacctgaccgatcgcgacaacgatcagattgtggtgaaatccacaggcgagatcgtcggagaaaagagcaaactcattgaacaaatcaagtgggtgtaccggtataagttcatgctggtttctcaggaggtgtttaccaaaaccggccccctgttcgaccagacaatctaccctgctgggtccaataagagcagacttattcccatcaaaaaggatcgccctacggacatttatggaggctactcctctagcaccgatgcctatatgtccctgatccgggtccccgacaaaaaggaagacaaatacaaggtggttggggtgccgtctagaagcctcgcctccctgaaccgcgctgagaagcggggacatgatgcctacctcgaccagctgagacaagtcattgcgaaatctcagaagaaagagtttcagatcattatccctaagctgcggtatcgccagctgatcattgatggcgggctcaaatacacactgggcagctccgcttatcaatacaatgccagacagctggtgcttagcgaaaagtctatggaggttctggtgaccgacttctccaaggtcacaaccgatctcgacaaacagaaccaaaagctgatcgccgtgtatgatgacattctcgataaagtgaatcggtgtctgcccctttacgacaagaaccagtttcgcaaagctctgaatggagccagagataagttcgtccagctgcccatcctccctaagtttaacggcaataaaaaggaagaggctgggaaagttgaaattctgaacgagatccttctgggactccacgacgatgccagcacgggcaatctgaagccgctcgggatcaaaacacccttcggaatgctgcagacccaatctggcattaccatgtccagcaacgcggtgatcgtgaatcagtctcctacagggctttttgagcatcggatttatctgaaggccctgctcaacaagctgaataaatga

SEQ ID NO: 4246 - RNA, 4098 nt, synthetic construct
  misc_feature 1..4098: note = Cas9 variant
  source 1..4098: mol_type = other RNA
atgaccaagctgaaccagccctacggcatcgggctcgacattggaagcaattccatcggcttcgccgtggtcgatgctaactctcaccttcttagactgaaaggggagacagccattggagcgcggctctttcgcgaaggccaaagcgctgccgacagacgggggtcccgcacgaccagacggcgcctgtctagaacacggtggcgccttagcttcctgagagactttttcgcccctcatatcaccaagattgatccggactttttcctccggcagaaatattccgagatctctcccaaggataaagatcgctttaagtacgaaaagagactgttcaatgaccggacagatgctgagttttatgaagactaccctagcatgtatcatctgcgcctccacctgatgacccacacacataaagccgatcccagagagatcttccttgctattcaccacatcctgaagtcccggggacattttctcacccctggcgccgcgaaagacttcaacacggataaggttgacctggaggacatttttcccgcccttaccgaggcttacgcccaggtgtatcctgatctggaactcacattcgacctggctaaagccgatgacttcaaggcgaagctgctcgatgaacaggccaccccgagcgacacacaaaaagctctggtgaaacttctgctctcttccgatggcgagaaggagatcgtcaagaaaagaaaacaggtgctgaccgaatttgccaaggctattacggggcttaagacaaagttcaatctggccctcggaaccgaggttgacgaagccgatgctagcaactggcagttttctatgggccagctggacgataaatggtccaatatcgagacaagcatgaccgaccaagggaccgaaattttcgagcagatccaggagctgtaccgcgcgcggctcctgaacggaatcgtgcccgccggcatgtctctttcccaggctaaggtcgccgactacgggcaacacaaagaagatctggagctctttaagacatatctgaaaaagctgaatgaccatgaactggccaagacgattagaggactctacgatcgctatatcaacggcgacgatgctaaacctttcctgcgggaggactttgtgaaggccctgaccaaagaagttacagcgcaccccaatgaggtgagcgagcagctcctgaacagaatgggccaggctaatttcatgcttaagcaacgcaccaaagccaacggggccattcctgtccagctgcagcagcgggaactcgatcaaatcattgctaatcagtccaagtactatgactggctggccaagcccaacccggtggagaaacacagagcttctaagccttaccagctggatgaacttctcacatttcgcatcccctattacgtgggacctctgatcacccccaaacagcaagccgagagcggcgaaaacgtcttcgcgtggatggttcggaagaatccctccgggaacattacgccttacaattttgacgagaaagtggatagagaggccagcgctaacacattcatccagcgcatgaagaccaccgacacatatctgattgatgaagacgtgctcccgaagcagtctctgctttaccagaaatatgaggtcctgaatgaactcaacaatgtgcggatcaacaatgaggccctgtccaccgaccaaaagcagagactgattcatgaggtttttgaacggcacagctctgtgacaatcaaacaggtcgtggataaccttgttgctcatggagacttcgcccagcgccccgagatcagaggcctcgcggatgaaaagcggttcctgagctccctgtctacgtaccaccaactcaaagagattctgcatggggccatcgacgatagcaccaaacttcacgacattgaaaatatcattacatggtccaccgtgtttgaggatgctgccatcttcaagacaaagctggctgagattgactggctcgatcctgccaccatcaagaaactgagcaacatcagatatcgcggatggggccagttttctcggaagctgcttgacggcctcaaactggggaatggacacacggtcattcaggaactgatgctctccaaccataatctgatgcaaatccttgccgatgagaccctgaaggaaacaatgaccgagctcaaccaggacaaactgaagacagatgacattgaagacgtgatcaacgatgcttacaccagcccctctaataagaaagcgctgagacaggtccttcgcgtggttgaggacattaagcacgccgctaacggccaggatccttcctggctctatatcgagacggccgacgggacaggaaccgccggcaaaagaacacaaagccggcagaagcagatccagaccgtgtacgctaatgccgcgcaagaactgattgattccgctgtccgcggggagctggaagacaaaatcgccgataaggcctctttcaccgacagactcgtgctgtactttatgcagggcggacgggatatttatacaggcgctccccttaacatcgaccagctgagccattacgatattgaccacatcctcccgcagtccctgatcaaggacgattctctggacaatcgcgttcttgtgaacgccacgattaatagagagaaaaacaatgtcttcgcgagcaccctgtttgcttccaagatggccgccacatggcggaaatggcacgaagctgggctcatcagcggacgcaagctgagaaacctcatgctgcggcctgatgagaccgacaaattcgcccatggctttgtggctcgccaacttgtggagacaagacagattatcaagctgaccgaacagattgccgcggcccaatatcccaatacgaagatcatcgctgttaaagccgggctctctcaccagctgcgggaggaactggatttccctaagaacagagacgtcaatcattaccaccatgcttttgatgccttccttgccgctcgcattggaacatatctgctcaaacggtaccccaagctggcgccctttttcacctatggcgagttcgccaaagtggacgtgaagaaatttagagagttcaactttatcggggctctcacccacgccaagaagaatattatcgccaaagatacaggcgaaattgtctgggacaaggagcgcgatatccaggaactggaccggatttacaacttcaaaagaatgcttatcacccacgaggtgcattttgaaacagctgatctgttcgaccagacgatctacgccgcgaaggactccaaagagcgcggaggccggatgagcctcattcctaagaagctggggtatctgaccggaatctacggcgggtatcaaacagagagaggatcttacgtttccattatccgcacctttaaaaagggcgaaacaatttataaagtggtcaacatccttaccgctgatgtgagcctgctctctgagaaggaaaaagttagcaagacgctggccgacatctacctcaaggagctgattgccaaaaagctgtccaaaggcaagagcgggaaaaatatcgcttctgaaccgttcgagattgtgcttcctcgggtcggaaaggattccctgtttaagaacaaaaagtatggcctcttcctgatcgagagcgccaccgaacttcacaattaccaggagctgtggctccccagaaacgaccagctgctcattaaacggatccaggcgcgccaaatcgaagagtccaaggctgattacgaactgacaagaatgtatcggaatattgcctggcaagtggaccattactttcgcctttataaaatcagaaagttcgccgagaagctgcaggcttctgttgaggatttcgccgggctgcccgtgtacaaaaacgaaaccagcgacggaaaggtcgaggtgctcgcttccgtgctgaaacggcttaatggcgccgcggataaggggagaacaaaccctaccacagtcaaactgcagtctgactttggacgcaccctcctgacgaatggcattgttctcgaagatgacagctccatcgtgtatcagtctccgacagggctgttcaagcggagcgtgaaacttgtcgatctgtga

SEQ ID NO: 4247 - RNA, 4098 nt, synthetic construct
  misc_feature 1..4098: note = Cas9 variant
  source 1..4098: mol_type = other RNA
atgaccaaggagtactatctgggcctcgacgtggggacaaacagcgtcggatgggccgttacggattcccagtacaatctgtgcaaattcaagaaaaaggacatgtggggcatcagactttttgaatctgctaacaccgccaaagatcggcgcctgcaaagagggaatcggcgcagactcgagcggaagaagcagcgcattgacctgcttcaggaaatcttcagccccgagatttgtaaaatcgatcctacatttttcattagactgaacgaatcccggctccacctggaggacaagtctaatgattttaaatatccgctgttcatcgagaaggactacagcgatatcgaatattacaaagagtttcccaccattttccatctccgcaagcacctgatcgaatccgaggagaagcaggacattagacttatctatctggcgctccataacattatcaaaacacggggacactttctgattgatggcgaccttcaatctgctaagcagctgcgccctatcctcgataccttcctgctgagcctccaggaagaacagaatctgtccgtgagcctttctgaaaaccaaaaagacgagtacgaagagatcctgaagaatagatccattgccaaaagcgagaaggtgaaaaagctcaagaacctgtttgaaatctctgacgagcttgaaaaagaggaaaagaaagcccagtccgctgtcattgagaatttctgcaagtttatcgtggggaacaaaggagatgtttgtaagttcctgcgggtgagcaaggaggaactcgagattgactctttctcctttagcgaaggcaaatacgaggatgacatcgtcaagaatctggaagagaaagtgcccgagaaggtttatctgttcgaacagatgaaagccatgtacgattggaacatcctcgtggacattctggagacagaagagtatatctcctttgctaaggtcaagcagtacgagaaacataagaccaatcttcgcctgctcagagatattatcctgaaatattgcacgaaggacgaatacaaccggatgttcaacgatgagaaagaagccggctcttataccgcgtacgtggggaaacttaagaaaaataacaagaaatactggattgagaagaaaagaaatcctgaagagttttataagagcctgggaaaactcctggacaagatcgagcccctgaaggaagatctcgaggtgctgacaatgatgatcgaagagtgtaaaaaccacacccttctgcctattcaaaagaataaagacaacggcgtcatcccgcaccaggttcatgaagtggagctcaagaaaattctggagaatgccaagaagtactattccttcctgacagaaaccgacaaagatgggtacagcgtggtccagaagatcgagtctatttttcgcttccggatcccctattacgtgggacctctttccacgagacaccaagaaaaaggcagcaacgtttggatggtgcgcaagcccgggcgggaggacagaatttatccttggaatatggaagagatcatcgattttgagaaatctaacgaaaatttcattacacgcatgaccaacaagtgcacatacctcatcggagaggacgtcctgcccaagcatagcctgctctactccaaatatatggtgctgaatgaacttaacaatgttaaggtgcggggcaaaaagctgccgacctctctcaaacagaaggtctttgaggatctgttcgagaacaagagcaaagtgaccggcaagaacctgcttgaatacctccagattcaggacaaagatatccaaattgacgatctgtccgggtttgacaaggatttcaaaacaagcctgaagtcttatctcgacttcaaaaagcagatctttggagaggaaatcgagaaggaatccattcagaatatgatcgaggatattatcaaatggattacgatctacggcaacgacaaggagatgctgaaaagagtcatccgcgctaattatagcaaccagcttaccgaggagcaaatgaagaaaattacagggttccagtactctggatggggcaatttttccaagatgttcctgaaggggatcagcggatccgacgtgtctaccggcgaaacatttgatattatcaccgccatgtgggagacggacaacaatctcatgcagattctgagcaaaaagttcacatttatggataacgttgaagacttcaattccggcaaagtggggaagatcgataaaatcacctatgactctaccgtcaaggagatgtttctgagccctgagaacaagcgggctgtgtggcagacaattcaagttgccgaagagatcaaaaaggtgatgggatgtgaacccaaaaagattttcatcgagatggcgagaggcggggaaaaagtcaagaagcgcaccaaatcccggaaggcccagcttctcgagctgtacgctgcctgcgaggaagattgtagagagctgattaaagaaatcgaggaccgggatgagcgcgactttaatagcatgaaactcttcctgtactatacacagtttggaaagtgcatgtactctggcgatgacattgatatcaacgaacttatcagaggcaattccaagtgggaccgggaccacatttatcctcagagcaagatcaaagatgactctattgataacctggtgctcgtgaataagacgtacaacgctaaaaagtccaacgagctgctgagcgaagacatccaaaagaagatgcactctttctggcttagcctcctgaataaaaagctgattaccaagtccaaatatgatagactcacacgcaagggggacttcaccgatgaggaactgagcggatttatcgcccggcagcttgttgagacaagacagtctaccaaagccatcgctgacattttcaagcaaatctactccagcgaggtcgtgtatgtgaaatcctctctggtcagcgattttcgcaagaagcccctcaactacctgaaatccagacgggtgaatgactaccatcacgcgaaggatgcctatctgaacattgttgtgggcaatgtctacaacaaaaagttcacgtctaatcccatccagtggatgaaaaagaaccgcgacaccaattatagccttaacaaggtgtttgaacatgacgttgtgattaatggggaggtcatctgggaaaaatgtacataccacgaggataccaacacatatgacggaggcaccctggatagaatccggaagattgtggaacgcgacaatatcctctacacggagtatgcttactgcgagaaaggggaactgttcaacgccacaattcagaataagaacggaaactccaccgtttctctcaaaaagggcctggatgtgaagaaatacgggggctattttagcgccaatacatcctacttcagccttatcgagtttgaagacaagaaaggagatagagctcggcatattatcggcgtccctatttatatcgccaacatgctggagcactctccgtccgcgttcctcgaatactgcgagcagaaggggtatcaaaatgtgcgcatcctggtggagaaaattaagaaaaacagcctgcttatcattaatggataccccctgagaatccggggcgaaaacgaggtcgacacctcttttaagcgcgctattcagctcaagctggatcagaaaaattatgaactcgttagaaacatcgagaagttcctggagaaatacgtggaaaagaaagggaattaccctatcgacgagaaccgggatcacattacccatgaaaagatgaatcagctttatgaggtgctgctctccaagatgaaaaagttcaacaaaaagggaatggccgaccccagcgatagaatcgaaaaatctaagcctaagtttattaaactggaggacctgatcgacaagattaatgtcatcaacaaaatgcttaatctgctccgctgtgataacgacacaaaggccgatctgtccctcatcgagctgcccaaaaatgctggcagcttcgtggttaagaagaacacgattgggaaatccaagatcattcttgtgaaccaaagcgtcaccggcctgtacgaaaatcggagagagctgtga

SEQ ID NO: 4248 - RNA, 4098 nt, synthetic construct
  misc_feature 1..4098: note = Cas9 variant
  source 1..4098: mol_type = other RNA
atggacaccgccaagacaaacaaacagccctactatatcggcctggatatggggacgagctccgtgggatgggctgtcaccgacgcctcttacaatgttgtgaagaaacacggcaaggcgctctggggagtgagactgttcgaggaagctcaaacagccgccgatcggcgccttcatagaaccgctcggcgccggattcagagacgcaaacagagactggccctcctgcaggagctttttgctaaggaaatctgcaaggtcgaccctgggttctttattcggctgcacgagagccgcctctggcaagaagataaatccatcgaccagccgaacacactgttcaatgatgaggactttgatgacaaggcctatcataaagcgtaccccaccatttatcacctgagatacgccctcatgacagagaacaagtctttcgatgtgcggctggtttatcttgctatccatcacatcattaaacaccgcggccattttctgctcgaaaattacgacctgagcaaccaggagacctccgggttcgatgaatcttacatcgcccttacgaatgctattaaggagctgctccagaaggagatccctgtgggacacgtcgagaaaattcaaatcattctgaaggacaaaagcctgtccaagagagagaaaaccgaaaagatcctccaggtgtgggacgttatcaaagataagcagctgaaggaggtggtccagcttatttgtggcggcacagccaacctgagcaccctctttatggacgaatctctgaaagaggcgcttaaggtgttcgagatcaaagattccaagattagcttttctacagccgtgtatgaagagaaagaatccgacctgcaaagcgtcctcgagcagcggttcgatctggtttacgctgccaagatgctgtatgactggtctctcctggctgaacttatgggggatcgcaagaccctgtccgaggccaaaatcgccatttacgagacgcataagaaagacctcgaagtgctgaagagacttacacggcaggataaaagcctgtatagaaagctctttcgcggaaccgacaaggattcctactctgcttatgtgggcagctgcatgatccacggggagaaactggtcatcgaaaagcggggatccacagaggaattttacaaattcctgaagaaagagattagcaagctccccgactgtgaggacaagatctacgtgctgtctaaaattgaagcggagaattttcttcctaaggccgtttccaccatcaacggcattatcccctatcaactgcaggaacaggagctcgatatcattctgaaaaaggctgagcagtacctgcctttccttatggaaaaagacgcctatgggaccatcagcgagaagattaaacaactcctgacatttagaatcccgttctacgtgggacccctgaatcgccactctgataagagctgggccgtccatacggacaaggaaggccggattctcccttggaactttaatgagagaatcaacgaagagaaatccgctgagaagttcattacccgcatgacaaataaatgcacctatctgcttggcaaggatgtgctgcccaaaaactctctcctgtacacagaatatatgctgtttaacgagcttaataacgttaagatcgggaaggccggaacctacctcacggaagaacagaaagaaaagctgtggaaagagctgttcctcacaaccaagaaagtgaccctgagcaagttttccaagttccttatcaaagagggcattgacaaggaagaggcggtcgaaatcaaagggctggatggaggctttaagagctctctcgctccttggattgacctgaaaaatatcctgggggaggatttcacacgggacaaggccgaagagattatcaaggccatcacccttttctccatggataaaaagattctcaaaaagtacctgatgagaatcgtgagcgagcccgtcgctaaacagctgtctaagctccgctatacaggatggggccggttctccaaagagttcctgacggaaattaccccgagagtgacagacgatgttcaggtgcttgtcgacaccagcacaggcgaaatcatgaacattatcaccgccctgaagaagacgtccctcaatctgatggagatcctgtctagcacctacgggtattccgctgccatttctgaggcgaacaaagaacttgtgggaaatacagttctcagctacgagaccgtgaaggaactgacagtctcccctgccgtgaaacgccccatctggcaaaccctgaagattatcaaagagattacgcacatcatgggcgctgaacctgcccggatctttattgagatggctagagacaagcagcccgataaggggcggacagacagccgcaaaaagcagctcatcgagctgtataaaaagtgtaaagaagatgtgagatcttggtccaaccgggagagcaaggactgggttgaagagattgaatctaagtccgatagccagcttagatctaataaactgttcctctactatacccaaatgggaaagtgcatgtacacaggcaaacccatcgacctgggggccctgcttaagggccagctgtacgatcgcgaccatatttatcctcagagccagaccaaagatgactccctcgataacctggtcatcgtggacaatcgggagaacagagataagagcaatacctacccgctctctaagaacattcgcgagagacaaatcggattttggaaactgcttcgggacaagggcttcatctccaaagaaaagtattttcgcctgacaagaaatacgcccttcagcgacgcggagaaagccgaatttattgctcggcagctcgtggagacccgccagtccacaaaggccgtcgctgaaatcctgaagagagtgctgcctaaatctattatcgtttacgtgaaggccgggcttaccagccggttccgccaatatggagagtttattaaagtcagagatctgaacgactaccaccatgccaaggatgcttatctcaacatcgtgacaggcaatgttcactacaccaaattcacgtccaaccccatccggtttgtgaaggactgtcagatttactctctgaatgagcacgcgctctataaatacacagtcgaacgcaacggggtggttgcctgggctcctaatgaggaaggaatgatgcccagcgtgaccagatggatgaacaagaataacatcctggtcacccggatgtcctatgtgggccagggggagcttttcgatcagctgccgctcaagaaaggcaagggacaagtgtctctgaaaaaggagggcgccattagcgacatctccaaatacgggggatataatagcgcctctacagcttactttatgtatgtcgaaggcgaggataacaaggggaagcctgtttacgtgattgaaaccatgcccctgcatcttgccgcgagactgacaacgctcgaggaaaaacagaagtactgcgaggagctgtggatgtccaccggaggcaaactcaagaatcctaaagtgctgatcgaacagatccccattcagagccttttctctgtcgacgggttccgcgtgacaatcgctggcaagaccggaaagcaatatggctgtcggctggccgaggaactggttctcaacaatgggtacgccatgacactgaaagctgtgcttaagtttgtcaacagacgcaaaatgaataaggaggccctgattacctcctatgatcacctcgaagagagccagctgctcgcgctgtacgacgtgttccttgataaactggagcattcttgcttttccaagcggttcagcacgcagagagacgttctgaagaacggacgcgaatcctatatcgctctcagcctggaggacaaatgtcagattctttctgaaatcctgcacctctttcaatgcaacgccaccctgagcaatctctccctgcttggctctagcaagcagtccgggcggctgtacatgtctaaaaacctgagcgataaggactcctggtatattatccaccagtctgtgacaggattctacgagcaacatatccctctcgccccctacaaaaagagctga

SEQ ID NO: 4249 - RNA, 4098 nt, synthetic construct
  misc_feature 1..4098: note = Cas9 variant
  source 1..4098: mol_type = other RNA
atggtgaagaaaaagtacgccatcggcattgacatcgggaccaacagcgtcggatggtccgttgtgacagatgactataaagtgccctctaagaaaatgaaggtcttcggcaatacggagaagagatacattaaaaagaacctgctcgggaccctgctttttgatgaaggaaatacagctgagaaccggcgcctgaaaagaaccgcccggcgcagatatacacggcgcagaaatcggatcctctacctgcaggaaattttcgcggaggaaatcaacaagatcgacgatagctttttccaacgccttgacgattcctttctgattgtggaggacaaacagggctctaagcaccctatcttcgggaccctccaggaggaaaagaaatatcataagcagtttccgacaatttaccacctgagaaaacaactggctgatagctcccagaaggccgacatccggctcatttatctggcccttgctcatatcattaaataccgcggacacttcctgtttgagggcgatctcaagtctgaaaataaagacgttcagcatctgttcaacgattttgtggagatgttcgacaagaccgtcgagggcagctacctttccgaaaatctgcccaacgtggccgacgttctcgtggagaaggtcagcaaatctagacggctggaaaatatcctgcactattttcctaacgagaagaaaaatggactcttcggaaacttcctggctcttgccctgggcctccagcccaattttaagacgaacttcgaactggcggaggatgccaaaatccaattttccaaggagacctacgaagaggaccttgaggaactgctcgggaagattggagatgactatgctgatctgttcatcgccacaaaaagcctgtacgacggcattctcctggctgggatcctttctaccacagattccaccacgaaggcccctctgtctagctccatggtgaaccgctatgaggaacacaaaaaggacctcgcgctgcttaaaaattttattcatcagaacctgagcgattcctacaaggaggtgttcaatgacaagctcaaagatggatatgccggctacatcgaaggcaagacaacccaggagaacttttacagattcatcaaaaaggctattgagaaaatcgaagggtctgactattttattgacaagatcgatcgggaagacttcctgagaaagcagcgcacatttgataatggaagcattccccaccaaatccatctgcaggagatgcacgccatcattcggagacaggctgagttctacccttttctcgtcgaaaaccaagacaaaatcgagaagattctgaccttccgcatcccgtattacgttggcccccttgcccgggggaaatccgaatttgcctggctgaatagaaagagcgatgagaaaattcgcccttggaacttcgacgagatggtggataaggaaacctctgctgagaatttcatcacacggatgacgaactatgaccagtacctccccgatcagaaagtgctgcctaagcactccctgctttatgaaaagtttgcggtctacaatgagctcaccaaagtgaagttcattgccgaaggaatgagagactaccagtttctggatagcggccagaaaaaggacatcgttaaaacactgttcaagaccaagcgcaaagtgacagctaaggatatcaaagcctatctcgagaactctaatgggtacgccggagtcgagctgaagggccttgaggaacaatttaacgctagcctgcccacctatcatgacctcctgaaaattctgcgggacaaggccttcatcgatgcggaagagaatcaggaaattcttgaggacatcgtgctcacgctgacactgtttgaggatagagaaatgattcgcaagcggctcgagaaatacaaggacatcctgaccgaggaacagagaaagaaacttgaacggcgccactataccggctgggggagactgtccgctaaactcatcaacgggattctggataaggttacacggaagaccatcctgggctaccttattgacgatgggacatctaacagaaatttcatgcaactcatcaacgacgatacgctgagctttgtggacgagattcgcctggcccagggatccggcgaggccgaagattatcgggctgaggtccagaatctcgccgggagcccggctatcaaaaagggcatcctgcagtctcttaaaattgtggacgaactgatcgaggtcatgggatacgatcctgagcatattgtggttgaaatggccagagagaaccaattcaccaatcagggccgcagaaactcccagcagcggtacaagaaaatcgaaaatgcgattaagaacctcgacagcaatctgaactctaaaatcctgaaggagtatcccacaaataaccaagcccttcagaatgaccgcctctttctgtactatctgcagaacgggaaggatatgtacaccgacgaggaactcgatatcgaccaactgtcccagtatgatattgaccacatcattcctcaggctttcatcaaagatgacagccttgataataaggtgctgacaaaatccgccaagaacagaggaaaatctgacgatgtccccagcctcgagattgtgcataagaagaaaaacttctggaagcagctgctggactcccaacttatctctcagcggaaatttgacaatctgaccaaggctgaacgcggcgggctcacgaacgaggataaagccagattcattcagcggcagctggttgaaacccgccaaatcacaaagcacgtggcgagaatcctcgacacccggtttaatacaaagctggatgaggccggaaaccgcattagagaccccaaagtcaatatcattacccttaagagcaacctggtgtcccagttccggaaagattaccagctctataaggtgagagaaatcaataactaccaccatgctcacgacgcctacctgaatgctgttgtcgccacggccctgcttaaaaagtatcctcagctggctccggagtttgtgtacggcgattatcccaagtacaacagctataaatctcgcaagtccgcgacagagaaagtcctcttctacagcaatattatgaactttttccggagagtgctggtgtattctaagaccggggaagttcgcatccggcctgtgatcgaggtcaataaagaaacaggcgagattgtgtgggacaagaagtccgattttagaaccgttcgcaaagtgctcagctacccccaagtcaacgtggttaagaaagtggaaatgcagaccggaggcttctctaaggagagcatcctgcagcatggggactccgataaacttattcctcggaagacagagaaattttacctggacacgaagaagtatggaggcttcgatagccccaccatcgcctactctgtcctcctgattgctgacatcgaaaaagggaaggccaaaaagctgaaaagagtgaaggagcttatcggaattacaatcatggaacgcatggccttcgagaagaatccgattgagtttctggaacacaaaggctataagaacatcctcgagaaaaacattatcaagctgcctaaatactccctcttcgaactggagaatgggcggagacggcttctggctagcgccaaggaactgcaaaagggcaacgagatgattctgccccctcacctcgtgacccttctgtatcattcctctaatatccacaaaatcacagagcccattcatctcaactacgtcaataagaacaaacacgaatttaaggagctgctccgccatatcagcgacttctccaccagatatattctggcgcaggatcggctttctaaaatcgaggaactgtacgacaagaatgatggagacgatattagcgacctgacgtcctcttttgttaacctcctgacattcaccgctatcggcgcccctgccgcttttaagttccttgggagcgtgatcgatcgcaaaagatacacctccattgccgaaatcctggaggcgacactcattcaccagagcgtgaccggactgtatgagacacggatcgacctctctaagctgggcggggattga

SEQ ID NO: 4250 - RNA, 4101 nt, synthetic construct
  misc_feature 1..4101: note = Cas9 variant
  source 1..4101: mol_type = other RNA
atgaagaaaccctacagcatcggcctggacattgggaccaactccgtgggatgggccgtcatcacagatgactataaggttcctgctaaaaagatgaaagtgctcggcaatacgaacaagaagaccattaaaaagaatctgatcggggcccttctgttcgatgcgggaaacacagctgccgacagacggctcaaacgcaccgccagacggcgctacacaagacggcgcaatcggattctgtatcttcaggagatctttgctgccgaaatgaacaagctggatgagtctttctttcaccggctcgacgatagcttcctggtgccggaagacaaaggcgggtccaagtaccccatctttggaaccctggaggaagagaaggagtatcataaacaattccctacaatttaccacctccgcaagtctctggctgatagcaaagaaaaggccgaccttagactgatctatctcgcgctggcccatattatcaaataccggggccactttctttacgaggataccttcgacattaagaataacgatatccagaaaatttttaatgagttcacgtccatctataacaatatctttgaagagtctagcctgtccaacgaaaatgctcaggtcgaggaaattttcaccgacaagatcagcaagtctgccaaaaaggaccgcgtgctcaaactgtttcccgatgagaagtccacaggcctgttcagcgagttcctcaaactgattgttgggaacaaggctgactttaagaaacatttcgatcttgaagagatggcccctctgcagttttctaaggacacctacgatgaagacctcgagtccctgcttggacaaatcggcgatgactatgcggatctgttcgtggtcgccaaaaagctctacgacgctattctgctggccgggatcctcagcgtgaaagatcccgctacaaaggcccctctgtctgcctccatgatcgaaagatatgacaatcaccagaacgaccttagcgctctgaagcagtttattcggtccaacctcccggagaaatacgcggaagttttctctgatgacagcaaggatggatatgccggctacatcgacgggaaaaccacgcaggagggattttacaagtatattaaaaatcaaatctccaagttcgagggcacaaagtactttctggaaaagattgagcgcgaagatttccttagaaagcagcggacctttgacaacggcagcatcccccaccagatccatctgcaggagatgaatgctattctccaaaaccaagggggatattaccctttcctgaaagccaataaggaaagaatcgagcagattctgacatttcgcatcccctattacgtgggccctctcgcccgggggaactctgatttcgcttggctgaccagaaattccgacgatgccattcgcccctggaacttcgaggaagtcgtggacaaagcgagctctgctgaggattttatcaataagatgaccaactatgacctttacctgccggaagagaaagtgctccctaagcacagcctgctgtacgagacattcgccgtctataatgaacttacgaaggttaaatttattgccgaggctatgaaggattacgagttcctcgactccggacaaaaacggaagatcgtggaaaacatctttaaaaatcatagaaaggtgaccgaaaaggacattatcaactatctgcacaatgtcgatggctacgacgggattgagatcaaaggaattgagaagcagttcaacgcctctctgagcacatatcacgatctcctgaaaatcatcaaggacaaagaatttatggataaccccaagaatggcgagattcttgaatccatcattcataccctgacaatcttcgaggaccgcgaaatgattaagcagctcctggctcagtacaacagcgtgtttgatgagaaagttatcaaggccctgtctcggaaacactataccggctgggggaaactttccgcgaaactcatcaatggaattagagacaagcaaacgggcaacagcatcctggattacctgatggacgatgggaagtctaatcgcaacttcatgcagctcattaaagacgatggactgtcctttaaggagatcattgacaaagcccaggtggtcggcgaaacagacaatcttagacaggtggttcaaaacctgcctgggagccccgctatcaagaaaggcatcctccagtccattaagctggtggatgagctggtcaaagtgatgggatctgaccccgaaagcatcgtcattgagatggccagagaaaatcagaccaccaacaagggcaagtccaaatctcagcaacgccttaagacactcagcgatgctatctccgagctggggagcaatattctgaaagagcatcctaccgacaacatccagctccagaatgatcggctgttcctttactatctgcagaacggaaaggacatgtacacaggcgaagccctcgatattaatcaactgtctaactatgacatcgatcacatcattccgcaggcgtttatcaaagacgattccctggacaacagcgtgcttacgtcttccaaggacaatagaggaaagagcgataacgttccctctctcgagattgtggagaaaatgaaggggttctggcagcaactgctggacagcaaactcatctccgaacggaagttcaataacctgaccaaagtcgagcgcggcgggcttgatgaaagagacaaggtgggctttattaagcggcagctggttgagacaagacagatcaccaaacatgtggcccagatcctcgatgctcgcttcaatgccgaagtcaacgagaagaatcaaaaactgcggagcgtgaagattatcacactgaaatctaaccttgtgtccaattttagaaaggagttcggactgtacaaggttcgcgaaattaacgactatcaccacgctcatgatgcctacctcaatgccgtcatcgctaaagcgattctgaaggagtatcctaaactcgaacccgagtttgtgtacggcgactaccagaagtatgatctgaaaagatacatcagccggaccaaggaccctaaggaaatcgagaaagccacggaaaagtatttcttttactccaaccttctgaatttctttaaagataaggtgtattacgctgacgggaccattatccagcgcggaaacgtcgagtattctaaagatacaggcgagattgcctggaataagaaaagagacttcgccatcgtgcggaaggttctcagctacccccaggtgaacattgtcaagaaaaccgaggaacaaacagggggattttccaaggaatctatcctgccgaaaggcaacagcgacaagctgattcctcgcaaaaccaagaatatccagcttgatacgacaaagtacgggggcttcgactcccccgtgatcgcttattctattctgctcgttgccgatgtggagaaaggaaagagcaaaaagctgaaaaccgtcaagtccctcatcggcattacaatcatggaaaaggtgaaattcgaggcgaaccctgttgcttttctggaggggaagggataccagaatgtggtcgaagagaacattatcagacttcccaaatatagcctgttcgaactcgagaatggccggcgcagaatgctggcctcttccaaggagctgcagaaagggaacgaaatggtgcttcctagctacctgctcgccctgctctatcacgctaagaagatccagaaaaaggacgagcccgaacatctggagtacattaaacagcaccactctgaatttaatgatcttctgaacttcgtgtccgactttagccagaagtatgtcctggccgagtctaatctcgagaaaatcaagaacctgtacattgataatgaacaaaccaaccttgaggaaatcgctaattccttcattaacctgctcacctttacagcgttcggagccccggccgtttttaaattctttggcaaggacatcgagcggaagcgctacagcacggtgaccgaaatcctgaaagctacactcattcatcagtccatcaccgggctgtatgagacaagaattgatcttagcaagctgggcgaggaatga

SEQ ID NO: 4251 - RNA, 4101 nt, synthetic construct
  misc_feature 1..4101: note = Cas9 variant
  source 1..4101: mol_type = other RNA
atggacaagaaatacaacatcggcctggatattgggaccagctccatcggattcgtggccacagacgaggataatcacgtcattagagctaagggcaaaaacgttatcggggtgcggctctttgacgaaggacagtctgccgcggagcgcagaggcttccggacgacccgcagacggctgaatcgcagaaagtggcggcttaacctgctccgcgaaatttttgagccccatatctatcctatcgatgctagcttctttatgagacaaaaatactccaatctgtctaagcaggacccgaaccagaagattgagttcaaagatatcctttttagcgacaagtccgatgccgagttctatcggcagtaccccacaatttatcatctgcgccaagccctcatgaccgagaaaagacagtttgacctgcgggaaatctacctggctattcaccacatcgtgaagtatcgcgggcatttcctcgatgagacacctaccgacaaattttctttcgatcagctggaccttacacaggaatttgagagactgaatgtcctcttcagcgagcaaaaccccgaagaacctttcgaaattgtggttaatcagaaccagtccatcgaggacatcctgagcaatcagtctatgaccgcctccgatcggagaaagcaagctcttgtggtcttttaccagcagagcgaaaacaaggagaatgagaaacaatacaaggccattgcgacggaaatcctgaacctcctgctgggaaataaagccaagctcaacgtgattctggctcaggaggttgacaaagaagccgctaaggattggtctctttccctgagctctgagaccttcgacgatgacctcgaaaaagcctccagcggcctgaacgattcccagcttgagatggtgggcatctttgagcgcatttattctagcctgatcctcaagtccatcattggggaccacaatagcctgtctgcggccatggtcgataagttcaaaacacacgctcagcatcgggacctgctcaaggatgtgatcaaaaactccgacgccaccaagggagaacaactgcagtttgcttacgaccactatcttcagagacatagcgccgatggcaaagcctacgggaaggacgatttctataaggaggtgaaaaagaatctggacgattctgacgctgcgcagcaaattcagcagctcatcgatacagaccagtttatgcccaaacaacgcaccaaggccaacggagctattcctcaccaggtccagcagaaagaactggatcttatcatcgagaatcaatgccagtactatccgtggctggccgaagagaaccccaatagcgagcggcacaacgttgccaagtacaagctcgacgaactggtgtccttcagagtgccttactatgtcggccccctgatttctcctgctgatgacgagacggatccccaggccatccaaaatacaaaatttgcgtggatgattcgcaaggacgctcaggggcggatcaccccgtggaacttcgacgataaagtggacagagaaaagagcgccgataaatttattaagcgcatgacaaccaccgacacatacctcatcggagaggatgttctgcctgaccagtcccttatttatcagcggtacaaggtgctgaatgagctcaacaatgtcagaatcaacggccgccccatcgaagtgcaaattaaacagaatatctatacggatctgttcaagaaatttaagagcgtttctgtgaaaaagctgcggtcctaccttgaggaaatgagctattaccctggctctttcaaaatttccgggctcaccaaccccggaaagttcgacaacggcctgacaagctacctggattataagaatatcctcggggactccgtcgatgccaacgacaaaagagctgatattgagcagatgatcgaatggtctaccatctttgaggacaataagattttcgcccagaaactggagagcatgacatggcttaccgctgaacaacggaaggccatctcccgcaaaagatacacgggatggggccggctgtctaacaagctcctgacacagctgaagaatcaggacaacagaagcattatggatcttctctgggagaccgaagagaattttatgaaaatccagtccgcgcccgacttcagcaagatgattgaagcccataaccaacagtttatcaaaaatgaggctaacatccagcaagtgatttctgatctgtatacctcccctcagaataagaaagccatccgccagattctgctcgtcgtggacgatatccagaaggctgttgggcacgccccggagcatattgcgatcgagttcgccaagggagaggacaaaaacccccggagaacaatcagccgcgaaatgaagattcaagatgtgtaccagcagatctctgacgatattctggtctcccctgaggtgagagctcagcttaatgagaaaatcgaaaaccggcacggccgcctgagcgacagactctttctgtatttcatgcaaggcgggcgggatatgtacaccggaaagcccattaatatcaacaacatttctcattatgacatcgaccacatcctgcctcaggcctttattaaagatgacagccttgataatcgcgttctcgtgtccgacaagctgaacagagaaaagagcgatacagtcccccgggacctgttcggccgcgaaatgatgtctacgtgggagaaaatggctgatagagggctcatcaccaagcggaaactggccaatcttaagacaattccgggatccatcgacgcccacaaagctcagggctttattaaccgccagctggtggaaaccagacaagtgatcaagctcgcggttgggatcatgattgatcagtaccctgagacacagatcgtcagcgtgaaagccaatctgacccatgagatgcgggaaatgttcgacctggtgaagaacagagatgtcaatgactaccaccatgcttttgatgcctatcttacggccttcgtgggcaactacctcctgcagcgctatcccaagctggagccttacttcgtttatgacaaatttaagaaactcaaggaccaaaatatttccatgcgggatttcaacctgctttacgacctgaaaaagaatgaagatgtgtatgaccagagaaccggacactctgctcacaagatctgggatcagcatggcagcattgactacatccgccacctctttgcctacaaaaagatcctggtctcccatgaggtgcaccaaaacgggggagcgctgtataatatgacagtttacggcaaagctgatgacgccaagcggaaacttattcccatcaaggccgataagcctaccgaactgtatgggggatacacatctagaaaactcgcttatatggccattgtgaagaccaaaaagggcaaaaaggagcagtaccaggtcacgggggtgcccgttagcgcgctgacaaccctccgccagttcaaggaggactccccggaacaaaaacaggctctggaggaaatcgtgcggagaaactttgatgagaagacagaagtcgagattatcgtgcctaaagtgcttttcaatcagctgattgtcgacgagaagtgtcgctttatggttggctctgatacctatcggtacaacgcccagcaactcgtgctgagcgccgacgacctggaaatcatcaacgcttcccataaagatattcagaccatcgacagctctgattactcccagcagcttgaccaagtgtatcagaatattctgacaatcgtcgataagcacttccccatgtacgacattaacaagtttagaacgaaactccacgatatctatgagcagtacatcgaactgcccaatgaggacgtgtgggaaaacaataagctcaccacactgggaaaacataccattatcattcggatccttcaaggcctgcacgccaacgctacagttgtggatctcaagcagctggggattaaaacccctttcggatttatgcagcaggcccgcggcatcgtcgtgagcccggacgcgcaactgatctatcagtctcccacggggctttacgagagacgggttcgcctgggagatctctga

SEQ ID NO: 4252 - RNA, 4101 nt, synthetic construct
  misc_feature 1..4101: note = Cas9 variant
  source 1..4101: mol_type = other RNA
atgggcgacagaaagtacaacctggggctcgatatcggaaccagctccattggcttcgccgctgtggacgagaataaccagcccatccgggtcaaagggaagacagccattggagttcgcctgtttgaagagggcaaaacggcggctgatagacgggggttccgcaccacaagacggcgcctttctagacggcgctggagaatcaatctgctcaacggaatttttgacgcccacctggccgaagtggatcctaccttccttgctcggctgaaggagagcaatcgctccaacctcgacccgaaaaagtcttttcaaggcagcctgctgttccccgaaagaaaggattatcagttttacaaagagtatcctacaatctaccatctccggaaggccctgatggaggaagaccgcaaattcgatatcagagagatttatcttgctgtgcaccatatcattaagtaccggggcaattttctgaacgggacccccatgagatccttcaaagtcgaaaatatcgagctcgacacactgtttgatcgccttaaccagctgtatgaggaaattatccctgacaatgagctcgccttcgatctggaacaggtggcggacgttaaggaggtgctgtctagcaccacgatttacaagatggacaaaaagaaacaactcgtcaagatgatgctgcttcccacctccaacaaagccctgcagagcgaaaataagaaaatcgtgacacagtttgttaacgctatcctcaattacaagttcaagctggatgtgcttctgcaggtcgagaccgacgccgattggtctctcaaactgaacgacgagggagctgatgacaagctggaagagttcacaggcgatctcgacgaaaaccggctggagattatcgatcttctgcaaagactccacaattggttttccctgaacgaaattaccaaagacgggaatagcctttctgccgcgatggtggagaagtataaagatcatcgccaccacctggagctcctgaagaaggtgatcgaagaccatcctgacgccaaaaaggctaaagccctgaaggagacgtacacagcttatgtcggaaaaaccgatgacaagacacagaaccaggatgacttctacaaggccgttgaaaagaatctcgatgactccccggatgccaaggagattaaacggctgatccagcttgaccaatttatgcccaagcagagaaccggccagaacggggctatccctcaccaactgcatcagcaggaactcgatcagattatcgagaaacaaagcaagtattaccccttcctggcggagcctaatcccaacgtgaagcgccggaaagacgccccgtataagctggatgaacttattgcttttaaaatcccttactacgtgggacccctcgtcacccctgaggaacaggcccagaatggcgagaacgtgttcgcctggatgaagagaaaagttgctggccccattacaccctggaattttgacaagaaagtggatcgcatggagtctgccaaccggttcatcagacgcatgacgaccaaggacacatatctgtttggggaagacgtcctgcctgcggagtccatgatctacgaaaagttcgtggttctcaatgagctgaacaatcttaaaattaacggacggcacctgagcctcaaggataaacaggacatctataacgatctgtttaagcaacagaaaaccgtgtccattaaggctctgcagaattactatgtcacaaagaaaaaggccgccaccgctccgacggtgggcgggcttgccgaccccaaaaagttcctctctagcctgtccacatacatcgattttaaaaacatgttcggagaacaggtcaatgaccctcaattccaggaggatctggagcagattgtggaatggagcaccatctttgaggacagaggcattttcaaggctaagctccaggccctggggtggctttctgaaaaacaaatccagcagctggttgcgaagcggtataaaggatggggccgcctctccaagaaactgctgaccggccttaagaacgccgaggggtacagcatcctcgatgaaatgtggagatctacagagaattttatgcaaattcagagccggcccgagttcgctgccctgatccagcaggctaacgaaaagcaatttgagggaaatgaccctaacaatgtgtgggaaaacattgagaatatcctgggcgatgcctacacctctccccagaacaaaaaggcgattagacaggtcgtgaaagttgtgcaggacatcgaaaaggccgtcgggaatccgcctgagaaaatcgctattgagttcacacgcgaagccgctgccaacccccaacggacgcagtccagactccgcaccctggagaaactttatgaaagcgccgaggaggtggtggatgctagactgacagcggaactcgccgagtttaaagaaaataagcacgttctgtccgacaagtactatctgtacttcacccagcttggacgggacgtctatacaggcgataccatcagcctcgaccgcctgaacgattacgacgtggatcatattctgcctcagtcttttatcaaagacgattccctcgacaacagagtgctgacgattcgggctgtcaataacggcaagagcgataatgtgcccgccaaaatgttcggcaagaaaatgggatctttttggcgctatcttctggacaacggcatgatctccaagagaaagtacaataacctcatcaccgatcctgacaatattagcaaatacgcccaaaaggggttcatcaaccggcagctggttgagacatcccaggtgattaaactgaccgctaatatccttaacggaatttatgacaaggatacagaaatcatcgaggtccccgccaaaatgaactctcaaatgcgcaagatgtttgacctggtgaaggttagagaggtgaatgattaccaccatgcgttcgacgcttatctcaccattttcatcggcaattacctgtataaatgctacccgaagctccggccttattttgtctacgggaaattcaagaaatttagcgataacgaagacattgaggtgggagatggccgcttcaattttctgaacagaatcgaacggcttaagaacgttacggaccccgagacaggggaaattctgtggtccaatgtggcccccaacgagaccatcaagagaattaaaaaggtctacaattataaattcatgatcgtgtctcgcgagatcacaacccggagagccgaactctttaaccagaccgtgtaccctaagaattatcgcggcaaactgattccgatcaaggaggatcggcccacagacctgtacggaggctatagcgggaacacggatgcttaccttgccattgtcgcgctggaagacaagaaaaagggaaaatatttcaaggttgtgggcatccctaccagagctgccgccaaactcgagaagctgaaacagcaggattcccaacagtacctccaggctgtgcacgaagtcattgctccccagtttacaaagagcaccaagaaagggatcaagaaaacagagttccgcatcgtgctggacaaggttcattaccggcaacttgtgcaggacggacctgtcaaaatgatgctggggtcttccacctataagtacaatgccaagcagctcgtgctgagcgagaaagccctgcaggttattaaggatgacagaaaatttgatgaaacgcaaaaggacgataaccttatcgcggtgtatgacgagattctgtctatcgtcaatcagtccttcgatctctacgacattaacgggttccgcaaaaagctgaatgataaccggaatcagtttatcgacctccccgccgaaacaaagtatgagggcagaaaagtggttgctcacggaaagcgggagatgatcctggaaattcttaaaggcctgcacgccaacgctagcttcgggaatctgaagcctatcggatttgccacccccttcggccagatgcaatctaaaaacgggattgagctcagcgaaaatgcctttctgatccatcagtccccgagcggacttttcgagcacaagattaagctgtctgatctctga

SEQ ID NO: 4253 - RNA, 4101 nt, synthetic construct
  misc_feature 1..4101: note = Cas9 variant
  source 1..4101: mol_type = other RNA
atgaccaagctgggcaaaccctacgggatcggagtggacattggcagcaactccatcgggttcgccgctgtcgatgaaaattctcacctcattagactgaagggaaaaacagttatcggcgcccggctttttgaagaggggaaggcggctgcctatcgcagagccagccggacgacccgcagacggctgtcccgcaacagatggcggctctctttcctgcgcgactttttcgaaagccatattacacctaccgatccgaactttttcatgagacagaaatactccgagatctctcccaaggacaaggctcggtataaatacgaaaagcgcctttttaatgatagaacagacgccgagttctatcaacagtaccctaccatgtatcatctgcggacacgcctcctgaccgatcccagcaaagctgacgtgagagagatctactttgccattcaccacatcctgaagtcccggggacatttcctcacgcctggctacgcgaaagattttaataccaacaaggtggccctgaatgaaattttccccgcccttcaggacgcttatgctcaggtctaccctgatctggacatcacatttgatgagaacaaggtgaatgagttcaaaaccgttctcctgaacgagaaggccacaccgagcgacacccaaagagcgcttgtgaatctgctcctggccaaagagggcgaccgcgatattctgaagcagcagaaacaggtcctcacggagttcgctaaggccgtggttgggctgaaaacaaaacttaacgtggctctgggaaccgaagtcgactcttccgaagccacagcctggaattttagcctcggccaactggatgacaagtgggctgggatcgagtctgcgatgaccgatgaaggaaccgagattcttgaccagatccgggatctgtatagagcccgcctcctgaacggcatcgtgcccgctgggaaaacactgtcccaggccaaggtggacgattacgcccagcaccacgaggacctcgaactgttcaaagattatcttaagcaactggaggacgacggaacggctaaagccattcggcagctctacgatagatatatcgacggcgatgacgcgaagccttttgtccgcgaagatttcgttaaggctctgaccaaagaggtgacagcccatcccaatgccaagagccctgaacttctggagcggctcgctcagcccgactttatgctgaaacaaagaaacaaggccaacggcgctattccggtgcagatgcagcagcgcgagctggatcaaatcattaaaaatcaggccgtctactacgactggctcgcggcccctaaccccgtggaaaagcaccggcagtctatgacctatcagctggatgagcttctgaatttcagaatcccttactatgttgggcccctcgtgacagctaaggaacaaaaagccgctcagggaggcgtctttgcctggatggtgcgcaaggaccccgatgggaacatcaccccttacaatttcgacgagaaagttgatcgggaagcgtccgccaacacgtttattcagagaatgaagacaaccgacacctatctgatcggagaggacgtgctgccgaaacagagccttctctaccaatcctatgaggtcctgaatgaactgaacaatgtgcgggtcaacgataataagctctctttcgaccagaagcaacaggtgctgggcgagctttttgaacgccataacacagttaccattaaacagttcgtggataatctgctcgctcacggggactacgatagaatccccgaggtccggggactggccgacgagaagagatttctgagctcccttagcacatacaaccagctcaaaggcattctgcacgaagctatcgatgacgccgataagcagacggacatcgagaatattatcgcctggtctaccattttcgaagataaagctatcttcaagacaaaactgaacgagatttcctggctcaacgcgggcatgatcaatagcctggccaacattcgctatcgggggtggggacaattttctcataaacttctgaatgaactcaccctgagcacaggcagaaccgtgttcgaggagctgcttatctcctctcgcaacctcatgcagatcctgacggacgaagttctgaagcagaagattgctgagctcaatgcccacgaactgaaggccagcgggatctacgctgccattgatgacgcgtatacctcccctagcaacaaaaaggctcttagacaggtgctgtctgtcatcgacgatattacaaatgccgccggacaagctcccaactggctctacatcgagaccgccgacggcgatggggtgcctggcaaacggacaaattcccgccagagaaagatccaggaaatttatgcgaacgctgcccaggagctgatcaccggaagcgtgcggggcgagtttgaagacaagattgcctctcgcgctgatttcacggacagactggttctttactttatgcaagggggacgggatatctatacaggcgagcccctcaatattgacaacctgtccagctacgatatcgaccatatcctgccgcagtccctcattaaagataattctctggacaaccgcgtccttgtgcaccctctggtgaatagagaaaaggacaccatcttcgccagcacacggtttgctaaacagatgaacgggatgtggcgccagtggcatgccgcgggactcatttcctctagaaagctgcggaacctgcaaatgagacccgatgagatcgacaaatacgccagcggcttcgtcgctcgccagcttgtggaaacccggcagattatcaagctgaccgagcaaatcgttgccgatcagtatcctgacacaaagattatcgctgtgaaagccgggctctccagccagctgagaaaggagctcgattttcccaaaaatcgcgaagtcaaccactaccaccatgccttcgacgcttttctggcggcccggattggcacgtatcttctgaagagataccctaatctcgagcccttctttacctatggaaaattcaagaagacagaagtgaaaaagctgaaatctctgaagtcccttaagagcttcaactttatccgcgatatgacccacgctaaggacaaaattgttgccaaggagacaggcgagatcgtgtgggataatgcctctgacattaacgaactggatcggatctacaatttcaagagaatgctcatcacccatgaggtccgctttgaaacggcttccctgttcaaacagacactctatgccgcgaagaacagcaaaaatagagggggatctcggcaactgattccgaagaaaaagggctaccttgtggacatctacgggggatatacccaggagaccggcagctacctgtccgttgtgcggctcacaaagaaagctatgtatgccgtcgtgaaggtgagcacccgcgatgccgctaaactggccgtcgcgaagtctatttccgaacagaaagagaacgagacactgaagaagatcattgacgggaaacttagcaagacgtccaaaaagggcaaaaccacacaccagctgtttgaaatcgttctccctagagtgggacaaaagaccctgttcaaaaattctaagtacaaccagtttctcgtgaatagcgacacatatatgcacaactaccaggagctgtggatgccccgggaatatcagcgcatgtggaaggatatccttctgtccaatcatggcgacgctcaaattgaggggcagctggatcagatcttcaaatttattgtctctcaggtgaacagctacttcaacctctacgacatcaatcaatttagaaagaaaattgccgatgccaccgacaagttcgctaagctgcccacgcacgataccgacaacgcccggggaaaaatcgctacaatcggccagcttctgattgggctccaggccaatgcgatgagatccgatctgcgcaacctcgacatcaagacccctttcggactgcttcaaattggcacagggatcaccctggatctggacacatctattatctatcagagcccgaccggcctctttgaacgggaggttcccctgacggatctttga

SEQ ID NO: 4254 - RNA, 4101 nt, synthetic construct
  misc_feature 1..4101: note = Cas9 variant
  source 1..4101: mol_type = other RNA
atgaccaaggactacagcctgggcctcgatatcgggacaggatccgtgggcttcgccgctctggacacgaactatagacttctgcgggccaaagggaataacgtcattggagttcgcctctttacccccgcggagacagctgaagagagacggggcttccgcaccgccagacggcgcctgtctagacggcgctggagacttggggccctgaatggaatctttgctcctgaactcgccaaggtggatccgaacttcctgcaccggctgaaatacgcttgggtgcatcccgccgaccagcaaaataagggcaaatatagcgcggcccctctctttaacgatgctgccctggaccgccagttccacgatgactaccccacaatttatcatcttagactgaagctcatgaccgatacatcccagcacgacctgcgggaggtctaccttgctatccatcacattatcaagtttcgcggcaatttcctgagaggggaaggacctatcaacgcctctgaggcgtttgatattaataccttcatcgaccagatgacggccttttatgatcaggctttccccgactttaaaattgtggaccaagttgatcagcagatcattttcaagggcctcaccgacatgacactgagccctgccgatcgggctaacaaagccctgatggggttcaataacgccgctcaacagccgaataagagaatctttaaagcgattctctccggactggtgggcaaccaggtcgaccttatggccatcttccagctggatgggatccccaaggaggaccaaaaggaatttaaattcaagtttgtggataatgacattgaggaaaaactcgctgccctgggagataaccctgccctttctgacgagcagaacgagttcctgaccacactctacgctgcctttagcggcctgaccctgaagggcctcctgggggatgcgacgtccatcagcgctgccatggttgcccgctacgcttctcaccggacagactggacctatattaaagaccatgtgcttacaccccagaataacagagaactgcgcctcgcctacgctgatctgatgaccgacaatgaggatgtccggcttaaggccggaaagaagttcgcgaaggccatcgaagctgccgacattcctgctgccaaaaagtccgagtttagcctgaaaatcgataacaatgagttcctccccagacaacgcaccaaggcgaacggcacaatcccgcaccagctgcatctgaatgagctccagcagattatcgagaaccaagggcagtattacccttttctgaaagccacgttcgaacaggacggacacacccttaataagattgagggcctggtgaagtttcgggtgccctattacgtcgggcctctcgttcccaaacacaaggtggctggaaacaatgccaaccattggatggtgcccaaagaacctggcgctatcacaccgtggaattataccgagaaggtcgatagagacaaatctggcaacgagttcattcgccggatgacagggaccgatacgtacctgctgggagaacccacacttcctaaaaattccctcgtgtaccaggagttcaacgttctgcaagaactgaacaatctcagaatcgagaagcgccggctggacatcgccgtgaaacaggatatttttgaacacgtcttcaagaccaacaaaaccgtgacagttaagagaatcgaggaatatcttaccacagagtttggcagccccgtgacgctgtctgggttcgccaatgtcaacgagcggaaactcaattccagcctgtccacctaccattattttgtgggaattttcggcgctgaatttgtcgacgatcctaagaacctgacacttctcgagcagatcgtggaactgcagaccgttttcgaggaccgcaaggcgctgcaaagacagctcaaactgcggcccgagctttctgaaaaacaggtgaagcagctggccagaacacactacaccgggtggggccgcctcagccaaaagctgctgacgtccaaaattgtccatgtggctcttgagggagaacgggagccgggccagtatagcatcctcgaaaccctgtacgggacacagatgaattttatggagattgttaacgacatgaaggatagatatggagtgaaatcttggctggaccaagaaaattccggcagcgaaaacaatctctctctgaagcagcgcatccttgatatgcctgggcccaagaacatcaaaagaggaattaatcaggccttccacatcattgacgagatcacccgggccgtcggcaacgctcctagccgcatttacatcgaatttgccagagagtcccagcaatctaatctgacaaacgcgcgggtgaaccgcctcaagcagctgtacagcaatcaggctctgaaaaaggagttcgccaaacttgcctccgaaatcaaggatctcaccaaggagcagctgaaagacgatagactgtatctctactatctgcaacaggggaaggacatgtacacggaaacagatattgacatcaccaaaattagctctaactatcagatcgatcacattatcccccaggcttacacaaagaataactcccttgacaatcgggtgctggttaacagcgagatgaatgcccgcaaatctgattcccctacctttctccccagcctgatccaagaaagaaaggcgtggtggcggcagctgcgcgacaccggccttatgtccacaattaagtataacaatctgacgagaacctctgacgatttcagcgctgaccagaaagagcggttcatcgccagatccctcgtcgaaacacgccaagtgattaagaacgtggccaccctgatcaaagagtactacgatgactctcaggtcgaggctctcccgagcgaaattacagccgagatgcggagatatctgaatgtgcgcaagaaccgggatatcaatgactaccatcacgctcatgatgcccttctgtttgcgaccgccggagagttctccagaaaagttggcatcatggaaaaggggcgcgtgagcgacggagctggcaacatttataatcggtacacgaaggatatcattcagagagcccgcgctaaagccgggcaggacaagaaagtccggccttttacattcatcgtgggatctatggccaaccccgataccaagtttcaaaccaaccagacaaccggcgagattgtttggacacccgaagacgtggcttatctcagaaaagtcatcgactacaagaaaatgctggtgacgaagatgaccctggatcagacagggaccctttataatgagacacggtacggctccggagacaagcacgttgcggtggccctgagcaaagataaggctgccgacctctacggcgggttcggatctctgaaacctgcctatgctgccctcgtctactccaagaaaaagtttcgcctggtgaacgtgcttagactgtggctcccggaaattaagaaaaatgcgagcgtcctggagcggaaggttcagtctgtgctgggcgatgacaacgctaaagtgatccgcgcccacgtcccctgcgggcaacttctgatcaaggatggagccctcgtgaccgttagctccgctacggaactgcataatttcagacagctctggctgcctaaagccgactatcaggatattagcatccttctgggcgcgcccgacaaggtgaccgctgagaaccggctgcaggccgagtctcactttgatgacgtcgatcaaagattcgaatccctcctgaaggacgtgattgaccaggcccgccagtactatcctcttaaaacacatcagaccagcctggagaagctcatcgggaaaattggcaagtttgatgaactgaaattcgctcaaaagcagcaggttttctcccggctcctgtctgcccttcacgctaatgccacaaacagcgacctgaagcaaatcggactgtccaccgcgtggggcagactcatctaccccaaaggggtgtctctgacagatgaggacaaacttattaatagctcctttaccggactgttcaacgatgtcatgtctatcaaggaatttcatgacttcagcattaattga

SEQ ID NO: 4255 - RNA, 4104 nt, synthetic construct
  misc_feature 1..4104: note = Cas9 variant
  source 1..4104: mol_type = other RNA
atgaagaaacagaagttcagcgactactatctgggctttgatatcgggaccaactccgtgggatggtgcattacagacctcgattacaatgtcctgagattcaacaaaaaggacatgtggggctctcggctttttgaggaagccaaaacggctgccgagcgcagagttcaacggaatagccgcagacggctgaagcgcagaaagtggcggctcaacctgcttgaagagatcttctccaatgaaattctgaaaatcgattctaactttttccgcagactcaaggagagctccctgtggctggaggacaaatctagcaaggaaaaatttaccctcttcaatgatgacaactataaggattacgacttttataagcagtaccccacaattttccatctgcggaatgagcttatcaaaaaccctgaaaagaaagatatccgcctggtgtatctcgcgattcactccatctttaagagcagagggcacttcctgtttgagggacagaatcttaaagagattaagaacttcgaaaccctgtacaataacctcatcgctttcctggaggacaatggcattaacaaaatcattgataagaacaatatcgaaaagctggagaaaatcgtgtgtgactctaagaaagggctcaaggacaaagaaaaggagtttaaggagattttcaactccgataaacagctggtcgccatctttaagctgagcgtgggatcttccgttagcctgaatgacctcttcgatacagacgaatacaaaaagggcgaggtggaaaaagagaagatttcttttcgggaacaaatctatgaggatgacaagccgatttactattccatcctgggcgagaaaatcgaacttctggatattgccaagagcttctacgactttatggtcctcaacaatatcctggctgattcccagtatatttctgaggccaaagtgaagctgtacgaggagcataaaaaggacctcaagaacctgaaatatatcattcgcaagtacaataaagggaactacgataaacttttcaaagacaagaatgaaaacaattatagcgcttacatcggactgaacaaagagaagggcaagaaagaggttgtggaaaagtccagactcaaaatcgacgatctgattaaggtcatcaaagggtatcttcccaagcctgagcggattgaagagaaggacaaaaccgtgtttaatgagatcctgagcaagattgaactcaaaacaatcctgcccaagcagagaatttctgataacggaaccctgccttaccagatccacgaggtggaactcgagaaaatcctggaaaatcaatccaagtattacgacttccttaactatgaggagaacggcgtcagcacgaaggataaactgctcaagacctttaaattccgcattccctactacgttgggcctcttaattcttatcataaggacaaaggaggcaacagctggatcgtgcggaaggaagagggcaagattctgccgtggaattttgaacagaaagtggatatcgagaagtccgccgaagagttcattaaaagaatgacaaacaagtgcacctaccttaatggggaggacgtcatccccaaagatacattcctctattctgaatacgtgatcctgaacgagctgaataaggttcaggtgaacgacgaatttctcaatgaggaaaacaaacgcaagattatcgatgagctgttcaaggagaataaaaaggtcagcgaaaagaagtttaaagagtatcttctggtgaagcagattgttgacggaaccatcgaactcaagggcgtgaaagattccttcaacagcaattacatttcttatatccggtttaaggacatcttcggggagaaactgaacctggacatttacaaggagatctccgaaaagagcattctttggaagtgtctctacggagatgacaagaaaatctttgagaagaaaattaagaatgaatatggcgatatcctgacgaaagacgagatcaagaagattaacacattcaaatttaacaattgggggagactgtctgaaaagctcctgaccggaatcgagttcattaaccttgagacaggcgaatgctactccagcgtcatggatgcgctgcgccggaccaattataacctcatggagctgctgtcctctaaatttacccttcaagaaagcatcaataacgagaataaggaaatgaacgaggcctcctacagagacctcattgaggaatcttatgtgagcccttccctgaaacgcgctatcttccagacactgaagatttacgaggaaatccggaagatcacgggcagagtccccaaaaaggtgtttattgagatggcccgcgggggagatgaaagcatgaaaaataagaaaatccctgctcggcaggagcaactcaagaaactgtatgactcttgtggcaacgatattgccaatttctccatcgacattaaggagatgaagaacagccttatctcttacgataataactccctgagacagaaaaagctctacctgtattacctgcagttcgggaaatgcatgtataccggacgggaaatcgaccttgatcgcctcctgcagaataacgacacatacgacattgatcacatctatcccagaagcaaggttattaaagacgattcttttgacaacctggtgctcgtcctgaagaatgagaacgcggaaaagagcaatgagtacccggtgaaaaaggagatccaagagaaaatgaagtccttctggcggtttcttaaagagaagaacttcattagcgatgaaaagtataaaagactgaccggcaaggacgattttgagctccgcgggttcatggcccggcagctggttaatgtgagacagacaaccaaagaagtcggcaagatcctgcagcaaatcgagcctgagattaaaatcgtgtactctaaggctgaaattgcctccagctttcgcgagatgttcgactttatcaaggtgagagaacttaacgatacgcaccatgctaaagacgcctacctgaatattgttgccggaaacgtctataatacaaagttcaccgagaaaccctaccggtatctccaggaaatcaaggagaactacgatgtgaaaaagatttataattacgacatcaaaaacgcttgggacaaggaaaattccctggaaatcgtgaagaaaaacatggagaagaataccgtcaacattacacgctttatcaaagaagagaagggccaactcttcgatctgaatcctattaaaaagggggaaacctctaacgagatcattagcatcaagcccaaagtgtataacggaaaggacgataaacttaatgagaagtacggctactataaatccctgaaccccgcgtacttcctctatgttgaacacaaggagaagaataaaagaatcaagtcttttgaacgggtgaacctggtcgacgtgaataacattaaagatgaaaagagcctggttaaataccttatcgagaataagaagctggtggaacctcgcgtcattaaaaaggtgtataaaagacaggttatcctcattaaccattacccgtattccatcgtgacactggactctaataagctcatggatttcgagaacctgaaacccctttttctggaaaataagtacgagaaaatcctcaagaacgtcattaagttcctggaagacaatcaggggaaaagcgaggagaactacaagtttatctatctgaaaaagaaagatcggtacgaaaagaatgagacgcttgaatccgtgaaggaccgctataacctggagttcaacgaaatgtacgataaatttctcgagaagctggacagcaaagattataagaattacatgaacaataaaaagtatcaggagctcctggacgtgaaggaaaaattcattaaacttaacctgtttgacaaagccttcaccctgaagtcttttctcgatctgttcaatagaaaaacaatggctgacttttccaaggtcggacttaccaagtacctgggcaaaatccagaagattagctctaacgttctctccaaaaatgagctgtacctcctggaagagagcgtgacagggcttttcgtgaagaaaatcaagctgtga

SEQ ID NO: 4256 - RNA, 4104 nt, synthetic construct
  misc_feature 1..4104: note = Cas9 variant
  source 1..4104: mol_type = other RNA
atgaagaaacagaagttcagcgactactatctgggctttgatatcgggaccaactccgtgggatggtgcgtcacagacctcgattacaatgttctgagattcaacaaaaaggacatgtggggctctcggctttttgatgaggccaaaacggctgccgaacgcagagtgcaacggaatagccgcagacggctgaagcgcagaaagtggcggctcaacctgcttgaggaaattttctccgacgagatcatgaaaattgattctaactttttccgcagactgaaggaaagctccctctggctggaggacaaaaattctaaggagaaatttaccctgttcaatgatgacaactataaggattacgacttttataagcagtaccccacaatcttccacctccgggatgaactgattaaaaatcctgagaagaaagacatccgccttatctatctggcgctccatagcatttttaagtccagagggcacttcctgtttgaaggacagaaccttaaagagatcaagaatttcgagaccctgtacaacaatctcattagcttcctggaagacaacggcatcaataaatctattgataaggacaacatcaagaaactggagaagattatctgtgattccgggaaaggactcaaggacaaagaaaaggagtttaaggaaatcttcaacagcgataaacagctggtggctatttttaaactttctgtcggctccagcgtgtctctgaatgacctcttcgatacagacgagtacaaaaaggaggaagttgagaaagaaaagatctcctttcgggagcaaatttatgaagatgacaagccgatctactatagcattctgggcgagaaaatcgagcttctggatatcgccaagtccttctacgactttatggtgctcaacaatattctgtctgacagcaactatatctccgaagccaaagtcaagctgtacgaggaacataaaaaggatctcaagaatctgaaatatattatccgcaagtacaacaaagagaattacgacaaacttttcaaggataagaacgaaaataactatcccgcttacattgggctgaataaagagaagggaaagaaagaggtggttgaaaagagcggcctcaaaatcgacgatctgatcaaggtgattaaagggtatcttcctaagcccgagagaatcgaagagaaggacaaaaccatttttaacgagatcctgaataagattgaactcaaaacaatcctgcctaagcagcggatttctgataacggaaccctgccctaccagatccacgaggtcgaactcgagaaaatcctggaaaatcagtccaagtattacgacttccttaactatgaggagaacggcgtgagcacgaaggataaactgctcaagacctttaaattccggattccttactacgtggggccgcttaattcttatcataaggacaaaggaggcaacagctggatcgtccgcaaggaagagggcaagattctgccctggaattttgaacaaaaagttgatatcgagaagtccgccgaagagttcattaaacggatgacaaacaagtgcacctaccttaatggggaggacgtgatccctaaagattctttcctctatagcgaatacatcattctgaacgagctgaataaggtgcaggtcaacgacgaatttctcaatgaggaaaacaaaagaaagatcattgacgagctgttcaaggagaataaaaaggtgtccgagaaaaagtttaaagagtatcttctggttaaccagatcgctaatcgcacagtggaactcaagggaattaaggatagcttcaactctaattacgtctcctatatcaaatttaaggacatcttcggcgagaaactgaacctggatatttacaaggagatcagcgaaaaatctattctttggaagtgtctctacggggacgataagaaaatctttgagaagaaaattaagaacgaatatggagacatcctgaataaagatgagatcaagaagattaactccttcaaatttaatacctggggccggctgagcgaaaagctcctgacggggatcgagttcattaaccttgagacaggagaatgctactcctctgtgatggaggccctgagacgcaccaattataacctcatggaactgctgagctccaaatttacacttcaggagtctatcgacaatggcaacaaggaaatgaatgaggttagctaccgggatctcattgaggaatcctatgtgagcccctctctgaaaagagcgatcctgcaaaccctcaagatttacgaggaaatcaagaaaatcaccggccgcgtccctaagaaagtgttcattgagatggccagagggggagacgaaacaatgaagaacaaaaagatccccgctagacaggagcagctgaaaaagctgtatgattcctgtggcaatgacattgccaactttagcatcgatattaagaaaatgaagtcttccctgagctcttacgacaataacagcctccgccaaaagaagctgtacctgtattaccttcagttcgggaaatgcatgtatacgggacgggagatcgacctcgatagactgctgcagaataacgacacctacgatatcgaccacatttatccgcggtccaaggtcatcaaggatgacagcttcgataacctcgtgctggttcttaaaaatgaaaacgctgagaagtctaatgaataccctgtgaaaaaggagattcaggagaaaatgaagtccttttggcgcttcctgaaggagaaaaactttatcagcgacgagaagtataaaagactcacaggcaaggatgacttcgaactgcgggggtttatggccagacaactggtcaatgtgcgccagaccacaaaagaggttggcaagattcttcagcagatcgaacccgagatcaagattgtgtactccaaagcggagatcgcctctagcttccgggaaatgtttgatttcattaaggtcagagagctgaacgacacccaccatgctaaagacgcctacctcaatatcgtggctggaaacgtgtataatacgaagtttacagaaaaaccttaccgctatctgcaagagattaaggaaaactacgatgttaaaaagatctataattacgacattaagaacgcctgggataaagaaaattccctcgagatcgtcaagaaaaacatgaagaaaaataccgtgaacatcaccagattcattaaggaagagaagggccagctgtttgaccttaatcccatcaaaaagggggaaacatctaacgagattatcagcattaaacccaagctgtataacggaaaagaagagaagctcaatgagaagtacggctactataaatccctgaaccctgcctacttcctgtatgtggaacacaaggagaaaaataagcggatcaaatctttcgaacgcgtcaaccttgtggatgttaataacatcaaggacgaaaagagcctggtgaaatacctcattgagaataagaaactggtcgaaccgagactcatcaagaaagtgtataagcggcaggttattctgatcaacgattacccctattccattgtggctcttgacagcaataaactgatggattttgagaacctcaagcctctgttcctggaaaataagtacgagaaaatccttaagaacgtcatcaaatttctggaagacaatcaggggaagtctgaggagaactacaaattcatttatctcaagaagaaagatcgctacgaaaagaatgagaccctggaatccgtgaaagacagatataacctcgagtttaacgaaatgtacgataagttcctggagaaacttgacagcaaggactataagaattacatcaacaataaaaagtataaaaacctgctggatgttaaggagaaatttattaagctcaatctgttcgacaaggcgtttacacttaaatctttcctggatctctttaaccggaagacgatggccgacttctccaaagtgggactgaccaagtacctcggcaaaatccaaaagattagctctaatgtcctgtccaagaacgaactttacctgctggaggaaagcgtgacagggctctttgtgaaaaagatcaaactgtga

SEQ ID NO: 4257 - RNA, 4104 nt, synthetic construct
  misc_feature 1..4104: note = Cas9 variant
  source 1..4104: mol_type = other RNA
atgaagaaacagcaattcagcgactactatctgggctttgatatcgggaccaactccgtgggatggtgcgtcacagacttcaattacaacgttctcagatttaataagaaagatatgtggggctctcggctgttcgacgaggccaagacggctgccgaacgcagagtgcagcggaacagccgcagacggcttaaacgcagaaagtggcggctgaatctcctggaggaaatttttagcgatgagatccttaagattgactctaacttctttcgcagactgaaagaaagctccctctggctggaggataagtctagcaaagagaagttcaccctgtttaatgacgataactataaagactacgatttctataagcagtaccccacaatctttcacctccggaatgaactgattaagaaccctgagaaaaaggacatccgccttgtgtatctggcgctccactccatcttcaaaagcagagggcactttctgttcgaaggacagaatcttaaggatattaaaaacttcgagaccctgtacaataacctcatggcttttctggaggacaatgacatctacaagaacattgattcttcctatatcggcaacctggaaaatattatctgtgacagcaaaaaggggctcaaggataaagagaaggagttcaaagagatttttaactctgacaagcaactggtcggattctttaaactttccgtgggcagctctgtttccctgaatgatctcttcgacacagatgaatacaagaagggcgaggtggagaaagaaaagatcagctttcgggagcagatctatgaagacgataaaccgatttactattccatcctgggggagaagattgagttccttgacatcgccaaatctttttacgatttcatggtcctgaacaatattctcgccgacagccagtatatctccgaagctaaggtgaagctgtacgacgagcataaacgcgatctgaagaacctcaaatacatcattagaaagtataataaagaaaactacgacaagctgtttaaggataaaaatgagagcaactattctgcctacatcggacttaataaggaaaaaggcaagaaagaggttattgaaaagtcccggctgaaaatcgacgatttcgctaagattatcaaggggtatctccccaaagccgagaagatcgacgagaaagatagaagcatttttaacgaaatcctggacaagattgagcttaaaaccatcctgcctaagcagcgcatttctgataatggaacactcccctaccaaatccacgaagcggagctggagaagattctggaaaaccaggccaaatattacgacttcctcaatcatgaggaaaacggcatcagcaccaaggataaactgcttatgacgttcaagtttcggatcccttactatgtggggcccctgaactcctaccacaaaaataagggaggcaactcttggattgtcagaaaggaggaaggcaaaatcctcccttggaatttcgagcagaaggtggacattgagaaaagcgctgaagagtttatcaagcgcatgaccaacaaatgcacatatctgaatggggaagatgtgattccgaaggactccttcctgtacagcgagtatatcatccttaacgaactcaataaggtccaggttaacgacgagtttctgaataaagagattaagaaaaagatcattgaagatctgttcaaaaagtctaaaaagatctccgagaagaactttcgggaatacctcctggtgaatcaaattaccaacaaaacagtggagcttaagggagtcaaagacgccttcaatagcaactatgtgtcttacatcaagtttaaagatatcttcggcgacaagctgaatctcgatatttacaaggaaatctccgagaaaagcattctgtggaagtgtctgtatggggacgataaaaagatctttgagaaaaagattaagtccgtttacggagacatccttaccaaagatgaaatcaagaaaattaactctttcaagtttaacacgtggggcagactcagcgagaaactgctgacagaaatcgagttcattgacctcgagaccggggaatgctattcctctgtgatggatgctctgcgccggacaaattacaaccttatggagctgctcagctccaagttcaccctgcaggaaaatatcgacaacgagaataaggaagtcagcgagttttcttatagagatctggtggaggaatcctacgttagcccctctcttaaacgcgccattctccagaccctgaagatctatgaggaaattcggaaaatcacaggaagaatccctaagaaagtgttcattgagatggcgcgcggcggcgacgaaacgatgaagaacaagaaaatccccgcccggcaagagcagctgaagaaactctacgactcctgtgggaaggatattagcaatttttctatcgacattaaagagatgaagaacagccttaattcctacgataacaatagcctgagacagaaaaagctgtatctctactatctgcagttcggaaagtgcatgtacaccggcaaagaaatcgacctgaaccggcttctccaaaataacgatacatatgacatcgatcacatttaccctcgctctaaggtcatcaaagacgattcctttgacaatctggtgctggtcctcaagaacgagaacgctgaaaaatccaatgagtatcccctgaagaaggaaattcaggagaaaatgaagtccttctggaaatttcttaaggagaaaaacttcatctctgatgaaaagtacaagagactgaccgggaaagacgagtttgaactccggggattcatggccagacagctggtgaatgttcgccagacaaccaaggaggctggcaaaattctgcaacagatcgagccggaaatcaagattgtgtacagcaaagccgagatcgcctcctcttttcgggaaatgttcgacttcattaaggtcagagagcttaacgatacgcatcacgctaaggacgcgtatctgaatatcgtggccgggaacgtttacaatacaaaatttaccgaaaagccttatcgctacctccaggagattaaagagaactatgatgtgaagaaaatctacaattatgacattaagaacgcttgggataaagaaaagagcctggagatcgtcaagaaaaatatggaaaagaacaccgtgaatatcacaagattcattaaagaggaaaagggccagctctttgacctgaaccccatccggaaaggagagacctccaatgagattatcgccattaagcctaagttctacgaaggctctacagagaaacttaacgaaaagtacgggtattacaaaagcctgaatcccgcctattttatctacgtggagcataaggagaaaaacaagatcattcgctccttcgaaagagttaacctcgtcgatgtgaataagatcaaagacgaaaagagcctgattaaatatctgatcgaaaacaagggacttattgagcccaaagtgatcaagaaggtctacaaacggcaagtgatcctgattaataactttccttattctatcgttgctctcgattccaataagctgatggacttcgaaaacctcaaaccgctgtttcttgagcgcaagtacgagaaaattctgaagaatgccatcaaattcctcgaagataaccagggcaagacggaggaatactataagtttctgtacctgaaaaagaaagacagaaatgagaagaacgaaaccattgatagcgtgaaagagcggtataatatcgagttcaacgaaatgtacgacaagtttcttgagaagctggactctaaagattataagaattacattaacaataaaaagtattccgaactcgtcaacgtgaaagagaagttcatcaagctgaacctcttcgacaaagcgtttacacttaagagcttcctggatctgtttaatcgcaaaaccatggctgacttctctaaggttgggctgacaaaatacctcggaaagatccagaagatttccagcaacgtgctgtccaaaaatgaacttcatctgctcgaggagagcgtcaccggcctgtttgtgaagaaaatcaagctctga

SEQ ID NO: 4258 - RNA, 4104 nt, synthetic construct
  misc_feature 1..4104: note = Cas9 variant
  source 1..4104: mol_type = other RNA
atgaaggactactatctgggcctcgatatggggagctcctctgtgggatgggccctgagcgacgagagatacaaccttctgcgggctaaaggcaaggatctctggggagtccgcctgttcgacgaagccaaaaccgcggctgagagacggacatttcgctcccagagacggcgccttgaaagatctaagtggcggctgagcctcctgacgtccctgttcgaggaagagatctctaaaattgatgacaagtttttcgatcgcctcaaggacagcaaatttttcatcgatgacaagtccgatcaacagcccaataccctgtttaacgacgttaatttcacagataaagagtatcacaagagataccctagcatttatcatcttcggaacgccctgtttaatcagaacgacaaattcgacatccgcctcatttttctggccctttctcacatcgtgaagaagagagggcatttcctgtttgatggcgacaaagctgggttcggagaagatatcgacgtgattctcgatgagctgaaggcctacctgcaggacgctttccacaccaaactcgaatttacatccgagttcaagagcatcatgctggataaaaatcttcggaagaaacaaaaggaggaagaactgaagaactctattaaaatctccagcgacaccattaattctaaggatggcaaatccatcctcattaagctgtttcttggctatgaagccaacctgaaaccgttctttctcgagtacaaggtcgaaaaggacaatgagtacaaaatcaacttcagcaaggaggattatgaagagaaactgctggacatgacatccaagtttgaagagaccacgtacttcatcgaaattgcgaaaaagatccatgactattttctcctggaggagattatgcttgggttcaagaatatctctgccagcaaagtgtccatttaccagaagcacaaaaacgatctgaagaccctcaaaaatatcgttaagaaccagatcaacaatagctataacgctatttttaaggacatcggactggataattaccccgcctatgtgtcttgctggaactccaaaaagcacaaagaaaagcagaaaggctgtacaaaggacaaattctacgcttttcttaagaccaagctgaaaaatattaacaatgccaaggagatcctcgatagcattgacaacgatgacttcctgcctcgcctggtcgataaaaattctatcatcccccatcaaattcacctcgcggaactgatcaagattatcgacaaccagagccagtactatcctttccttaaagagattaaggataagatcatttccatctttaaattcagaatccccttttacgtggggcctctgaataacttccataaggacaaaggaggcaatgcctggattgaaaagctcaaagatgagcggatctttccgtggaacttcaatgacgttgtggacctgaacaagtctgctgccaactttattgagaagatgatcaatgaatgcagctatctgaaaggggagaaggtccttgctaaaaactccctcctgtacacaaagtatagcgtgctgaatctcattaacaaactgaagatcaatggaaccgccgtgtctgtcgaaacgaagcagaaaatctacaacgagcttctgctcaagcaaaagaatattaagaaaacagccatcaagaaattcctgattaacaattccatcattgataagaacgacgagatcagcggcatcgatgactctctgacctccaatcttgctgtttttattgatttcgaaaagatcagcaacagactccgctatgaccagaaagaggatattatcaagtccatttctctgtttggctacgacaatgcgatgctgaaaaagcagatcatcacaattgcccccgatctcagcgaagacgagctggaaaaactttccaagctgcggtactctgggttcggaagactcagcaagcgcctgctgacctccatcaaacacaacggcaagagcattatcgagatgctttgggataccaatgacaacctcatggagctgctgtctgatcggtatacatttattgaacaaatcaacaaacacaatgacgggttcaaggaggacattaacctcaatttccagaacgtggatacgctgtacgtgtcccctagcgtcaaaagacagatctggcaggcttttaaggtgatcaatgaacttatttctgttatgggacgcgagcccaagaaaatcttcgtggaaatggcccgggaggagggcgaaaagaaaagaacccaagcccgcaaggacaaagtcctggagctctataagtccattaagaacaatgaaatcagcacatttctgaccaacttcaaagatattaagacaaaactggagggggaatctaatcttaacagcaagaaactctacctgtattacctgcagctcggagtggacatctataccggcgagaagatcccttttgagaagctgttcgatcagaatatttacgacatcgatcatgttattccccggtcccttaaaaaggacgatagctttgacaacctggtgctcacgtctaaaacaaataacgctaagaaaaccgatgagttcccggtctccagcgagatccagtccaagatgcaaaccttttggaaagtgctgaaggacaaggacctgatgtctgaaattaaatacacaaatcttaccagaaagacacacctgagcgatgacgagctcggcgatttcatcgcccgccagctggtcgagacgcggcagtccaccaaagcgctcacacagatcctgaagaacgtgtatgctaactctgacattgtttacgtgaaagccgggatcgtcagcgaatttagacaacagttcgatatgcttaagattcgggagctgaatgacttccatcacgccaacgatgcttatctcaatatcgtgattggaaacgtttacaatatcaagtttaccaaaaaccctcgcaattatgtgaaggaatactataaaaagggcgagcattacaacctgaaaattgaaaagatgctggagaaggacatcgccagagggggaaatttcggctgggataaaaagcactccatcgagacagtccagaaaaccatgaagaaacagtctccccttattacgtaccggacctttgaaaacaagggggagttctttaatcaacagcctagcaaggcttccgccaacctgctcgcgctgaaaagctctgacaagagactcctggatacagtgcgctatggcggatacaaaggcacccagtatgcccacatgttccttgtggaacattttaatgggaagatcattaaagagatcatgggagttcccatttacctgtccaaggaaatcaaagacgataaggctaagctcctggagtattgtaacgacgtcctgaaacttaagaatcccaaaatcctgttcagcaagattccttacaactctctcatcgtgtataatggctacccgattctgctccgggggctgacaggagtgagaggcgccgctcaacttaaactggaccagacctccacgcaggtcgtgaagaacatcgttaagctgtacgattggctcagccagaaacaaaaggagctgtctgacctttccaaaaagattgaatttttccaggagaacaataaaaaggatgaagtgaaggccgcgatgctggaggccgacaacatcctctttatcctgaatgatcgcttcaaaaacacaaagattgggaaagacatcatgaatgataaccacctcaataacctgtatgacacctttattaataaacttgaaaacagcatctacaaaaataagcccggcggaaagcaggatgtcctgatgaaagagaagagagacctgttcctctccttcagcatgtctaaaaagtgcattacactgtataaaatcattaagatctttggcagctgtgatcagggggtggacttctccgatatcgctgagaaaatttctaagagcggaggcatcgggggaaagaaccttggcaaaaatacctttgacctggttttcaaggaaaactccacctacacactcgtgcaatctagcgtcacggggctgtatgccaaaaagaccgacctccataaactgtga

SEQ ID NO: 4259 - RNA, 4104 nt, synthetic construct
  misc_feature 1..4104: note = Cas9 variant
  source 1..4104: mol_type = other RNA
atgaagaaacagaagttcagcgactactatctgggctttgatatcgggaccaactccgtgggatggtgcgtcacagacctcgattacaatgttctgagattcaacaaaaaggacatgtggggctctcggctttttgaggaagccaaaacggctgccgagcgcagagtgcaacggaatagccgcagacggctgaagcgcagaaagtggcggctcaacctgcttgaagagattttctccaatgaaatcctgaaaattgattctaactttttccgcagactcaaggagagctccctgtggctggaggacaaatctagcaaggaaaaatttaccctcttcaatgatgacaactataaggattacgacttttataagcagtaccccacaatcttccatctgcggaatgagcttattaaaaaccctgaaaagaaagatatccgcctggtgtatctcgcgatccactccatttttaagagcagagggcacttcctgtttgagggacagaatcttaaagagatcaagaacttcgaaaccctgtacaataacctcattgctttcctggaggacaatggcatcaacaaaattatcgataagaacaatattgaaaagctggagaaaatcgtctgtgactctaagaaagggctcaaggacaaagaaaaggagtttaaggagatcttcaactccgataaacagctggtggccatttttaaacttagcgttggatcttccgtgagcctgaatgacctcttcgatacagacgaatacaaaaagggcgaggtcgaaaaagagaagatctcttttcgggaacaaatttatgaggatgacaagccgatctactattccattctgggcgagaaaatcgaacttctggatatcgccaagaccttctacgactttatggtgctcaacaatattctggctgatagccagtatatctccgaggccaaagttaagctgtacgaggagcataaaaaggacctcaagaacctgaaatatattatccgcaagtacaataaagggaactacgataaacttttcaaagacaagaatgaaaacaattattctgcttacattggactgaacaaagaaaagagcaagaaagaggtgatcgaaaagtccagactcaaaatcgacgatctgattaagaatatcaaaggctatcttcccaaggtcgaggaaattgaggagaaggacaaagccatctttaacaagattctgaataaaatcgaactcaagacaattctgcctaaacagcggatcagcgataacgggaccctgccctaccagatccacgaggcggaactcgagaagattctggaaaaccaatctaagtattacgacttccttaattatgaggagaacggaatcattacgaaagataagctgctcatgacctttaaattcagaatcccttactacgtgggcccccttaattcctatcataaggacaaagggggaaacagctggattgtgcgcaaggaagagggcaagatcctgccttggaattttgaacagaaagtcgatatcgagaagtctgccgaagagttcattaaacggatgacaaacaagtgcacctacctgaatggcgaggacgttatcccgaaagatacattcctctatagcgaatacgtgattctgaacgagctgaataaggtgcaggtcaacgacgaatttctcaatgaggaaaacaaaagaaagatcattgatgagctgttcaaggagaataaaaaggtgtccgaaaagaagtttaaagagtatcttctggttaagcagatcgtggacgggaccatcgaactcaagggagtcaaagattctttcaacagcaattacatttcctatatccgctttaaggacattttcggcgagaaactgaacctggacatctacaaggagattagcgaaaaatctatcctttggaagtgtctctacggggatgacaagaaaatctttgagaagaaaattaagaacgaatatggagatatcctgacgaaagacgagattaagaagatcaatacattcaaatttaacaattggggccggctgtccgaaaagctcctgaccgggattgagttcatcaaccttgagacaggagaatgctacagctctgtgatggatgctctgagacgcaccaattataacctcatggagctgctgtccagcaaatttacccttcaagaatccattaataacgagaataaggaaatgaacgaggcctcttaccgggacctcatcgaggaaagctatgtttccccctctctgaaaagagctatcttccagacactgaagatttacgaggaaatccgcaagattacgggccgggtgcctaaaaaggtctttatcgagatggccagaggcggggatgaaagcatgaaaaataagaaaattcccgcgcgccaggagcaactcaagaaactgtatgactcctgtggaaacgatatcgccaatttcagcatcgacattaaggagatgaagaactctcttatctcctacgataataacagcctgcggcagaaaaagctctacctgtattacctgcagttcggcaaatgcatgtataccgggagagaaattgaccttgatcggctcctgcagaacaatgacacatacgacatcgatcacatttatcctcgctctaaggtgatcaaagacgattcctttgacaacctggtcctcgtgctgaagaatgagaacgctgaaaagagcaatgagtaccccgttaaaaaggagatccaagaaaagatgaagtctttctggagatttcttaaagagaagaacttcattagcgatgaaaagtataaacggctgaccggaaaggacgattttgagctcagaggcttcatggcccgccagctggtgaatgtccggcagacaaccaaagaagtggggaagatcctgcagcaaattgagccggagatcaaaattgtttactccaaggctgaaatcgccagctcttttagagagatgttcgactttattaaggtgcgcgaacttaacgatacgcaccatgccaaagacgcttacctgaatatcgtcgcgggcaacgtgtataatacaaagttcaccgagaaaccttacagatatctccaggaaatcaaggagaactacgatgtgaaaaagatttataattacgacatcaaaaacgcctgggacaaggaaaattccctggaaattgttaagaaaaacatggagaagaataccgtcaacatcacacggtttattaaagaaaagaaaggacaactcttcgatctgaaccccatcaagaagggcgagaccagcaatgaaatcatttccatcaaacctaaggtgtataacgggaaagacgataaacttaatgagaaatacggatactataagtctctgaaccccgcttacttcctctatgtggagcacaaggagaaaaataagcgcattaagagctttgagagagtcaacctggtggacgttaataacatcaaggatgaaaaatccctggtgaagtaccttattgagaataagaaactggtcgagccccgggtgatcaagaaagtttataagcgccaggtgatcctcattaacgactacccttattctatcgtcacactggatagcaataaactcatggacttcgaaaacctgaagccgctttttctggagaataaatacgaaaagattctcaagaacgtgatcaaattcctggaggataatcagggcaagtccgaagagaactacaaatttatttatctgaagaaaaaggacagatacgagaagaacgaaacgcttgagtctgttaaagatcggtataatctggagttcaacgaaatgtacgacaagtttctcgaaaaactggatagcaaggactataaaaattacatgaacaataagaagtatcaggagctcctggacgtgaaagagaagttcatcaaacttaacctgtttgataaggccttcaccctgaaatcctttctcgacctgttcaatcgcaagacaatggccgattttagcaaggtcgggcttaccaaatacctgggaaagattcagaaaatctcttccaacgtgctcagcaagaatgaactgtacctcctggaggaatctgtgacaggccttttcgtcaaaaagatcaagctgtga

SEQ ID NO: 4260 - RNA, 4104 nt, synthetic construct
  misc_feature 1..4104: note = Cas9 variant
  source 1..4104: mol_type = other RNA
atgaagaaacagaagttcagcgactactatctgggctttgatatcgggaccaactccgtgggatggtgcgtcacagacatgaattacaacgttctcagattcaataaaaaggatatgtggggctctcggctgtttgaggaagccaaaacggctgccgagcgcagagtgcaacggaacagccgcagacggcttaagcgcagaaagtggcggctgaatctcctggaagagattttctccaacgaaatccttaaaattgactctaactttttccgcagactgaaggagagctccctctggctggaggataaatctagcaaggaaaaatttaccctgttcaatgacgataattataaggactacgatttttataagcagtaccccacaatcttccacctccggaacgagctgattaaaaatcctgaaaagaaagacatccgccttgtgtatctggcgatccattccatttttaagagcagagggcacttcctctttgagggacagaacctgaaagagatcaagaatttcgaaaccctttacaacaatctgattgctttcctcgaggataacggcatcaacaaatctattgacaaggataatctggaaaagctggagaaaatcgtctgtgactccgggaagggactcaaagacaaggaaaaagagtttaaggagattttcaacagcgataagcagctggtggccatctttaaactttctgttggcctgtccgtgagcctcaatgacctgttcgatacagacgaatacaagaaaggcgaggtcgaaaaggagaaaatctcttttcgggaacaaatttatgaggatgacaagccgatctactattccattcttggggagaagatcgaactgctcgatattgccaagagcttctacgactttatggtgctgaacaatatcctggctgattcccagtatatctctgaggccaaggttaaactctacgaggagcataagcgcgacctgaaaaaccttaagtatattatcagaaagtacaatcgggaaaactacgataaactgttcaaggacaaaaatgagagcaactatcccgcttacattggactcaataaggagaaatccaagaaagaagtgatcgaaaagagcaagctgaaaattgacgatcttatcaagtctatcaaaggctatctgcctaaggtcgaagagattgaggaaaaagacaaggccatctttaacgagattctcaataagatcgaactgaaaattatcctgcccaagcagagaatttccgataacgggaccctcccttaccagatccacgaggcggaactggagaaaatccttgagaatcaaagcaagtattacgacttcctgaactatgaagagaacggaattatcacaaaagataagctcctgatgacctttaagttccgcattccctactacgtgggccctcttaattcttatcataaagacaaagggggaaacagctggatcgtgcggaaagaagagggcaagattctgccgtggaattttgaacagaaagtcgatatcgagaagtccgccgaggagttcatcaagagaatgacgaacaaatgcacctacctcaatggcgaggacgttattcccaaggattctttcctgtatagcgaatacatcattctgaacgagctcaataaagtccaggtgaacgacgaatttctgaatgaggagaacaagcgcaaaatcattgaggaacttttcaaggggaataaaaaggtgtccgaaaagaaatttaaggagtatctgctcgtgaaccagatcacaaccggaacaatcgagctgaaaggcattaaggatagcttcaattctaactacatctcctatattaaatttaaggacatcttcggggaaaagctgaatcttgatatttacaaagagatcagcgaaaagtctatcctctggaaatgtctgtacggagacgacaagaaaatttttgagaagaagatcaaaaacgaatatggcgatattctgaccaaggacgagatcaaaaagattaacacgttcaaatttaataactgggggcggctctccgagaagctgcttacaggaatcgagttcattaatctggaaaccggcgaatgctacagctccgttatggaggctctcagacgcacaaactataatctgatggaactgctttctagcaagtttaccctccaagagaacatcgataatgagaacaaagacatctcccagttctcttaccgggatctggtggaagagagctatgtctcccctagcctgaagagagccattctccagaccctgaaaatctacgaagagattaagaaaatcacaggccgcgtgcccaagaaggtttttattgaaatggctagagggggagacgagtctatgaaaaataagaaaatccctgcccggcaagagcagcttaagaaactgtatgattcctgtggcaacgacatcgcgaatttcagcattgatatcaaggaaatgaaatcttccctcagcctgtacgacaacaattctctgcgccagaagaaactttacctctattacctgcagttcgggaaatgcatgtatacgggacgggagattgatctggacagactcctgcaaaacaatgatacctacgacatcgaccacatttatccccggagcaaggtgatcaaagatgactcctttgataaccttgtcctggtgctcaagaacgaaaatgccgagaaaagcaacgagtacccggtcaagaaggaaatccaggagaaaatgaagtctttctggcgctttctgaaagaaaagaatttcatttccgacgagaaatataagagactgacaggcaaggatgactttgaacttcgggggttcatggctagacagctggtgaacgttcgccagaccacaaaagaggtgggcaagatcctccaacagattgagcctgaaatcaaaattgtctacagcaaggccgagatcgcttcctcttttcgggaaatgttcgattttattaaagtgagagagctgaatgacacccaccatgccaaggatgcctacctcaacatcgttgctggaaatgtgtataacacgaagttcacagaaaaaccctaccgctatctgcaggagatcaaggagaattacgacgtcaaaaagatttatagctacgatatcaaaaacgcgtgggacaaggaaaattcccttgagattgtgaaaaagaacatggaaaagaataccgtgaacatcaccagatttattaaagaggaaaagggccagctgttcgacctcaatcctatcaaaaagggggagacatctaacgagatcattagcatcaaacccaaggtttataatggaaaggatgacaaactgaacgaaaagtacggctactataaatccctgaaccccgcctacttcctttatgtcgagcacaaggaaaagaataagcggattaagtcttttgagcgcgtgaacctggtggatgtcaataacatcaaagacgaaaagagcctcattaaatacctggtggaaaataagaaactcgttgagcctagagtgatcaagaaggtctataaacggcaagtgatcctgattaacgattacccgtattccatcgttgctcttgacagcaataagctgatggatttcgaaaacctcaaacccctgtttctggagcgcaagtacgagaaaattcttaagaatgtgatcaaattcctggaagacaaccaggggaagtctgaggaaaattacaagtttatttatctcaaaaagaaagatagatacgagaagaacgaaaccctggagtccgtccgggaacgctataatatcgagttcaacgagatgtacgacaaatttctcgaaaagctgaatagcaaggattataaaaactacattaacaataagaaatatcaggaccttctggatgtgaaggagaaattcatcaagctgaacctctttgacaaggccttcacactgaaatcttttcttgacctgttcaatagaaagacgatggccgatttttccaaagttggactcaccaagtacctgggcaaaatccagaagattagctctaacgtgctctccaagaatgaactgtaccttctggaggaaagcgtcacagggctgttcgtgaaaaagatcgagctctga

SEQ ID NO: 4261 - RNA, 4104 nt, synthetic construct
  misc_feature 1..4104: note = Cas9 variant
  source 1..4104: mol_type = other RNA
atggtgaagaaaaagtacgccatcggcattgacatcgggaccaacagcgtcggatggtccgttgtgacagatgactataaagtgccctctaagaaaatgaaggtcttcggcaatacggagaagagatacattaaaaagaacctgctcgggaccctgctttttgatgaaggaaatacagctgagaaccggcgcctgaaaagaaccgcccggcgcagatatacacggcgcagaaatcggatcctctacctgcaggaaattttcgcggaggaaatcaacaagatcgacgatagctttttccaacgccttgacgattcctttctgattgtggaggacaaacagggctctaagcaccctatcttcgggaccctccaggaggaaaaggagtatcataaacagtttccgacaatttaccacctgagaaagcaactggctgatagctcccagaaagccgacatccggctcatttatctggcccttgctcatatcattaagtaccgcggacacttcctgtttgaaggcgatctcaaatctgagaataaggacgttcagcatctgttcaacgattttgtggagatgttcgacaaaaccgtcgaaggcagctacctttccgagaatctgcccaacgtggccgacgttctcgtggaaaaggtcagcaagtctagacggctggagaatatcctgcactattttcctaacgagaaaaagaatgggcttttcggaaacttcctgacgcttgctctgggcctccagcccaattttaaaaccaacttcgaactggccgaggatgcgaagatccaattttccaaagaaacatacgaggaagaccttgaggaactgctcgggaagattggagatgactatgccgatctgttcatcgctaccaagagcctgtacgacggcattctcctggccgggatcctttctacaaccgattccacgacaaaagctcctctgtctagctccatggtgaaccgctatgaggagcaccagaaggacctcgccctgcttaaaaattttattcatcagaacctgagcgattcctacaaggaagtgttcaatgacaaactcaaggatggatatgcgggctacatcgagggcaagaccacacaggaaaacttttacagattcatcaaaaaggccattgagaaaatcgaagggtctaattattttattgacaagatcgaccgggaggatttcctgagaaaacaacgcacctttgacaacggaagcattccccaccagatccatctgcaggagatgcacgctatcattcggagacaagccgaattttacccttttctcgtcgagaatcaggataagatcgaaaagattctgaccttccgcatcccgtattacgttggcccccttgctcgggggaaatccgagttcgcctggctgaacagaaagagcgacgagaaaattcgcccttggaattttgatgaaatggtggacaaggagacatctgccgaaaacttcatcacgcggatgaccaattatgatcagtacctccccgaccagaaagtgctgcctaagcactccctgctttatgagaaatttgctgtctacaacgaactcacaaaggtgagatacgttaccgagcaaggaaagagcttctttttcgatgcgaatatgaaacaggagatttttgacggcgtgttcaaggtctatcgcaaagtgacaaaggaaaaactgatggattttctggggaaggagttcgacgaatttcggatcgttgatctcctgggacttgacaaggacaacaaatctttcaatgccagcctgggcacctaccatgatctcaagaaaatcgtgtccaaggacctgctggataaccccgagaacgaagacattcttgagaatgtcgtgctcacgctgacactgtttgaggatagagaaatgatccgcaaacggctcgagaagtataaggacgtcctgaccgaggaacagcggaaaaagctcgaacggcgccactacaccggctgggggagactgtctgctaaactcattaacggaatccgggataaggtgacaagaaaaaccattctggactatctgatcgatgacggcacaagcaatcgcaacttcatgcagcttatcaatgatgacacgctctccttcgttgatgagattcggctggcccaagggagcggagaggccgaagactacagagctgaggtgcagaacctggccggctctccggcgatcaagaaggggattctccagtccctgaaaatcgtcgacgaacttattgaggtgatgggctatgatcctgagcatatcgttgtggaaatggctcgcgagaatcagtttaccaaccaaggaagacggaatagccagcagcgctacaagaaaatcgaaaacgccattaagaatctggactctaacctcaattccaaaatcctgaaggagtaccccacaaacaatcaggccctgcaaaacgatagacttttcctctattacctgcagaacggcaaagacatgtataccgatgaggaactggacattgatcagctcagccaatacgacatcgatcacattatccctcaggcttttatcaaggacgattccctggacaataaggtccttacaaaatctgccaagaaccgggggaaaagcgacgatgtgccctccctggagattgtgcataagaaaaagaatttctggaagcagctcctggactctcagctgatcagccaacgcaaatttgataaccttaccaaggctgaaagaggaggcctgacgaatgaggacaaagcccggttcattcagcgccagctcgttgaaaccagacagatcacaaagcacgtcgcgcggattctggatacccgctttaacacaaaactcgacgaggccgggaatagaatccgggatcccaaggtgaacattatcaccctgaagtccaatcttgtgagccaattcagaaaagactatcagctgtacaaggtccgcgaaatcaacaattatcaccatgctcacgatgcctacctcaacgctgtggttgccacggcgctgctgaaaaagtaccctcagcttgccccggagtttgtgtatggagactaccccaaatataattcttacaagtccagaaagagcgctacagagaaagtcctgttctattctaacattatgaatttcttcagacgcgtgctcgtttactccaagaccggcgaagtgcggatcagacctgtcattgaggtgaacaaagaaacaggggagatcgtttgggataagaaaagcgacttccgcaccgtgcggaaggtcctgtcttatccccaggtgaacgtggtcaagaaagttgaaatgcaaaccggcggatttagcaaggagtccattctccagcatggcgatagcgacaaactgatccctagaaagacagagaaattctaccttgacacgaagaaatacgggggatttgattctcccaccatcgcctattccgtgctgctcattgctgacatcgaaaagggcaaggccaaaaagctgaaacgcgtgaaggagctgattgggatcacaattatggaacggatggccttcgagaaaaatccgatcgagtttcttgaacacaagggatacaagaacatcctggagaaaaatattatcaagctccctaaatatagcctgttcgaactcgagaacggcagacggcgcctgcttgcttccgcgaaggaactgcagaaagggaatgagatgattctgccccctcacctcgtcaccctgctttaccattctagcaacatccacaagattacagagcccatccatctgaattatgtgaacaagaataaacacgaatttaaggagctcctgagacatatttccgatttctctacccggtacatcctcgcccaagaccgcctgagcaaaatcgaggaactttatgataagaacgacggcgatgacatttccgatctgacgtctagctttgttaatctgctcacattcaccgctatcggagcccctgccgcttttaaattcctgggctccgtgattgacagaaagcggtacaccagcatcgccgaaattcttgaggcgacactgatccaccagtctgtcaccgggctctacgagacaagaatcgatctgtccaagctcggaggcgactga

SEQ ID NO: 4262 - RNA, 4104 nt, synthetic construct
  misc_feature 1..4104: note = Cas9 variant
  source 1..4104: mol_type = other RNA
atggtgaagaaaaagtacgccatcggcattgacatcgggaccaacagcgtcggatggtccgttgtgacagatgactataaagtgccctctaagaaaatgaaggtcttcggcaatacggagaagagatacattaaaaagaacctgctcgggaccctgctttttgatgaaggaaatacagctgagaaccggcgcctgaaaagaaccgcccggcgcagatatacacggcgcagaaatcggatcctctacctgcaggaaattttcgcggaggaaatcaacaagatcgacgatagctttttccaacgccttgacgattcctttctgattgtggaggacaaacagggctctaagcaccctatcttcgggaccctccaggaggaaaaggagtatcataaacagtttccgacaatttaccacctgagaaagcaactggctgatagctcccagaaagccgacatccggctcatttatctggcccttgctcatatcattaagtaccgcggacacttcctgtttgaaggcgatctcaaatctgagaataaggacgttcagcatctgttcaacgattttgtggagatgttcgacaaaaccgtcgaaggcagctacctttccgagaatctgcccaacgtggccgacgttctcgtggaaaaggtcagcaagtctagacggctggagaatatcctgcactattttcctaacgagaaaaagaatgggcttttcggaaacttcctggctcttgccctgggcctccagcccaattttaaaacgaacttcgaactggcggaggatgccaagatccaattttccaaagaaacctacgaggaagaccttgaggaactgctcgggaagattggagatgactatgctgatctgttcatcgccacaaagagcctgtacgacggcattctcctggctgggatcctttctaccacagattccaccacgaaagcccctctgtctagctccatggtgaaccgctatgaggagcaccagaaggacctcgcgctgcttaaaaattttattcatcagaacctgagcgattcctacaaggaagtgttcaatgacaaactcaaggatggatatgccggctacatcgagggcaagacaacccaggaaaacttttacagattcatcaaaaaggctattgagaaaatcgaagggtctaattattttattgacaagatcgaccgggaggatttcctgagaaaacaacgcacatttgacaacggaagcattccccaccagatccatctgcaggagatgcacgccatcattcggagacaagctgaattttacccttttctcgtcgagaatcaggataagatcgaaaagattctgaccttccgcatcccgtattacgttggcccccttgcccgggggaaatccgagttcgcctggctgaacagaaagagcgacgagaaaattcgcccttggaattttgatgaaatggtggacaaggagacctctgctgaaaacttcatcacacggatgacgaattatgatcagtacctccccgaccagaaagtgctgcctaagcactccctgctttatgagaaatttgcggtctacaacgaactcaccaaggtgagatacgttacagagcaaggaaagagcttctttttcgatgccaatatgaaacaggagatttttgacggcgtgttcaaggtctatcgcaaagtgaccaaggaaaaactgatggattttctggggaaggagttcgacgaatttcggatcgttgatctcctgggacttgacaaggacaacaaatctttcaatgctagcctgggcacataccatgatctcaagaaaatcgtgtccaaggacctgctggataaccccgagaacgaagacattcttgagaatgtcgtgctcaccctgacgctgtttgaggatagagaaatgatccgcaaacggctcgagaagtataaggacgtcctgacagaggaacagcggaaaaagctcgaacggcgccactacaccggctgggggagactgtctgccaaactcattaacggaatccgggataaggtgaccagaaaaacaattctggactatctgatcgatgacggcaccagcaatcgcaacttcatgcagcttatcaatgatgacacactctccttcgttgatgagattcggctggcccaagggagcggagaggctgaagactacagagccgaggtgcagaacctggcgggctctccggctatcaagaaggggattctccagtccctgaaaatcgtcgacgaacttattgaggtgatgggctatgatcctgagcatatcgttgtggaaatggcccgcgagaatcagtttacgaaccaaggaagacggaatagccagcagcgctacaagaaaatcgaaaacgccattaagaatctggactctaacctcaattccaaaatcctgaaggagtaccccaccaacaatcaggctctgcaaaacgatagacttttcctctattacctgcagaacggcaaagacatgtatacagatgaggaactggacattgatcagctcagccaatacgacatcgatcacattatccctcaggcctttatcaaggacgattccctggacaataaggtccttaccaaatctgctaagaaccgggggaaaagcgacgatgtgccctccctggagattgtgcataagaaaaagaatttctggaagcagctcctggactctcagctgatcagccaacgcaaatttgataaccttacaaaggccgaaagaggaggcctgaccaatgaggacaaagcgcggttcattcagcgccagctcgttgaaacgagacagatcaccaagcacgtcgcccggattctggatacacgctttaacaccaaactcgacgaggctgggaatagaatccgggatcccaaggtgaacattatcacactgaagtccaatcttgtgagccaattcagaaaagactatcagctgtacaaggtccgcgaaatcaacaattatcaccatgcccacgatgcttacctcaacgccgtggttgcgaccgccctgctgaaaaagtaccctcagcttgctccggagtttgtgtatggagactaccccaaatataattcttacaagtccagaaagagcgccacggagaaagtcctgttctattctaacattatgaatttcttcagacgcgtgctcgtttactccaagacaggcgaagtgcggatcagacctgtcattgaggtgaacaaagaaaccggggagatcgtttgggataagaaaagcgacttccgcacagtgcggaaggtcctgtcttatccccaggtgaacgtggtcaagaaagttgaaatgcaaaccggcggatttagcaaggagtccattctccagcatggcgatagcgacaaactgatccctagaaagaccgagaaattctaccttgacacaaagaaatacgggggatttgattctcccacgatcgcttattccgtgctgctcattgccgacatcgaaaagggcaaggccaaaaagctgaaacgcgtgaaggagctgattgggatcaccattatggaacggatggctttcgagaaaaatccgatcgagtttcttgaacacaagggatacaagaacatcctggagaaaaatattatcaagctccctaaatatagcctgttcgaactcgagaacggcagacggcgcctgcttgcgtccgccaaggaactgcagaaagggaatgagatgattctgccccctcacctcgtcacactgctttaccattctagcaacatccacaagattaccgagcccatccatctgaattatgtgaacaagaataaacacgaatttaaggagctcctgagacatatttccgatttctctacacggtacatcctcgctcaagaccgcctgagcaaaatcgaggaactttatgataagaacgacggcgatgacatttccgatctgacctctagctttgttaatctgctcacgttcacagccatcggagcccctgctgcctttaaattcctgggctccgtgattgacagaaagcggtacaccagcatcgcggaaattcttgaggctaccctgatccaccagtctgtcacagggctctacgagaccagaatcgatctgtccaagctcggaggcgactga

SEQ ID NO: 4263 - RNA, 4107 nt, synthetic construct
  misc_feature 1..4107: note = Cas9 variant
  source 1..4107: mol_type = other RNA
atggacaagaaatacagcatcggcctggatattgggacctcctctatcggattcgtgggcgtcgacgagaacgggtggcccctcaatattaagggaaaaagagccatcggcgctcacctgtttcgggaaggggaggccgcggctgaaacacgcggattcagaacgacccggcgcagatataaccggcgcaagtggagacttcggctgctccgcgagatttttgatgaacctatcagcagagttgacccgacattctttgcccggatgaaagagtcctctgtgagccccaaggatcctaattacgacggcctggccaaggagatccttattccccgcgataaagacggcaagatcctgtatcctaccatttaccatctcagacacgctctgatgtatgaagatcatcagttcgacatccgggagatttacctggccatccaccatattgtgaaatatcgcgggcactttctcctggatggagctgccaagaacttcgaatcctctaatcttgacctgaaaagcgatatccacgagatcaacgcgattctcgtcggcatctttgggaatgagcaagtgcagttcaacgaccagtacgttgaaaagctgaaggaggtgcttctggactccacacagagcagatctgatcggcaaaaagccgctgccaaggtcctcctgcccaccaatgacctggataaagacacaaccaagattctcaaaacggtgtccaccgaaatcacaaaggctattaccggactgaaagccaagtttttcgttatcacaggcaacgatatcgcgaaggaccagcagaaagattggacctttagcattgacacgcttgatgagaagatgtctgtgatcgaaccttccttcagcgagaaaaatttctctctgattacaatcctccagaagctgtactccagcgtcacccttgccgggattgtgccgaacggactgtccctctctgaggctatgatccaaaaatatgacagacatgccagcgatctggtgctgctcaagaagtactgggacacaaaacccaaggtcctgaaacaccagcttcagaatacctatgctgaatacatcgagattcatcaggttgtggacgaattttattccgatctgagcaagctcatcaaaaacgacgatgacaccctggcccaagagattaagtctaagatcacaattggcaatttccttcctaaacagcgcacgaccgaaaacggcgtgatcccctaccagctgcaacagcgggagctcgatacaattatcaagaaccagcaggagtattacccttggctggccgaagagaatcccgtcgctgaccaccaaatcgcgtttccgtacaaactggatgaactcgtggggttccgcattccttattacgttggacccatgatcgccaaggaggacacctccaacagcaaaaattctaagtttgcttggatgattagaaagcagagcggcgaagtgacaccttggaacttcgatgagaaaatcgaccggaccgcctccgccacggcttttattgatagaatgacaaccaccgacacatatctgatcggggaggatgtccttcccaagcagtctctgatctaccagcgcttcgaagtgctcaatgagctgaacaaaattagcatcgacggacaacccattacccggaagcagaaacagtccgtttatacacacgtgtttgaaaagaaaaagacggtccaggtgaaggacgtccaaaaattcctggtgagctctggcgaggttatgtcccttcctaagatcgggggactcgccaatgagaaacagtttaacagctctctgtccaccctgtacgattataataagattatcccggacgcgctcgaagatagaaacaaagtggacgatatcgagaagattatcctgtggagcacaattttcgaagacaattccatctttgtcgagaaacttgattctattgactggctgaccagctcccagcgcaaacggctcgctcagaagagataccgcggctggggccggctgtctctgagacttctcacaaccttcaaaaacaaggatgggtacagcatcctggacgaactgtggaactccaatcataatttcatggagatccaagcccagagcgatttttctgagcagattgccacggctaacaacaataacctctcccaagtgctgcccgccaaatgggaacctggacggaagaatcttgctagcctggacgagttcatctctaacctctataccagcccccagaataagaaagccctgcgcaaggcgattagagttgtgcaggatatgatgacagccgctggccacatgcctgaaaagatctttattgaggtcgcccgggacacctccaactctcatcagcaaacaatcgctagacagcgccagctgcagcaactttaccagagcgaagccaaggaggtgattgactccagcgtgcggtctgagctcgatgacatcctgaaaaatagagcgaacatcaaggatcagctgttcctctattttcagcaagggggacgcgacctgtacaccggcaaggccattaatatcgataaactttccctgtatcacattgaccatatcctcccccagagcctggttaaggatgactccctggataacagagtccttgtgtctcagaaaacgaatgaagacaagggggtgacattcgtcagcgataaatacatgaacaatatgctcccgacctggaagcggtggcacgagatgggcctgatttccgctcgcaaactgaagaacctcacaatgagacctgacgaaatcgacaagtatgcccccggatttatccaacggcagctggtggagacccgccaggttaccaaacttgtgattgaactgctcgatgctctgctgggcaattctcagacagagatcattacgatcaaggccagcctttcccaccaattcagacagcagtttgacctggtcaaaattcgggaggtgaacgataaccatcacgccttcgacgcttttctcgcggcccgcatcgggacctacctgtacaagagatatcctaaactccggccctacttcgtttatggacagtacatgcaaaatcataagaacctgaagtctatcaatcttattaaaacactggatagcgacaaggctatcgtggatgaaggcaccggggagattctctgggacaaaaagtccgatctggccaaaatgatcaagatttataactaccagcgcctgcttatcacacacgaaagcagaacctcttttggagccatgtataagcagaaaattctgaaggctacggacgccaaacagaatggcgggggcttcaagctcgtccctacaaaacggaactggcccgtggatatctacggaggctacaccgggcaaaccgcggcttatctgacaatcgttagagtgtactccaagaagaccagcgagctccgcgtcctgccgatttatacaaataaagtgcagcagatcgagaaggccatgacgcagggagacaaagccaccatgcttgctttcaagaaagtgattgcccctcaactgggcaaggaaaacaagaaaacacacgagatcaagattcccgaatttgatgtcgttatccccaaagtgctcctggaccagctggtgatcgacgatattgcggggtctcctcatcggttcagacttggaaccgacacatactatcacaattcccagcaactgtttctcccgctgagcatgcagcgccagctcatggatcgggagtctgacgataaggtctacctggacatcttcaacgatgtgcttaaacaggttgactcctattttaatctgtacgatgtgaacggcttcagagctgccctgcaaaagagcaaaaaggcctttgaacagctccccattaatgacttccctaaggatgtccccgacaacaaaaagaaaaaggggaaacgctccatcctgaaggagatttttatcggccttcatgctaatgccaccctgggaaacctcaagcagatgggcatcaaaacggatttcgggaagctgcagaaaagcaacggactccggattaccgagaattgcaagatcattcaccaatctcctacaggcctgtttgaaagaatcgtgcccattaaatga

SEQ ID NO: 4264 - RNA, 4107 nt, synthetic construct
  misc_feature 1..4107: note = Cas9 variant
  source 1..4107: mol_type = other RNA
atgagcagaccctacaacatcggcctggacattgggacctcctctatcggatggagcgtggtcgatgaccagtccaagctcgtttctgtgcggggcaaatatgggtacggagtgcgcctgtatgatgagggccaaacagccgctgaaagacggagcttccgcacgaccagacggcgccttaagagacggaaatggcgcctggggctcctgagagagatttttgaaccttacatcacaccggtcgacgataccttctttcttcggcagaagcagtccaatctgtctcccaaagaccagcgcaagctctatcctcaaacaagcctgttcaacgatagaaccgaccgggccttttacgatgactatcccacaatttaccatctgcgctacaagctcatgaccgagaaaagacagttcgatatccgggaaatctatctggcgatgcaccacattgtgaagtacagaggacattttcttaatgaggctcctgtttccagcttcaaatcttccgagatcaacctggtggcccactttgaccgcctcaatacgattttcgccgatctgtttagcgaatctggcttccagcttgagaccgacaagctggctgaagtcaaagccctcctgctggacaaccagcaatccgctagcaatcggcagagacaggccctctctctgatctatacaccctccaccaacaaggcggtggagaagcagaataaagccattgctacagagcttctgaaggccatcctcggcctgaaagctaagtttaacgttcttaccgggattgaagccgaggatgtgaaagcgtggacgctgacattcaatgccgaaaacttcgacgaggaaatggtcaagctcgagagctccctggatgacaatgctcatcaaatcatcgagtctctgcaggaactctacagcggagtgctgcttgccggcattgtgcctgagaaccagtccctgagccaagctatgatcaccaaatatgatgaccaccagaagcacctcaagatgctgaaagccgtccgcgaagcccttgctccggaggatcggcagagactgaagcaggcgtacgaccaatatgttgatgggcaggaaaatacaaaagcctactctaaggaggacttttacggagatattaccaaagctctcaagaacaaccccgaccatcctatcgtgtccgagattaagaaactgatcgaactggaccagttcatgcccaagcagcgcaccaaagataatggcgccatccctcaccaactccatcagcaggagctggaccggattatcgaaaaccagcaacagtattacccctggcttgccgagctgaatccgaacagcaagagacagacagtggctaaatataagctcgatgaactggtcgcctttcgcgtgccttactatgttgggcccctgattacggcggagcagcaacggcagtctagcgacgctaagttcgcctggcttatcagaaaagccgagggacgcattaccccttggaattttgatgacaaggtggatcggcaggcttccgccaacgagttcatcaaaagaatgacaaccacagacacctacctcctggctgaggatgtcctgcccaagcaatctctcatctatcagcggtttgaagtgctgaatgagcttaacggcctgaaaattgacgatcagcccatcacgacagagctcaagcaggccattttcaccgacctgtttatgcaaaagatcagcgttaccgtgaaaaatattcaggattacctggtctccgaaaagcgctacgcgagcagacctgccatcacaggcctttctgacgagaacaaattcaattcccggctcagcacctatcacgacctgaagatgattgtgggggatgctgtcgacgatgtggacaaacaggccgatctggaaaagtgcatcgagtggtctacaatctttgaagacggaaaaatttactccgctaagctcaacgagatcgattggctgacggaccagcaaagagttcagcttgccgcgaagcgctatcggggctgggggagactgagcgccaaactcctgacccagattgtgaatgctaacggacagcgcatcatggatctgctttgggacacaaccgataatttcatgagaattgtccactccgaggactttgataagctcatcacagaagccaaccaaatgatgctggctgagaacgacgtgcaggacgttatcaatgatctgtacacctctccgcagaacaaaaaggccctccggcaaattctgcttgtggtcaatgacatccagaaagccatgaagggccaggctcccgaacgcattctgatcgagttcgcgagagaagatgaggtgaaccctcggctcagcgtgcagcgcaagagacaagttgagcaggtctatcagaatatttccaacgaactgctgaataacacggagatccggaatgaacttaaagacctctctaacagcgccctgtccaatacccgcctgttcctctactttatgcaagggggaagagatatgtatacaggcgacagcctgaacatcgatcggctttctacctacgacattgatcatatcctgccccagtccttcgtgaaggacaatagcctcgataaccgcgtgctggtctctcagaaaatgaatagatccaaggctgaccaggtgcctacagactttaccagcgttgagctgggcaaaaagatgcagcttcaatgggaacagatgctgcgggccgggctcattacgaagaaaaagtacgataacctgacactcaaccccgaccacatctctaaatatgccatgaagggattcattaatagacagctggtggagacccgccaggtcatcaaacttgctacaaacctgctcatggagcaatacggcgaagataatatcgagctgattaccgttaagagcgggctgacccatcagatgcggacagaatttgacttcccgaagaacagaaatcttaacaatcaccatcacgcctttgatgcgtatctgacggctttcgtgggactctacctgctcaaacgctatcctaagctgaaaccctactttgtgtatggcgagtaccagaaggcctcccaacaggacaaatggcggaacttcaattttcttaacgggctgaagaaagatgagctcgtcgacgaaaataccgaggccgtgatctgggataaggaaagcggcctggcttacctgaacaagatttatcagttcaaaaagatccttgttacaagagaggtgcacgaaaattctggagccctgtttaaccagaccctctacgcggctaaagacgataaggcctccggccaagggggaaaacagctgattcctgccaagcaggaccgccccacagctctctatggcgggtacagcggaaagacctccgcctatctgtgtcttgtcaaaatcaagaataaatctgagtacatttatcggatcttcggcgtgaacacgagctggtcctctgagctgaagcagatccaagatcctgctgaaagactggtgcgcctcgagaaactgcttacaccccagctgaccattaacaagaagaaaaagggggaaccggtccctgttaccaaagacttcaagatcattctcccccggatcctgattaatcagaaattttacagcagaggccaggacatctccatcgcctctgagttctacctccataacgaacaagagctggtgcttgataagagcgacattaagatcctgaatggagcgattaaagtgaacaattccaacaagcaggtcatcaatctgtttaaccacattctcgaacaggtgaatcaatatttccccgtttacgatatctataaaagccgggaagtgctgaactcttccaaggagatctttgaaaatcttacatggaacgaccagtggcgcaatagaaaactgattaacgtcggccagaagaccatcctcaatcggattctgatcgggctccatgccaacgctgcccgcattaagatcagcgagctgggattcaaaaatgattttggccttctgacacagacgtctgggattaccttcacacctgacacccaaatcatctaccagtccccgacaggactgtttgaaagacgggtggctctcagagatctgtga

SEQ ID NO: 4265 - RNA, 4107 nt, synthetic construct
  misc_feature 1..4107: note = Cas9 variant
  source 1..4107: mol_type = other RNA
atgaagagaagctacaacatcggcctggacattgggaccaattccatcggatgggccattgtggatgaccagtctaaactcatcagcgtcaagggcaaatatgggtacggagttcggctgtatgatgagggccaaacagctgccgaacgcagatccttccggacgacccgcagacggcttaagcgcagaaaatggcggctggggctcctgcgcgagatttttgaaccctacatcacacctatcgactctaccttctttcttagacagaagcagagcaacctgtccccgaaggatcagcggaaactctatccccaaacatctctgttcaatgaccgccctgatgcggacttttaccagcagtatcccaccatttaccacctgagataccagctcatgacagagaagcggcaattcgatatccgcgaaatttatctggctatgcatcacatcgtgaaatacagaggacattttcttaacgaggcccctgtggccagcttcaagtccagcgagattaatctggctgaacactttgaccagctcaacaccatcttcgccgatctgtttcgggagtctggcttccagcttgaaacggacgagctggtcgctgtgaaagccctcctgatggataatcagcaatccgcgagcaacagacagcgcaaggccctgcccaagctctataccccttctgctgacaaatccattgagaagcagcggaaagccatcgctacagaaatcctgaaggccattcttggcctgaaagcgaagtttaatgttgtgaccgggatcgaggccgaagacgtcaaggcttgggccctcacattcaacgctgagaatttcgatgaagaactggccaagctggagagctctctggacgataacggacatgaagtgattggcatcctccaagagctgtactccgggattctgctcgccggaatcgttccggaaaatcagagcctgtcccaggctatgatcaccaagtatgaggaacaccaggcgcaccttaaaatgctgaaggccgtgagagacgatctcgctacggccgaccaacagaaactgaagaaagcctacgatcagtatattgacggccaggagaacacaaaggcttactctaaggaggccttttacgatgacgtcaccaaagcgcttaaggattatagcgaacaacccctggtgtccgagatccagaaactcattgaactggaccagttcatgcctaagcagcgcacaaaagacaatggggctatcccccatcaactgcaccagcaggagctcgatcggattatcgaaaaccagcaacagtactatccttggctggccgagcttaaccccaatccgaagagacagaccgtggccaagtacaaactggacgagctcgtcgcttttcgcgttccttattacgtgggacccctgatcaccgccgaacaacagcagcagagctctaacgctaagttcgcctggatgattcggaaaacagagggcagaatcacgccttggaattttgatgacaaggtggatcgccaagcgtccgccaacgagttcattaaacggatgaccacaaccgacacatatctgcttgctgaggatgtcctccccaagcagagcctgatctaccagagatttgaggtgctgaatgaactcaacggcctgaagattgacgatcagcccatcaccaatgagcttaaacaagccattttcaacgacctgtttatgcagaagacgtctgttagcgtgaaaaatatccaggattacctcgtctccgaaaagcgctatgcttctcggcctgccatcacagggctgagcgacgagaaaaagttcaactccagactgagcacctaccatgatcttaaagtgattgttggagacgcggtggacgatgtcgacaagcaggccgatctcgaaaagtgcatcgagtggtctaccatttttgaggacggcaaaatctattccgctaagctgaatgaaattacatggctgaccgagcaacagcgggggcagctcgccacaaaacgctacagaggatggggccggctgagcgctaaacttctgacgcaaatcgtgaacgccaatgggcagagaatcatggatctcctgtgggacaccacagataacttcatgcgcattgtccactttgaagacttcgataaactgatcaccgaggccaatcagatggtgcttgctgaaaacgacgttcaggatgtgattaacgacctctatacatctccgcaaaataagaaggcgctgcggcagatcctgctcgtcgtgaacgatattcagaaagccatgaagggacaggctcccgagagaatcctgatcgagttcgcccgcggcgcccaaaaagacaagtcccttaccgttagacggaaacgcaagctggacgaaatgtacagccagatttccgatgctgtgctcgccgacgagtctgtcagacaggaacttaagagctccaatcaggatgacctggtgaaagagaaggtgtatctttactttatgcaaggcgggcgggatctctacacgggaaacgcgctgaatatcgaccgcctgtctgattatcacgttgaccatattatccctcaggcttacattaaagatgacagcctcgataacaaggccctggtctccagcagaatgaatgaaatcaaagccgaccgggtgccccttcaggtggtccagaagcaattcggcaagaacatggcttctgagtgggggtatatgcaccgcgccggactgatctccagaaagaagtacgacaatctcatgtttaaccctgagaatctgaacaaatatcagattaatcggttcatcagccgccagctggtggaaacccaacaggttattaaacttgtggcgaacctgctctctaatcagtacgagggcgataacgtcaaaatcattacagtgaagtccaaactgacccagacaatcagaagcgaatttgacttccccaagaaccgggaggttaataactatcatcacgcttttgatgcctacctcaccgccttcgtggggatgtacctgcttaagagatatccgaaactgtctagctactttacgtatggcgagtacctcaagggaaatcaacaggacaaatggtccagcttcaactttctgaatgatctgaagcgcgctaaacttgaagacaagacaaacaaggagattttctggcataaagaatctggcctggcctatctcaataagatctaccagtttaaaaagatcctggtcacccgggaggtgcacgaaaactccggggctctcttcaatcagacactgtatgccgcgaaagatgacaaggccagcggacaaggcgggaagcagcttattcctgctaaacaggccagacccaccgctctgtacggaggctactccgggaagaccgttgcctatatgtgtatcgtgcgcattaaaaacaagaaaggcgatctctacaaggtctgcggagtggagacatcttggctggcccagctgaagcaacttaaagacgaggatagccagaaggctttcctgaaacagaagatctcccctcaatttacgaaagcgaagaagcagaaaggcaccattgtgaaggtcgttgaagacttcgaggtgatcgctccccacatcctcattaatcagcggctgtttgataacgggcaggaactcacactgggatctgccacctataaacataatgagcaagaacttatcctggacaagacagccgtgaaactgctcaacggcgagctgcctcttgcccagagcgaggaactggctgagctcgtctacgacgaaattctggatcaggtgatgcactatttccccctctacgacaccaatcagtttagagccaagctgcttgcggggaaaacggctttcatgcaactgccgtggaagtccaaccctgatgacaacaagacagttcagatcacccagcccattgtgctgaaaaagatcctccagggactgcatgccgatgccggccgcgtctctcttaaagagctggggatgaccacagactttggcatgctccaaaaggctaccggaatcacattcacgcccgatacccagattatctatcagagccctacaggcctgtttgaacggagagtggccctccgcgacctgtga

SEQ ID NO: 4266 - RNA, 4107 nt, synthetic construct
  misc_feature 1..4107: note = Cas9 variant
  source 1..4107: mol_type = other RNA
atggacaagaaatacagcatcggcctggatattgggaccaactccgtgggatgggccgtcatcacagacgattataaggttccctctaaaaagttcaaagtgctgggcaatacggacagacacagcattaagaagaacctgatcggggcccttctgtttgattccggagagaccgccgaagcgacacggctcaaacgcaccgctagacggcgctacacaagacggaagaatcgcatttgctatctgcaggagatcttctctaacgaaatggccaaagtggacgatagctttttccatagacttgaggaatcctttctggtcgaggaggacaagaaacacgaacggcatcctatcttcggcaatattgtggatgaggttgcctaccacgaaaagtatccgaccatctaccatctccgcaagaaactggtggactctacagataaggctgacctgagactcatttatctggcccttgctcacatgatcaaatttcgggggcacttcctgattgagggagatctcaaccccgacaatagcgacgtcgataagctgtttatccaacttgtgcagacctacaaccagctgttcgaggaaaatcctattaacgcctccggcgttgacgcgaaagccatcctcagcgctcgcctgtctaagtccagacggctggagaatctcatcgcccagctgcccggcgaaaagaagaacgggctttttggaaatctgattgctctcagcctgggccttacgcctaacttcaagtctaattttgatctggccgaggacgcgaaactccaactgtccaaggatacctacgacgatgacctggataacctcctggcccagatcggggaccagtatgctgatcttttcctggccgctaaaaacctcagcgacgccattctgctttctgacatcctgcgcgtgaatacagaaattaccaaggctcccctctccgctagcatgatcaaaagatacgatgagcatcaccaggacctgacactgctcaaggcgctggtccggcaacagcttcctgagaagtataaagaaatcttctttgatcagtccaagaacggatacgccggctatattgacgggggagcttctcaggaggaattttacaaattcatcaagccgattctggagaaaatggatggcaccgaggaactcctggtgaagctgaatagagaggaccttctccgcaagcaacggacgttcgataacggcagcatcccccatcagattcacctgggggaactgcacgccatcctcagacgccaggaggacttttatcctttcctgaaagataatcgggaaaagatcgagaaaattcttacatttagaatcccctactacgtgggacctctggcccgcggcaactcccggttcgcttggatgaccagaaagagcgaagagacaattaccccctggaattttgaggaagtcgttgacaaaggggcctctgcgcaatccttcatcgagcgcatgaccaactttgataagaatctcccgaacgaaaaggtgctgcctaaacatagcctgctttatgagtacttcacagtgtataatgagctcacgaaggtcaaatacgtgaccgaaggaatgcggaagcccgcttttctgtctggcgagcagaaaaaggccattgttgaccttctcttcaaaacaaacagaaaggtgaccgtcaagcagctgaaagaagattatttcaagaaaatcgagtgttttgacagcgtggaaatttccggggttgaggaccgcttcaatgcctctcttggaacataccacgatctgctcaagatcatcaaagacaaggattttctggacaacgaggaaaatgaggatattctggaagacatcgtgcttaccctcacgctgttcgaggatcgggaaatgattgaggagagactgaagacatatgctcatctctttgacgataaagtcatgaagcagctgaaacggcgcagatacaccggctggggccggcttagcagaaagctgatcaacgggattcgcgacaaacaatccggaaagaccatcctcgatttccttaagagcgacggctttgccaaccggaatttcatgcagctgatccacgatgactctctgacatttaaagaagacattcagaaggctcaggtgtccgggcaaggagatagcctccatgagcacatcgccaacctggcgggctctcctgccattaaaaaggggatcctgcagaccgtcaaagtggttgacgaactcgtgaaggtcatgggcagacacaagcccgagaatattgtgatcgaaatggctcgcgagaaccagacaacgcagaaaggacaaaagaactccagagagcggatgaaacgcatcgaagagggcattaaggaactggggagccagatccttaaagagcatcccgttgagaatacccagctgcagaatgaaaagctctacctgtattacctgcaaaacggaagagatatgtatgtggaccaggagcttgatattaatcggctgtccgactacgatgtcgaccacatcgtgcctcagtctttcctcaaagatgacagcattgataacaaggtgctgacacgctccgacaagaatagaggcaaatctgacaacgttccgagcgaagaggtcgtgaagaaaatgaagaattattggcggcaactcctgaacgccaaacttatcacccagcgcaagtttgataatctgacaaaggctgaaagagggggactctccgagctggacaaagccggcttcatcaagcggcagctggtggagacccgccagattacgaaacatgtcgcgcaaatccttgatagcagaatgaacaccaagtacgacgaaaacgataaactgattcgggaggtgaaggttatcacactcaagtctaaactggtgtccgactttagaaaggatttccagttctataaagtccgcgaaattaataactaccaccacgcccatgacgcttacctcaatgccgtggttgggaccgctctgatcaagaaatatcccaagctggagagcgaatttgtgtacggcgattataaggtctacgacgtgcggaaaatgattgccaagtctgagcaggagatcggaaaagccacagctaagtatttcttttactccaacatcatgaatttctttaaaaccgaaattacgctggcgaacggcgagatcagaaagcgccctctcattgaaacaaatggggagaccggagaaatcgtttgggataagggccgggacttcgccacagtgagaaaagtcctgagcatgccccaggtgaacattgtgaagaaaaccgaggtccaaaccgggggattttctaaggagagcatcctgcctaaacgcaattccgataaacttatcgctcggaaaaaggactgggaccccaagaaatatggcgggttcgatagcccgacagttgcctactctgtgctggtggtcgccaaggtggaaaaaggcaagtccaaaaagctcaagagcgttaaagagctgctcggaattacgatcatggaaagatcctcttttgagaagaaccctattgacttcctggaggctaaaggctacaaggaagtgaaaaaggatcttatcattaagctgcccaaatatagcctgtttgagctcgaaaatgggcgcaagcggatgctggcctccgcgggagagcttcagaaaggcaacgaactggctctcccttctaagtacgtcaatttcctgtatctcgccagccactacgagaaactgaaggggtcccccgaggacaacgaacagaagcagcttttcgtggagcaacataaacactatctggatgaaatcatcgagcagatttctgaatttagcaagagagttatcctggccgacgctaatctcgataaagtgctgtccgcctacaacaagcatcgggacaaacctattcgcgagcaggcggagaacatcattcaccttttcaccctgacaaatctcggagctcccgccgcctttaagtatttcgataccacaatcgacagaaaacggtacaccagcacgaaggaagtcctggatgctacactcattcaccaatctatcaccggcctgtacgagacccgcatcgacctttcccagctcgggggcgattga

SEQ ID NO: 4267 - RNA, 4107 nt, synthetic construct
  misc_feature 1..4107: note = Cas9 variant
  source 1..4107: mol_type = other RNA
atggacaagaaatacagcatcggcctggatattgggaccaactccgtgggatgggccgtcatcacagacgattataaggttccctctaaaaagctcaaaggcctggggaatacggacagacacggaattaagaagaaccttatcggcgctctcctgttcgatagcggggagaccgccgaagcgacacggctgaaacgcaccgctagacggcgctacacaagacggaagaatcgcatttgctatcttcaggagatcttttccaacgaaatggccaaagtggacgattctttctttcatagactggaggaatccttcctcgtggaggaggacaagaaacacgaacggcatcctatctttggaaatattgtcgatgaggtggcctaccacgaaaagtatccgaccatctaccatctgcgcaagaaactggctgactccacagataaggttgacctcagactgatttatcttgccctggctcacatgatcaaattccggggccactttctcattgagggcgatctgaaccccgacaattctgacgtggataaacttttcatccaactggtccagacctacaaccagctctttgaggaaaatcctattaacgccagccgcgtggacgcgaaagccatcctgtccgctagactgagcaagtctcggcgcctcgagaatctgatcgcccagcttcccggggaaaagaagaacggactgttcggcaatctcattgctctgtcccttgggctgacgcctaactttaagagcaatttcgatctcgccgaggacgcgaaactgcaactgtctaaggatacctacgacgatgacctcgataacctgcttgcccagatcggagaccagtatgctgatctgtttctcgccgctaaaaacctgtccgacgccacacttctgagcgacattctcagagttaattctgaaatcaccaaggctcccctgtccgccagcatgattaaacggtacgatgagcatcaccaggacctgacactcctgaaggcgcttgtgagacaacagctgcctgagaagtataaagaaatcttcttcgatcagtccaagaacggctacgccgggtatatcgacggaggcgcttctcaggaggaattttacaaattcattaagccgatcctcgagaaaatggatggcaccgaggaactgctggccaaacttaatcgcgaggacctcctgcggaagcaaagaacgtttgataacgggagcattccctatcagatccatctgggagaactccacgccattctgcgccggcaggaggacttctacccttttcttaaggataatagagaaaagatcgagaaaatcctgacattccgcattccctactatgtcggccctctcgctcgggggaactccagatttgcctggatgacccgcaagagcgaagagacaatcaccccctggaatttcgaggaagtggtggacaaaggagcgtctgctcaatcctttattgagcggatgaccaacttcgataagaatctgccgaacgaaaaggtcctgcctaaacacagccttctctacgagtattttacagtttacaatgagctgacgaaggtgaaatatgtgaccgaaggcatgagaaagcccgccttcctgtctggggagcagaaaaaggccatcgtcgacctcctgtttaaaacaaaccgcaaggtgaccgttaagcagcttaaagaagattacttcaagaaaattgagtgtttcgacagcgtggaaatctccggagtcgaggaccggtttaatgcttctctgggcacatatcatgatctcctgaagattatcaaagacaaggatttcctggacaacgaggaaaatgaggatatccttgaagacattgtgctcaccctgacgctgtttgaggatagagaaatgatcgaggagcggctcaagacatacgcccacctgttcgacgataaagttatgaagcagcttaaacgcagacggtacaccggctgggggagactgagccgcaagctcattaacggaatccgggacaaacaatccggcaagaccattctggattttcttaagagcgacgggttcgctaacagaaattttatgcagctgatccatgatgactctctcacattcaaagaagacatccagaaggcccaggtgtccggacaaggcgatagcctgcacgagcatattgcgaacctggccgggtctcctgctatcaaaaagggcattctccagaccgtcaaagtggtcgacgaactggtgaaggttatgggacgccacaagcccgagaatatcgtgattgaaatggccagagagaaccagacaacgcagaaaggccaaaagaatagccgggagcgcatgaaaagaatcgaagaggggatcaaggaacttggaagcgatattctgaaagagtatcccgtcgagaacacccagctccagaatgaaaagctgtacctgtattaccttcagaacggccgggacatgtatgtggatcaagagctggacatcaatcgcctctccgattacgacgttgatcacattgtgcctcagtcttttctgaaagacgatagcatcgacaacaaggtcctcacaagatccgacaagaatcgggggaaatctgataacgtgccgagcgaagaggtggttaagaaaatgaagaattattggcgccagctgcttaacgctaaactgattacccaaagaaagttcgacaatctcacaaaggccgaacggggaggcctgtccgagctggataaagtcgggtttatcaagcgccagcttgtggagaccagacagatcacgaaacatgtggcgcagattctggacagccggatgaacaccaagtacgatgaaaacgacaaactcatcagagaggtccgcgtgattacactgaagtctaagctcgtttccgatttccggaaagactttcaattctacaaggtgagagaaatcaataactatcaccatgcccacgatgcttacctgaatgccgtcgtgggcaccgctcttattaaaaagtatcccaaactggagagcgagttcgtttacggagactataaggtgtacgatgtccgcaagatgatcgccaaatctgaacaggagattggcaaggccacagctaaatactttttctattccaacatcatgaactttttcaagaccgaaatcacgctcgcgaatggggagattcggaaaagacctctgatcgaaacaaatggagagaccggcgaaattgtgtgggacaaggggcgcgattttgccacagttcggaaggtgctgagcatgccccaggtcaacatcgtgaaaaagaccgaggtgcagaccggaggcttctctaaagagagcattcttcctaagagaaattccgacaaactgatcgctcgcaagaaagactgggatcccaagaagtacgggggctttgacagcccgacagtcgcctattctgttctcgtggtggccaaagtcgaaaagggaaaatccaagaaactcaagagcgtgaaggagctgctgggcatcacgattatggaacggtcctctttcgagaaagatcctatcgactttcttgaggctaaggggtacaaagaagttagaaaggatctgattatcaaactgcccaagtatagcctcttcgagctggaaaacggacggaagcgcatgcttgcctccgcgggcgagctgcaaaaagggaatgaactcgctctgccttctaagtacgtgaactttctctatctggccagccactacgagaaacttaagggatcccccgaggacaatgaacagaaacagctgttcgtcgagcagcataagcactatctggatgaaattatcgagcaaatctctgagttcagcaagagagtgattctcgccgacgctaacctggataaagttctttccgcctacaataagcatcgggacaaacctatccgcgaacaggcggagaacattatccacctgtttaccctcacaaacctgggcgctcccgccgccttcaagtactttgataccacaattgacagaaaacggtataccagcacgaaggaagtgctcgatgctacactgatccatcagtctattaccgggctttacgagaccagaatcgacctgtcccaactgggcggagactga

SEQ ID NO: 4268 - RNA, 4107 nt, synthetic construct
  misc_feature 1..4107: note = Cas9 variant
  source 1..4107: mol_type = other RNA
atggacaagaaatacagcatcggcctggatattgggaccaactccgtgggatgggccgtcatcacagacgattataaggttccctctaaaaagttcaaagtgctgggcaatacggacagacacagcattaagaagaacctgatcggggcccttctgtttgattccggagagaccgctgaagcgacacggctcaaacgcaccgctagacggcgctacacaagacggaagaatcgcatttgctatctgcaggagatcttctctaacgaaatggccaaagtggacgatagctttttccatagacttgaggaatcctttctggtcgaggaggacaagaaacacgaacggcatcctatcttcggcaatattgtggatgaggttgcctaccacgaaaagtatccgaccatctaccatctccgcaagaaactggctgactctacagataaggccgacctgagactcatttatctggctcttgcccacatgatcaaatttcgggggcacttcctgattgagggagatctcaaccccgacaatagcgacgtggataagctgtttatccaacttgtccagacctacaaccagctgttcgaggaaaatcctattaacgcgtcccgcgtggacgccaaagctatcctcagcgccagactgtctaagtcccggcgcctggagaatctcatcgctcagctgcccggcgaaaagagaaacggcctttttgggaatctgattgccctcagcctgggacttacgcctaacttcaagtctaattttgatctggcggaggacgccaagctccaactgtccaaagatacctacgacgatgacctggataacctcctggctcagatcggcgaccagtatgccgatcttttcctggctgccaagaacctcagcgacgccattctgctttctgacatcctgcgggttaattccgaaattacaaaagctcccctcagcgcgtccatgatcaagagatacgatgagcatcaccaggacctgaccctgctcaaagccctggtgcgccaacagcttcctgagaagtataaggaaatcttctttgatcagtctaaaaacgggtacgctggatatattgacggcggggccagccaggaggagttctacaagtttatcaaaccgattctggaaaagatggatggaacagaggaactcctggccaaactgaatcgggaggaccttctcagaaagcaacgcaccttcgataacggctccatcccccatcagattcacctgggcgaactgcacgctatcctccggagacaggaggacttttatcctttcctgaaggataatcgcgagaaaatcgaaaagattcttacgtttcggatcccctactacgtcgggcctctggccagaggaaacagccgcttcgcgtggatgacacggaaatctgaagagaccattacaccctggaattttgaggaagtggtggacaagggcgcttccgcccagagcttcatcgagagaatgaccaactttgataaaaatctcccgaacgaaaaggtcctgcctaagcattctctgctttatgagtacttcaccgtttataatgagctcacaaaagtgaagtacgtgacggaagggatgcgcaaacccgagtttctgagcggagaacaaaagaaagccattgtcgacctcctgttcaagaccaaccggaaagtgacagttaagcagctgaaggaggattatttcaaaaagatcgaatgttttgactccgtggagatttctggcgtcgaggacagattcaatgctagccttgggacctaccacgatctgctcaaaatcatcaaggacaaagattttctggacaacgaagagaatgaagatattctggaggacatcgtgcttacactcaccctgttcgaagatcgggagatgattgaggaacgcctgaagacgtatgcccatctctttgacgataaggttatgaaacagctgaagagacggagatacacaggatggggccgcctttcccggaaactgatcaacggcattagagacaagcaaagcgggaaaaccatcctcgatttcctgaagtctgacggatttgctaaccgcaatttcatgcagctgatccacgatgactcccttacctttaaggaggacattcagaaagcccaggtgagcggccaaggggattctctccatgaacacatcgcgaacctggccggatcccctgctattaagaaaggcatcctgcagacagtcaaggtggtcgacgagctcgtgaaagttatggggagacacaagcccgaaaatattgtgatcgagatggcccgggagaaccagaccacacagaagggccagaaaaatagccgcgaaagaatgaagcggatcgaggaaggaattaaagagctgggctccgatatccttaaggagtaccccgtcgaaaacacgcaactgcagaatgagaaactctatctgtactatctgcagaacgggcgcgacatgtacgtggatcaagaacttgacattaatagactgtctgattatgacgttgatcatatcgtgcctcagagcttcattaaggacgattccatcgacaacaaagtcctcacccggtctgacaagaatcgcggaaagagcgataacgtgccgtccgaggaagtggttaaaaagatgaaaaattactggaagcagctgctcaacgctaaactgatcacacaaagaaagtttgacaatcttaccaaggccgagcggggcgggctgagcgagctcgataaagcgggattcattaagcgccagctggtcgaaacaagacagatcaccaaacacgtggcccagattctggactctcggatgaacacgaagtatgatgagaacgacaaacttatcagagaagtgaaggtcattaccctgaagtccaaactcgtgagcgattttcgcaaggacttccaattctacaaagttcgggagatcaataactaccatcacgctcacgatgcctatctgaatgctgtggtcggcacagccctcattaagaaataccccaagctggaatctgagtttgtgtatggggactacaaggtttatgatgtgagaaaaatgatcgccaagtccgagcaggaaatcggcaaagctaccgcgaagtacttcttttatagcaacattatgaatttctttaaaacagagatcacccttgccaacggagaaattcgcaagcggcctctgatcgagacgaatggcgaaacaggggagattgtctgggacaagggaagagatttcgctaccgtgcgcaaagttctctctatgccccaggtgaacatcgtcaagaaaacagaggtgcagaccggcgggtttagcaaggaatccatcctgcctaaacggaatagcgacaagctgattgcccgcaaaaaggactgggatcccaagaaatacggaggcttcgactctccgaccgtggcctactccgtccttgttgtggctaaggtggagaaaggcaagagcaaaaagctgaagtccgtcaaagaactcctggggatcacaattatggagagatctagctttgagaagaaccctatcgatttcctcgaagccaaaggatataaggaggtgcggaaagacctgattatcaaacttcccaagtactccctgtttgaactggagaatggcagaaaacggatgctcgcgtctgctggggaactgcaaaagggaaacgagcttgccctgcctagcaaatatgttaatttcctctacctggcctcccattatgagaagctcaaaggctctcccgaagataacgagcagaagcagctgttcgtggaacagcacaagcattaccttgacgagatcattgaacaaatcagcgagttttccaaacgcgtcattctggctgatgccaatctggacaaggtgctcagcgcgtataacaaacacagagataagcctatccgggagcaggctgaaaacattatccatctgttcacgcttaccaattttggggcccccgccgctttcatttactttgacacaaccatcggacgcaacagatacaaatctatcaaggaggttctggatgccacactcattcaccagtccatcaccggcctgtatgaaacgcggattgacctcagccaactcgggggcgattga

SEQ ID NO: 4269 - RNA, 4107 nt, synthetic construct
  misc_feature 1..4107: note = Cas9 variant
  source 1..4107: mol_type = other RNA
atgaagtacgagagcgaagagtattacatcggcctggacatggggacctcctctgtgggatgggccgtcacagatccccactatcatctcattagaaagaagggcaaagacctgtggggagctcggcttttcgaaaaggccaacacggcgcaggagcgcagaaccaatcggatcaaccgcagacggaatcaacgcagaaaacagcggattgcttttatccgcgaagccttcagaaaggaggttgagaaggtggatgtgaactttttccggcgcctggacgaaagccagctctacctggaggataaatccattaaggaaccttatcttctgtttaatgacctcaactacacagataaagacttctatcaccagtacccgaccgtctttcatctgatcacagatctgctcacctctgacagaaagttcgatatccgggagatttacatcgccgtgagctccctgtataatcaccgcgggaactttcttaataaatctctgggcaacgagacacaagacgaagatctcgttttcaagaatctggacgaggcttttagcgcctgcgggatgaactggaataccaaggctgaaaacattgaggtggtcaaacagatcctttgtgacagatccctgaataagaaagaaaagcaggatcagctcgcccattgcctggagattaacaaaaagacggagaaagaaaagatcgagttcctgaagctcctgaccggaggcaaagcggacagcaagaaaatgtttccccaataccactatgaacgggatgagaaactttctttcgccttcgctgacgaaaacggcgatgagaattgggaggaaacactgaacgccattgaggaaagactcacctccgacgagtacgggctgatccttgctctgaaaagcgtgtatgattggtctatcctcgccgacctgatgaagaatgaaaagacaggagagacctacccttatctgtccatggcgcgcaaagatagctacgagaagcacaaagccgacctccggctgcttaagtctgttattaaaagactgatccccaacgaatacaatcatttcttccgccagtatgatggcaaggggaagacgtacacaaactatattggatccgtgcagtaccacgagaaacggcatagatttaagcacatcaccacaaaagaattttatgacggcctcaagaaactgcttaagccttacagcgaggacgaggaaattaagcagatcctgcaagatatcgagtccgaaacctttctccccaaacagattaccaatatgaacggggtcatccctaatcaggtgcacgctaaggagctgaaagtgattctggaaaaggcctctcaacattatgacttcctcaacgagacaaatgagagcggactgacggtcaaagaacagatcatgcagatgtttaccttccagattccgtactacgttggcccccttgctaacctgaatggcaaggggaacggatgggccgtgcgctatgtgggcaaagagcggacaaaggtctacccttggaatatggatgaagtgatcgacgagaaggaaaccgccgatcaatttatcaaaagaatgatttccacatgtacctatctcggggacgagtacgttctgcccaagagctctatcctgtatgagaaattcgctgtgcttaacgaactcaactccctgaagattaatggacagcctgtcagcgtggatctgaaacagaagatctaccgcgacctctttacgaagggcaaacgggttacacagaaggggctgcttctgtatctcaaaagagagggagtgatttctaagagcgaagagaccatcctgtccggcttcgatattgactttaaaaacaccctgtctagctaccgcaagttctgcgaagtcttcgcgacaaatgagcttaacgatgagcaaatccggatggccgaagacatcattgagtggctcaccgtgtttggcgattccaagaaattcgtcagagaaaagatccacgggaattacccccagattacagctaaccagctgaaacggatcctgagctttaatttcaaggactggggaaaactctctaagcagtttctggagcttgagggcgaagaccgcgagacggggaagtcctgtagcctgattcaagccctctgggataccaacaataacctgaatcagctgctttcttccagattcacatataaagaaaacctcgagaagaaacggaagaaaatcgaaatggacctgtttgagttcacccatgaggatctggacgatctctacatcagcgccccggtgaagagaatgatttggcaggctctgaaaatcatgaaggacattgttatcgtgatgaaggaatcccctacaaaactttttattgagatgacccgcaataacgaaaatgagaagacgcggaccgtctctagaaagaacaagctggtggatctctataaaaagatcaagggagaaagccgcgactggatcaaagagctggagagatacgaagagaaggatttccggtccaaaaagctgtatctttactatacacagatgggcaaatctgcctacagcggggaacccattgacatggataagctctttgacaagaacgtttacgatatcgaccacatttatcctaaatccaaggtgaaagacgatagcctgctgaataactgcgtcctcgtgaagcgcaaagagaatatggacaagggcaacaatttccccatcgatcccgacattcaaaccaagcaggaacatctgtggaaattttggcttgagaagggactgatcacacaggagaaattcaacagactcacccggaagaaacctttcacgaatgatgaactggcggactttgtgaaccgccaactggttgagacaggccaggctaccaagacaatcgccgatcttttcaagatgacctttcccaattctgacattgtctacgtgaaagccgggaacgtgaccgatttcagacagtatatcgaagtctacaagtgtcgggaggtgaataacctgcaccacgcttatgacgcctacctcaatgttgtggtcggaaacgtgtatgatacaaaatttacgaagaatcccatgaactacattaaagagcagcgcaaggaaaactccaatgagagataccatatggacaaaatcttcgaatttcctgttattcggaacggcaaggaggcttggatcaccaagaaagacgaaagcattaatatcgtgcgcaagacactggccagaaaaaccccgctcgtcacaaagcggaacttcgaggcgaatgggaccatcgccaaagctacgatttatcctaagggaaacgtgaaggatcaaggctacctgcccagaaaaacatctatcccggcccttcgcgacatgaagaaatatgggggcgttacctccattcagatcgcttactttttcctggtggagcacgaagtcaagaaaaagcggattagaaccatcgagtgcgtgcctatctatcgcaaggaggaactcaaaacaaaggaacagctggagcggtactgtagagaggaactgaaacttattaatcccagcatccgcctggagaagattaaaccttattctctcctgaagatgaacggaaactttttctacatcaccggcaagacaaatgatcggttcagcctcgccaatgcgatggaactgtacgtggacaaagtctccgagaaccatattagagatcttgttaagtataaaaattgcgggtactttaacgtggacgataaggaagcccgcaaacggaatgagagactgtatacgatcctcaccaagaaacacctgacagtgttcaagggaagccccaagcctatgggcgagaaactgcagcaataccagcagctttttctggaactcgaggtctctaaacaggtgtatgttctgctccaaatcctgcagcttaccgctacaaacgtgaaaaccaaggccgacctgacggctattgggggaaaagccaatgaaggcaccatggatatctccaagaacctggagaacgtcattaagaatcagatcaaaaaggggctcgtgcccgagctgatgcttattaaccaaagcccgacaggcctgttcgaatccgagatcgacctcctgaccatttga

SEQ ID NO: 4270 - RNA, 4107 nt, synthetic construct
  misc_feature 1..4107: note = Cas9 variant
  source 1..4107: mol_type = other RNA
atgagcagaccctacaacatcggcctggacattgggacctcctctatcggatggagcgtggtcgatgaccagtccaagctcgtttctgtgcggggcaaatatgggtacggagtgcgcctgtatgatgagggccaaacagccgctgaaagacggagcttccgcacgaccagacggcgccttaagagacggaaatggcgcctggggctcctgagagagatttttgaaccttacatcacaccggtcgacgataccttctttcttcggaagaaacagtccaatctgtctcccaaggaccagcgcaagctctatcctcagacaagcctgttcaacgatagaaccgaccgggccttttacgatgactatcccacaatttaccatctgcgctacaaactcatgaccgagaagagacaattcgatatccgggaaatctatctggcgatgcaccacattgtgaaatacagaggacattttcttaatgaggctcctgtttccagcttcaagtcttccgagatcaacctggtggcccactttgaccgcctcaatacgattttcgccgatctgtttagcgaatctggcttccagcttgagaccgacaaactggctgaagtcaaggccctcctgctggacaaccatcagtccgctagcaatcggcagagacaagccctcctgcttatctatacaccctctaccaacaaggcggtggagaaacagaataaggccattgctacagagctgctcaaagccatcctgggccttaaggctaaatttaacgttctgaccgggattgaagccgaggatgtgaagacgtggacactcaccttcaatgcggaaaacttcgacgaggaaatggtcaaactggagtccagcctggatgacaatgcccaccagatcatcgagtccctccaggaactgtactctggagtgcttctggctggcattgtgcctgagaaccaaagcctctcccaggccatgatcacaaagtatgatgaccaccagaagcatctgaaaatgcttaaggctgtccgcgaagccctggccccggaggatcggcaaagactcaaacaggcttacgaccagtatgttgatgggcaggaaaataccaaggcgtacagcaaagaggacttttacggagatattaccaaggccctgaagaacaaccccgaccaccctatcgtgtctgagattaaaaagctgatcgaactcgaccaattcatgcccaaacagcgcacaaaggataatggcgctatccctcatcagctgcaccagcaagagcttgaccggattatcgaaaaccagcagcagtattacccctggctggccgagctcaatccgaactccaaaagacaaacggtggccaagtataagctggatgaactggtcgcttttcgcgtgccttactatgttgggccccttattaccgccgagcagcagcagcaaagctctgacgcgaaattcgcttggatgatccggaaggccgagggacagattacaccttggaattttgatgacaaagtggatagacaggccagcgctaacgagttcatcaagcgcatgaccacaaccgacacgtacctcctggccgaagatgtcctgcccaaacaatccctcatctatcagcggtttgaagtgctgaatgagcttaacggcctgaagattgacgatcagcccatcacaaccgagctcaagcaggctattttcaccgacctgtttatgcagaaaacatctgttaccgtgaagaatatccaggattacctggtcagcgaaaagagatacgcctcccggcctgcgattacaggccttagcgacgagaacaagttcaattctcgcctctccacgtatcacgacctgaaaaccatcgtgggggatgccgtcgacgatgtggacaagcaggctgatctggaaaaatgcattgagtggagcacaatctttgaagacggaaagatctactctgccaagctcaacgagattgattggctgaccgaccagcaaagagttcagcttgctgccaaacggtatagaggctgggggcgcctgtccgcgaagctcctgacacagatcgtgaatgccaacggacagcggattatggatctgctttgggacaccacggataatttcatgagaatcgtccatagcgaggactttgataaactcattaccgaagctaaccaaatgatgctggccgagaacgacgtgcaggacgttatcaatgatctgtacacatccccgcagaacaagaaagctctccgccaaatcctgcttgtggtcaatgacattcagaaggccatgaagggccaggcccccgaaagaatcctgattgagttcgctcgggaagatgaggtgaaccctcgcctctctgtgcagagaaaacggcaagttgagcaggtctatcagaatatcagcaacgaactgctgaataacaccgagattcgcaatgaacttaaggacctctccaactctgcgctgagcaatacaagactgttcctctactttatgcaagggggacgggatatgtataccggcgactccctgaacatcgatcgccttagcacgtacgacatcgatcacattctgccccaatctttcatcaaagacaattccctcgataacagagtgctggtgagccagcggatgaatcgctctaaggccgaccaggtccctacagactttacctccgtggagctgggccagaaaatgcaaattcagtgggaacagatgcttagagctgggctgatcacaaagaagaaatacgataacctcaccctgaaccccgaccatattagcaagtatgccatgaaaggattcatcaatcggcagctcgttgagaccagacaagtgatcaagctggccacaaaccttctgatggagcagtacggcgaagataatattgagctcatcacggtcaaatctgggctgacccaccagatgcgcacagaatttgacttcccgaagaaccggaatctgaacaatcatcaccacgcttttgatgcctatcttaccgcgttcgtgggactgtacctcctgaagagatatcctaaactcaagccctactttgtttatggcgagtaccaaaaagctagccagcaggacaagtggcgcaacttcaattttctgaacgggcttaaaaaggatgagctggtggacgaaaatacagaggccgtcatttggaacaaagaatccggcctcgcctacctgaataagatctatcagttcaagaaaattctggtgacccgggaggttcatgaaaacagcggagctctttttaatcaaacgctgtacgccgcgaaggatgacaaagcctctggccaagggggaaagcagctcatccctgccaaacaggatagacccacagccctgtatggcgggtactccggaaagaccgtggcttatatgtgtattgtccgcatcaagaacaaaaagggcgacctctacaaagtgtgcggggtggagaccagctggctggcccagcttaagcagctgacagatgaggactccaaaaaggctttcctgaagcagaaaatctctcctcagttcaccaaggtcaaaaagcaaaaaggcacaattgttaaggtggtggaagactttgaggtcatcgctccccacattctcatcaaccagcggttctttgataatggacaggaactgacgcttggcagcgcgacctataagcataacgagcaagaactgattctcgacaaaacagccgtgaagctgctcaatggggctctgccgcttacccagtccgaggagctggccgaacaggtttacgatgagatcctggaccaggtgatgcactacttccctctctatgatacaaaccaatttagagctaaactgtctgccggaaaggccgctttcatgaaacttccctggaaaagccagtgggacggcaataagatggtccaggtggggcagcaagttatcctggatcgcgtgctcattggactgcacgcgaacgccgctgtctccgacctcggcgtgctgaaaatctctacgccccttgggaagatgcagcagcctagcggcatttccctgagcccggatacccagatcatttaccaatctcccaccggactgtttgaacggagagttgccctccgggacctgtga

SEQ ID NO: 4271 - RNA, 4107 nt, synthetic construct
  misc_feature 1..4107: note = Cas9 variant
  source 1..4107: mol_type = other RNA
atgagcagaccctacaacatcggcctggacattgggacctcctctatcggatggagcgtggtcgatgaccagtccaagctcgtttctgtgcggggcaaatatgggtacggagtgcgcctgtatgatgagggccaaacagccgctgaaagacggagcttccgcacgaccagacggcgccttaagagacggaaatggcgcctggggctcctgagagagatttttgaaccttacatcacaccggtcgacgataccttctttcttcggcagaagcagtccaatctgtctcccaaagaccagcgcaagctctatcctcaaacaagcctgttcaacgatagaaccgaccgggccttttacgatgactatcccacaatttaccaccttcgctacaagctcatgaccgagaaaagacagttcgatatccgggaaatctatctggcgatgcatcacattgtgaagtacagaggacattttcttaatgaggctcctgtttccagcttcaaatcttccgagatcaacctggtggcccactttgaccgcctcaatacgattttcgccgatctgtttagcgaatctggcttccagcttgagaccgacaagctggctgaagtcaaagccctcctgctggacaaccagcaatccgctagcaatcggcagagacaggccctctctctgatctatacaccctccaccaacaaggcggtggagaagcagaataaagccattgctacagagcttctgaaggccatcctcggcctgaaagctaagtttaacgttcttacccgcattgaagccgaggatgtgaaagcgtggacgctgacattcaatgccgaaaacttcgacgaggaaatggtcaagctcgagagctccctggatgacaatgctcatcaaatcatcgagtctctgcaggaactctacagcgggattctgcttgccggaatcgtgcctgagaaccagtccctgagccaagctatgattatgaaatatgatgaccaccagaagcacctcaagatgctgaaagccgtgcgggaagcccttgctccggaggatagacagcgcctgaagcaggcgtacgaccaatatgtcgatggccaggaaaataccaaagcctactctaaggaggacttttacggggatatcacaaaagctctcaagaacaaccccgaccatcctattgtttccgagatcaagaaactgatcgaactggaccagttcatgcccaagcagcggaccaaagataatggagccattcctcaccaactccatcagcaggagctggacagaatcattgaaaaccagcaacagtattacccctggcttgccgagctgaatccgaacagcaagcgccagaccgtggctaaatataagctcgatgaactggtggcctttcgggtcccttactatgtgggccccctgatcacagcggagcagcaaagacagtctagcgacgctaagttcgcctggcttattcgcaaagccgaggggcggatcacgccttggaattttgatgacaaggttgatagacaggcttccgccaacgagttcatcaaacggatgaccacaaccgacacatacctcctggctgaggatgtgctgcccaagcaatctctcatttatcagcgctttgaagtcctgaatgagcttaacggactgaaaatcgacgatcagcccattaccacggagctcaagcaggccatcttcacagacctgtttatgcaaaagaccagcgtgtccgttaaaaatattcaggattacctggtgagcgaaaagagatacgcgtctcggcctgccatcaccggcctttccgacgagaacaaattcaatagcagactctctacatatcacgacctgaaggctattgtcggcgatgccgtggaagacgtcgataaacaggtggacctggagaagtgcgttgaatggtccaccatctttgaggatgggaaaatctacagcgctaagctcaacgagattgactggctgacagatcagcaacgcgtgcagcttgccgcgaagcggtatagaggatggggccgcctgtccgccaaactcctgacgcagatcgtcaatgctaacgggcagagaattatggacctgctttgggataccacagacaatttcatgcggatcgtgcactctgaagattttgacaagctcattaccgaggccaaccaaatgatgctggctgaaaacgatgttcaggacgtgatcaatgacctgtacacaagcccgcagaacaaaaaggccctccgccaaatcctgcttgtcgtgaatgatattcagaaagccatgaagggacaggctcccgagagaatcctgattgagttcgcgcgggaagacgaggtgaaccctcgcctctccgttcagagaaagcggcaagtcgaacaggtgtatcagaatatctctaacgagctgctgaataacaccgaaattcgcaatgagcttaaagatctcagcaactccgccctgagcaatacgagactgttcctctactttatgcagggcgggcgggacatgtataccggagattctctgaacatcgaccgcctttccacatacgatatcgaccatattctgccccaatctttcatcaaggataatagcctcgacaacagagtgctggtctcccagaaaatgaatcggagcaaggctgatcaggtgcctaccgactttacatctgttgaactgggcaaaaagatgcagcttcaatgggagcagatgctgagagccggcctcattaccaagaaaaagtacgacaacctgacgctcaaccccgatcacatcagcaaatatgccatgaaggggttcattaatcgccagctggtggagacacggcaggtcatcaaacttgctaccaacctgctcatggaacaatacggagaggacaatatcgaactgattacagtgaagtccggcctgacccatcagatgagaaccgagtttgatttcccgaagaaccgcaatcttaacaatcaccatcacgcctttgacgcgtatctgacagctttcgttgggctctacctgctcaaacggtatcctaagctgaaaccctactttgtgtatggagagtaccagaaggccagccaacaggataaatggagaaacttcaattttcttaacggcctgaagaaagacgaactcgtcgatgagaatacggaagccgtgatctgggacaaggagtctgggctggcttacctgaacaagatttatcagttcaaaaagatccttgttacccgcgaagtgcacgaaaattccggcgccctgtttaaccagacactctacgcggctaaagatgacaaggccagcggacaaggcgggaaacagctgattcctgccaagcaggatcggcccaccgctctctatggaggctactccgggaagacagtcgcctatatgtgtatcgtgagaattaaaaataagaaaggagacctgtacaaggtgtgcggcgtcgagacctcttggcttgctcagctgaaacaactgacggatgaagacagccagaaggccttcctcaagcagaaaatctcccctcagttcacaaaggttaaaaagcaaaaagggaccatcgtgaaggtggtcgaggactttaaggtgattgcgccccatatcctgattaaccagcgcttctttgataacggccaggaacttaccctgggatctgccacatataaacacaatgagcaagaactcatcctggacaagaccgctgttaaactcctgaacggcgcccttccgctgacacagagcgaggagctggctgaacaggtgtacgatgagattctcgaccaggtcatgcattacttccctctgtatgatacgaatcaatttcgggccaagctgtccgccgggaaagctgcgttcatgaagctgccctggaagtctatctgggacggaaacaaaatgacccagatcggccagcagattatcctcgatcggattctgatcgggctccacgccaatgctgccgtgagcgacctgggagttcttaagatttccacacccctgggcaaaatgcaacagcctagcgggatctctctgtccccggatacccagatcatttaccagagccccacaggcctctttgaaagacgcgtggccctgagagacctttga

SEQ ID NO: 4272 - RNA, 4107 nt, synthetic construct
  misc_feature 1..4107: note = Cas9 variant
  source 1..4107: mol_type = other RNA
atggtggagaagaaaagctactccatcggcctggacattgggaccaactctgtcggatgggccgttatcacagatgactataaggtgcccgctaaaaagatgaaagtgctcggcaatacgagcagacagtccattaagaagaacatgatcggggccctgcttttcgatgaaggaggccctgcggcttctacccgggtcaaacgcacaaccagacggcgctacacaagacggaagaatcgcctgtgctatctcagagacatttttgagagcgaaatgcacaccatcgataaacatttctttctgcggcttgaggactccttcctgcacaagtctgataaacgctacgaagcccatccgatctttgggacactccaagaggagaaggcctatcacgacaactaccccaccatttatcatctgagaaaggctctggccgataatacggaaaaagctgacctccggctgatctaccttgccctggcgcacattatcaagttccgcggacactttctcattgagggcgccctgagcgctaacaataccgatgtgcagcagcttgttcatgccctggtggacgcttacaacatcatgttcgaagaggatcagctcgacattgaggccatcgacgtcaaagcgatcctgacagaaaagatttccaaaaccagacggctggagaatctcatcagcaacattcctggccaaaagaaaaatgggctgtttggaaaccttatcgccctgtctctcggcctgacacccaatttcaagtcccactttaaccttcctgaagatgctaagctgcagctcgccaaagacacctatgatgaggaactgaataacctgctcacgcagattggggacgagtacgctgatctgttccttagcgccaagaacctgtctgacgccatcctcctgtccgatatccttacagtgaatggagacggcacccaggctcccctgagcgcgtctctcattaaacgctatgaggaacatagacaagatctggccctgctcaagcagatgtttaaagagcagctgcctgacctttaccgggatgttttcacagacgaaaacaaggacgggtatgctggatacatctccggcaagaccagccaggaggccttctataaatacattaagccgatcctggaaaccctcgatggcgccgaggactttctgacaaaaattaatagagaggatttcctgcgcaagcaacggacgtttgacaacgggtccatcccccaccagatccaccttggagaactccaggctattctggagagacaacaggcctactatcctttcctgaaagataatcaggaaaagatcgagaagattctcacctttcgcatcccctactatattggccctctggcgcgggggaactctagattcgcttggcttacacgcaccagcgaccagaaaatcacaccctggaattttgatgaaatggtggaccaagaggcctccgcccaggctttcattgagcggatgaccaactttgatgaatacctgccgcaggagaaggtcctccctaaacatagcctgacgtatgaatacttcacagtgtataatgagctgaccaaggtgaaatacgtcaccgagggaatgacaaagcccgaatttctttctgccggccagaaggagcaaatcgttgaactcctgttcaaaaagtacagaaaagtgaccgtgaagcagctgaaagaggactttttctccaagatcgaatgtttcgatacagtcgacattagcggggtggaggataaatttaacgcttctctcggaacgtatcacgacctgcttaagatcattaaggacaaagccttcctggataatagcgagaacgaaaatatcattgaggacatcatcctcaccctgacactgtttgaagataaggagatgattgcgaaccgccttgccgtttacgaagacctcttcgatcagaatgtgctgaaacagctgaagcggagacattataccggctggggccgcctctccaaacaactgatcaacgggatgcgggacaagcacacaggaaagaccattcttgattttctgaaagctgacggcttcatcaacagaaattttatgcagctcattaacgatgacaatctgtctttcaaggaggagatcaaaaaggcccaggaagggggactgaaagatagcatcaacgaccagattcgggatcttgctggctcccctgccatcaagaaggggattctccaaacgatcaatattgtcgacgagatcgtgaaaatcatgggcaaggcgccccagcatattgttgtggaaatggcccgcgacgtccagaaaaccgatatcggagtgaagcaaagcagagagcggatgaaaagagtccaggaagtgctgaagaagctgggctctcagctcctgaaagagcaccccgttgagaactttcagcttcaaaatgaacgcctgtacctctattacctgcagaacgggaaggacatgtatacaggagaggaactgtccattagcaatctttctcactacgatatcgaccatattatccctcggtccttcattaaagatgacagcatcgataacaaggtgctgaccagatccgagcacaatcgcggcaaaacagacaacgtcccgtctatcgaggtggttaagagaatgaaaccctactggcagaagctcctggataccaaggtgattagccagcggaaatttgacaatctcacgaaggctgaacgcgggggactgcaagagtccgataaagccaacttcatccagagacagcttgtcgaaacacggcagattaccaagcatgtggctcaaatcctggactctcgctttaatacagagagagacgaaaaagatcggcctattcgcagagtgaaggttatcaccctcaagagcaaattcgtctccgacttccggcaggattttggcttctataagctgcgcgagatcaacgactaccaccacgcccatgatgcctatctgaacgctgtggtggggaccgcgcttctgaaaatgtaccccaagctcgccagcgagtttgtctatggcgactaccagaaatatgatctgaagagaatggtgggaaagtctggcaaagcctccgggcacgccacagccaagtacttcttttacagcaatctcatgaacttctttaaatctgaagttaagctggctaatggaaacattatcaaacggtcccctattgaggtgaatgaagagacgggcgaaatcgtctgggacaagaccaaggatttcgggacagtgagaaaagttcttagcgctccccaagtgaacattgtcaagaaaaccgagatccagacaggaggcttttctaatgagaccatcctgagcaaggggaaatccagcaagctcattccgcgcaagaacaaatggcgggacacgacaaagtatggcggattcaatacccctaccgtggcgtactctgttctggtggtcgctaaagtggaaaagggcaaagccaagaaactgaagcccgtgaaggagcttgtcgggatcacaattatggaaagaaccaaatttgaggccaaccctatcgctttcctggaatccaagggatatcatgatattcaggagcacctcatgatcacactgcccaaatacagcctcttcgagctggaaaatggccgccggagacttctggcctccgcgacggagctgcagaaggggaacgaaatggttctccctcaacatctggtgacctttctttatcgcgtgtctaaacgggacaagggaacacagagcgagaatatggagtacatttccaaccacaaggaaaaattcatcgagatctttcactatattatcagatacgctgaaaagaatgtcattaaacccaaggtgatcgagcgcctgaacgataccttcaaccagaaatttaatgactctgacctcacagaactgagcatttccttcctcaacctgtttaagttcacctcttttggcgccccggagaagttcacgtttcttaatagcgagatcaaacaggatgacgttcggtacagatccaccaaggaatgcctgaacagcacactgatccatcaatctgtgaccgggctctatgagacacggattgatctgtcccagttcggcggagactga

SEQ ID NO: 4273 - RNA, 4107 nt, synthetic construct
  misc_feature 1..4107: note = Cas9 variant
  source 1..4107: mol_type = other RNA
atggacaagaaatacagcatcggcctggatattgggaccaactccgtgggatgggccgtcatcacagacgattataaggttccctctaaaaagttcaaagtgctgggcaatacggacagacacagcattaagaagaacctgatcggggcgcttctgtttgattccggagagaccgccgaagcgacacggctcaaacgcaccgctagacggcgctacacaagacggaagaatcgcatttgctatctgcaggagatcttctctaacgaaatcgccaaagtggacgatagctttttccatagacttgaggaatcctttctggtcgaggaggacaagaaacacgaacggcatcctattttcggcaatatcgtggatgaggttgcctaccacgaaaagtatccgaccatttaccatctccgcaagaaactggctgactctacagataaggccgacctgagactcatctatctggctcttgcccacatgattaaatttcgggggcacttcctgatcgagggagatctcaaccccgacaatagcgacgtggataagctgtttattcaacttgtccagacctacaaccagctgttcgaggaaaatcctatcaacgcgtcccgcgtggacgccaaagctatcctcagcgccagactgtctaagtcccggcgcctggagaatctcattgctcagctgcccggcgagaaaagaaacggcctttttgggaatctgatcgccctcagcctgggacttacgcctaacttcaagtctaattttgatctggcggaagacgccaagctccaactgtccaaagatacctacgacgatgacctggataacctcctggctcagattggcgaccagtatgccgatcttttcctggctgccaagaacctcagcgacgccatcctgctttctgacattctgcgggttaatacagaaatcaccaaagctcccctctccgcgagcatgatcaagagatacgatgagcatcaccaggacctgacactgctcaaagccctggtgcgccaacagcttcctgagaagtataaggaaattttctttgatcagtccaaaaacgggtacgctggatatatcgacggcggggcctctcaggaggagttctacaagtttattaaaccgatcctggaaaagatggatggaaccgaggaactcctggccaaactgaatcgggaggaccttctcagaaagcaacgcacgttcgataacggcagcattccccatcagatccacctgggcgaactgcacgctatcctccggagacaggaggacttttatcctttcctgaaggataatcgcgagaaaattgaaaagatccttacatttcggattccctactacgtcgggcctctggccagaggaaactcccgcttcgcgtggatgacccggaaaagcgaagagacaatcaccccctggaattttgaggaagtggtggacaagggcgcttctgcccaatccttcattgagagaatgaccaactttgataaaaatctcccgaacgaaaaggtcctgcctaagcatagcctgctttatgagtacttcacagtttataatgagctcacgaaagtgaagtacgtgaccgaagggatgcgcaaacccgcctttctgtctggagagcagaagaaagctatcgtcgacctgctgttcaagacaaaccggaaagtgaccgttaagcagctgaaggaagattatttcaaaaagattgagtgttttgacagcgtggaaatctccggcgtcgaggacagattcaatgcctctcttgggacataccacgatctgctcaaaatcattaaggacaaagattttctggacaacgaggaaaatgaggatatcctggaagacattgtgcttaccctcacgctgttcgaggatcgggaaatgatcgaggagcgcctgaagacatatgctcatctctttgacgataaggttatgaaacagctgaagagacggagatacaccggatggggccgccttagccggaaactgattaacggcatcagagacaagcaatccgggaaaaccatcctcgatttcctcaagagcgacggatttgccaaccgcaatttcatgcagctgattcacgatgactctcttacatttaaggaagacctccagaaagctcaggtgtccggccaaggggatagcctgcatgagcacatcgccaacctggctggatctcctgccattaagaaaggcatcctccagaccgtcaaggtggtcgacgaactggtgaaagttatggggagacacaagcccgagaatattgtgatcgaaatggctcgggagaaccagacaacgcagaagggccagaaaaattcccgcgagagaatgaagcggatcgaagagggaattaaagaacttggcagcgatatcctgaaggagtaccccgtcgagaccacacaactccagaacgaaaaactgtatctgtactatcttcagaatgggcgcgacatgtacgtggatcaagagctggacattaacagactctccgattatgacgttgatcatatcgtgcctcagtctttcctgaaggacgatagcattgacaataaagtcctcacccggtccgacaagaaccgcggaaagtctgataatgtgccgagcgaagaggtggttaaaaagatgaaaaactactggaagcagctgcttaatgccaaactgatcacacaaagaaagtttgacaacctcaccaaggcggaacggggcgggctgtccgagctggataaagccggattcatcaagcgccagcttgtcgagacgagacagattaccaaacacgtggctcagatcctggacagccggatgaatacaaagtatgatgaaaacgacaaactcattagagaggtgcgcgtcatcaccctgaagtctaagctcgtgtccgattttcggaaagacttccaattctacaaggttagagaaattaacaattaccatcacgcccacgatgcttatctgaacgccgtggtcggcacagcccttatcaaaaagtaccccaaactggagagcgaatttgtgtatggggactacaaggtttatgatattcgcaagatgatcgctaaatctgagcaggagatcggcaaggcgaccgccaaatacttcttttattccaatattatgaacttctttaagacggaaatcacactcgctaatggagagattcggaaaagacctctgatcgaaaccaacggcgagacaggggaaattgtgtgggacaagggacgcgatttcgccaccgtccggaaggtgctgagcatgccccaggttaatatcgtgaaaaagaccgaggtccagacaggcgggttttctaaagagagcatccttcctaagagaaactccgacaaactgattgcccgcaagaaagactgggatcccaagaagtacggaggcttcgacagcccgacggtggcttactctgtgctcgtcgttgccaaagtggaaaaggggaaatccaagaaactcaagagcgtgaaggagctggtcggcatcaccattatggaacggtcctcttttgagaaagatcctgtggacttcctggaggcgaagggatataaagaagttagaaaggatcttatcattaaactgcccaagtacagcctgtttgagctcgaaaatggccggaagcgcatgctggcttccgccggggagcttcaaaaaggaaacgaactggccctcccttctaagtatgtgaatttcctgtacctcgctagccattatgagaaactgaagggctcccccgaggacaacgaacagaaacagcttttcgtcgagcagcacaagcattacctggatgaaatcatcgagcaaatttctgaatttagcaagagagtgatcctggccgacgcgaatctcgataaagttctgtccgcttataacaagcaccgggacaaacctattcgcgagcaggccgagaatatcattcatcttttcacactgaccaacctcggggcccccgctgcctttaagtgcttcgatacaaccatcggaagaaaccggtacaaaagcattaaggaagtgctggacgctacgctcatccaccagtctatcacaggcctgtacgagaccagaattgatctttcccaactcgggggcgactga

SEQ ID NO: 4274 - RNA, 4107 nt, synthetic construct
  misc_feature 1..4107: note = Cas9 variant
  source 1..4107: mol_type = other RNA
atggacaagaaatacagcatcggcctggatattgggacctcctctatcggattcgtgggcgtcgacgagaacgggtggcccctcaatattaagggaaaaagagccatcggcgctcacctgtttcgggaaggggaggccgcggctgaaacacgcggattcagaacgacccggcgcagatataaccggcgcaagtggagacttcggctgctccgcgagatttttgatgaacctatcagcagagttgacccgacattctttgcccggatgaaagagtcctctgtgagccccaaggatcctaattacgacggcctggccaaggagatccttattccccgcgataaagacggcaagatcctgtatcctaccatttaccatctcagacacgctctgatgtatgaagatcatcagttcgacatccgggagatttacctggccatccaccatattgtgaaatatcgcgggcactttctcctggatggagctgccaagaacttcgaatcctctaatcttgacctgaaaagcgatatccacgagatcaacgcgattctcgtcggcatctttgggaatgagcaagtgcagttcaacgaccagtacgttgaaaagctgaaggaggtgcttctggactccacacagagcagatctgatcggcaaaaagccgctgccaagctcctgctgcccaccaatgacctcgataaagacacaaccaagattctgaaaacggtctccaccgaaatcacaaaggctattaccggacttaaagccaagtttttcgtgatcacaggcaacgatatcgcgaaggaccagcagaaagattggacctttagcattgacacgctggatgagaagatgtctgttatcgaaccttccttcagcgagaaaaatttctctctcattacaatcctgcagaaactttactccagcgtgaccctggccgggattgtcccgaacggactctccctgtctgaggctatgatccaaaaatatgacagacatgccagcgatctggtgctcctgaagaagtactgggacacaaaacccaaggtgcttaaacaccagctgcagaatacctatgctgaatacatcgagattcatcaggtcgttgacgaattttattccgatctcagcaagctgatcaaaaacgacgatgacacccttgcccaagagattaagtctaagatcacaattggcaatttcctgcctaaacagcgcacgaccgaaaacggcgtgatcccctaccagctccaacagcgggagctggatacaattatcaagaaccagcaggagtattacccttggctggccgaagagaatcccgtggctgaccaccaaatcgcgtttccgtacaaactcgatgaactggtcgggttccgcattccttattacgtgggacccatgatcgccaaggaggacacctccaacagcaaaaattctaagtttgcttggatgattagaaagcagagcggcgaagttacaccttggaacttcgatgagaaaatcgaccggaccgcctccgccacggcttttattgatagaatgacaaccaccgacacatatcttatcggggaggatgtgctgcccaagcagtctctcatctaccagcgcttcgaagtcctgaatgagctgaacaaaattagcatcgacggacaacccattacccggaagcagaaacagtccgtgtatacacacgtttttgaaaagaaaaagacggtgcaggtcaaggacgtgcaaaaattccttgtcagctctggcgaggtgatgtccctccctaagatcgggggactggccaatgagaaacagtttaacagctctctgtccaccctctacgattataataagattatcccggacgcgctggaagatagaaacaaagttgacgatatcgagaagattatcctttggagcacaattttcgaagacaattccatctttgtggagaagctggattctattgactggctcaccagctcccagcgcaaacggctggctcagaagagataccgcggctggggccggctgtctcttagactcctgacaaccttcaaaaacaaggatgggtacagcatcctggacgaactctggaactccaatcataatttcatggagatccaagcccagagcgatttttctgagcagattgccacggctaacaacaataacctgtcccaagtccttcccgccaaatgggaacctggacggaagaatctggctagcctcgacgagttcatctctaacctgtataccagcccccagaataagaaagccctgcgcaaggcgattagagtggttcaggatatgatgacagccgctggccacatgcctgaaaagatctttattgaggtggcccgggacacctccaactctcatcagcaaacaatcgctagacagcgccagcttcagcaactctaccagagcgaagacaaggaggtcattgattccagcgtgcggtctgagctggacgatatcctgaaaaatagagccaacatcaaggaccagctgttcctctattttcagcaagggggacgcgatctttacaccggcaaggcgattaatatcgacaaactgtccctctatcacattgatcatatcctgccccagagcctggtgaaggacgattcccttgacaacagagttctcgtctctcagaaaacgaatgaagataagggggtgacattcgtgagcgacaaatacatgaacaatatgctgccgacctggaagcggtggcacgagatgggcctgatttccgcccgcaaactcaagaacctgacaatgagacctgacgaaatcgataagtatgctcccggatttatccaacggcagcttgtcgagacccgccaggtgaccaaactggttattgaactcctggacgccctgcttggcaattctcagacagagatcattacgatcaaggctagcctgtcccaccaattcagacagcagtttgatctcgtgaaaattcgggaggtcaacgacaaccatcacgccttcgatgcctttctggctgcgcgcatcgggacctacctctacaagagatatcctaaactgcggccctacttcgtgtatggacagtacatgcaaaatcataagaaccttaagtctatcaatctgattaaaacactcgacagcgataaggccatcgttgacgaaggcaccggggagattctgtgggataaaaagtccgacctggctaaaatgatcaagatttataactaccagcgccttctgatcacacacgaaagcagaacctcttttggagccatgtataagcagaaaattctcaaggccacggatgctaaacagaatggcgggggcttcaagctggtgcctacaaaacggaacagacccgtcgacatctacggaggctacaccgggcaaaccgccgcgtatctcacaatcgtgcgcgtttactccaagaagaccagcgagctgcgggtgcttccgatttatacaaataaagtccagcagatcgagaaggctatgacgcagggagataaagccaccatgctggccttcaagaaagtgattgctcctcaactcggcaaggaaaacaagaaaacacacgagatcaagattcccgaatttgacgtggtcatccccaaagttctgctggaccagcttgtgatcgatgacattgccgggtctcctcatagattccgcctgggaaccgatacatactatcacaattcccagcaactctttctgccgctcagcatgcagcggcagctgatggacagagagtctgatgacaaggtgtaccttgatatcttcaacgacgtcctgaaacaggtggattcctattttaatctgtacgacgttaacggcttccgcgcggctctccaaaagagcaaaaaggcctttgaacagctgcccattaatgatttccctaaggacgtgcccgataacaaaaagaaaaaggggaaacggtccatccttaaggagatttttatcggcctgcatgccaatgctaccctcggaaacctgaagcagatgggcatcaaaacggacttcgggaagctccagaaaagcaacggactgagaattaccgagaattgcaagatcattcaccaatctcctacaggcctttttgaacgcatcgtccccattaaatga

SEQ ID NO: 4275 - RNA, 4107 nt, synthetic construct
  misc_feature 1..4107: note = Cas9 variant
  source 1..4107: mol_type = other RNA
atggacaagaaatacagcatcggcctggatattgggaccaactccgtgggatgggccgtcatcacagacgattataaggttccctctaaaaagttcaaagtgctcggcaatacggacagacacagcattaagaagaacctgatcggggcccttctgtttgattccggagagattgccgaagcgacccggctcaaacgcacagctagacggcgctacaccagacggaagaatcgcatctgctatctgcaggagatcttctctaacgaaatggccaaagtggacgatagctttttccatagacttgaggaatcctttctggtcgaggaggacaagaaacacgaacggcatcctattttcggcaatatcgtggatgaggttgcctaccacgaaaagtatccgacaatttaccatctccgcaagaaactggtggactctaccgataaggctgacctgagactcatctatctggcccttgctcacatgattaaatttcgggggcacttcctgatcgagggagatctcaaccccgacaatagcgacgtcgataagctgtttattcaacttgtgcagacatacaaccagctgttcgaggaaaatcctatcaacgcctccggcgttgacgcgaaagccatcctcagcgctcgcctgtctaagtccagacggctggagaatctcattgcccagctgcccggcgaaaagaagaacgggctttttggaaatctgatcgctctcagcctgggccttacccctaacttcaagtctaattttgatctggccgaggacgcgaaactccaactgtccaaggatacgtacgacgatgacctggataacctcctggcccagattggggaccagtatgctgatcttttcctggccgctaaaaacctcagcgacgccatcctgctttctgacattctgcgcctcaattccgaaatcaccaaggctcccctgagcgcttccatgatcaaaagatacgatgagcatcaccaggacctgacactcctgaaggcgcttgtgcggcaacagctgcctgagaagtataaagaaattttctttgatcagtctaagaacggatacgccggctatatcgacgggggagctagccaggaggaattttacaaattcattaagccgatcctcgagaaaatggatggcaccgaggaactgctggccaaacttaatagagaggacctcctgcgcaagcaacggacattcgataacggctccattccccatcagatccacctgggggaactccacgccatcctgagacgccaggaggacttttatcctttccttaaagataatcgggaaaagattgagaaaatcctgacctttcgcattccctactacgtcggacctctcgctagaggcaacagccggttcgcctggatgacgagaaagtctgaagagacaatcaccccctggaattttgaggaagtggtggacaaaggggcgtccgctcaatctttcattgagcgcatgacaaactttgataagaatctgccgaacgaaaaggtcctgcctaaacatagccttctctatgagtacttcaccgtttataatgagctgaccaaggtgaaatacgtgacagaaggaatgcggaagcccgcctttctgagcggcgagcagaaaaaggccatcgtcgacctcctgttcaaaacgaacagaaaggtgaccgttaagcagcttaaagaagattatttcaagaaaattgagtgttttgactccgtggaaatctctggggtcgaggaccgcttcaatgctagcctgggaacataccacgatctcctgaagatcattaaagacaaggattttctggacaacgaggaaaatgaggatatccttgaagacattgtgctcaccctgacactgttcgaggatcgggaaatgatcgaggagagactcaagacctatgcccatctgtttgacgataaagttatgaagcagcttaaacggcgcagatacacggtgtggggccggctgtccagaaagctcattaacggcatccgcgacaaacaaagcgggaagacaatcctggatttcctgaagtctgacggatttgctaaccggaatttcatgcagcttattcacgatgactccctcacctttaaagaagacatccagaaggcccaggtcagcggccaaggggattctctgcatgagcacattgcgaacctggccggatcccctgctatcaaaaagggcattctccagaccgtgaaagtcgtggacgaactggttaaggtgatggggagacacaagcccgagaatatcgtcatcgaaatggcccgcgagaaccagacaacccagaaaggccaaaagaatagcagagagcggatgaaacgcattgaagagggaatcaaggaacttggctcccagattctgaaagagcatcccgtggagaacacacagctccagaatgaaaagctgtacctgtattaccttcaaaacgggagagatatgtatgttgaccaggagctggatatcaatcggctctctgactacgatgtggaccacattgtccctcagagcttcatcaaagatgactccatcgataacaaggtgctgacgcgctctgacaagaatagaggaaaaagcgacaacgtgccgtccgaagaggttgtcaagaaaatgaagaattattggcggcaactcctgaacgctaaacttattacccagcgcaagtttgataatctgacaaaggccgaaagaggcgggctcagcgagctggacaaagcgggattcatcaagcggcagctggtggagacccgccagattacaaaacatgtggcccaaatccttgattctagaatgaacaccaagtacgacgaaaacgataaactgattcgggaggtcaaggtgatcacgctcaagtccaaactggttagcgactttagaaaggatttccagttctataaagtgcgcgaaattaataactaccaccacgctcatgacgcctacctcaatgctgtcgtgggcaccgccctgatcaagaaatatcccaaacttgagtctgaatttgtttacggggattataaggtgtacgacgtccggaagatgctggccaagtccgagcaggagatcggcaaagctacagcgaagtatttcttttacagcaacattatgaatttctttaaaaccgaaatcacactcgccaacggagagattagaaagcgccctctgatcgaaaccaatggcgagacgggggaaattgtgtgggataagggacgggacttcgctacagttagaaaagtgctgtctatgccccaggtcaacatcgtgaagaaaaccgaggtgcaaacaggcgggtttagcaaggagtccatccttcctaaacgcaatagcgataagctgattgcccggaaaaaggactgggaccccaagaaatatggaggcttcgattctccgaccgtcgcctactccgttctcgtggtggctaaggtcgaaaaaggcaagagcaaaaagctgaagtccgtgaaagagctcctggggatcaccattatggaaagatctagctttgagaagaaccctatcgacttccttgaggccaaaggatacaaggaagttcgcaaagatctgattatcaagctgcccaagtattccctctttgagctggaaaatggccggaaaagaatgcttgcgtctgctggggagctgcagaagggaaacgaactcgccctgcctagcaaatacgtgaatttcctctatctggcctcccactacgagaaacttaagggctctcccgaggacaacgaacagaagcagctgttcgtcgagcaacataagcactatctggatgaaatcattgagcagatcagcgaattttccaaacgggtgattctcgctgacgccaatctggataaggttcttagcgcgtacaacaaacatcgcgacaagcctatcagagagcaggctgagaacattatccacctgttcacactcacgaatctgggggcccccaccgcctttaaatatttcgatacaaccattgaccggaagcgctacacatctaccaaagaagtgctcgatgctacgtttatccaccaatccatcacaggactgtacgagaccagaattgaccttagccagctgggcggggattga

SEQ ID NO: 4276 - RNA, 4107 nt, synthetic construct
  misc_feature 1..4107: note = Cas9 variant
  source 1..4107: mol_type = other RNA
atggacaagaaatacagcatcggcctggatattgggaccaactccgtgggatgggccgtcatcacagacgattataaggttccctctaaaaagttcaaagtgctcggcaatacggacagacacagcattaagaagaacctgatcggggcccttctgtttgattccggagagaccgccgaagcgacacggctcaaacgcaccgctagacggcgctacacaagacggaagaatcgcatttgctatctgcaggagatcttctctaacgaaatggccaaagtggacgatagctttttccatagacttgaggaatcctttctggtcgaggaggacaagaaacacgaacggcatcctatcttcggcaatattgtggatgaggttgcctaccacgaaaagtatccgaccatctaccatctccgcaagaaactggtggactctacagataaggctgacctgagactcatttatctggcccttgctcacatgatcaaatttcgggggcacttcctgattgagggagatctcaaccccgacaatagcgacgtcgataagctgtttatccaacttgtgcagacctacaaccagctgttcgaggaaaatcctattaacgcctccggcgttgacgcgaaagccatcctcagcgctcgcctgtctaagtccagacggctggagaatctcatcgcccagctgcccggcgaaaagaagaacgggctttttggaaatctgattgctctcagcctgggccttacgcctaacttcaagtctaattttgatctggccgaggacgcgaaactccaactgtccaaggatacctacgacgatgacctggataacctcctggcccagatcggggaccagtatgctgatcttttcctggccgctaaaaacctcagcgacgccattctgctttctgacatcctgcgcctcaattccgaaattacaaaggctcccctgagcgcttccatgatcaaaagatacgatgagcatcaccaggacctgaccctcctgaaggcgcttgtgcggcaacagctgcctgagaagtataaagaaatcttctttgatcagtctaagaacggatacgccggctatattgacgggggagctagccaggaggagttctacaaatttatcaagccgattctcgagaaaatggatggcacagaagaactgctggccaaacttaatagagaggacctcctgcgcaagcaacggaccttcgataacggctccatcccccatcagattcacctgggggaactccacgccatcctgagacgccaggaggacttttatcctttccttaaagataatcgggaaaagatcgagaaaattctgacgtttagaatcccctactacgtcggacctctcgctcgcggcaacagccggttcgcctggatgacaagaaagtctgaagagaccattacaccctggaattttgaggaagtggtggacaaaggggcgtccgctcaatctttcatcgagcgcatgaccaactttgataagaatctgccgaacgaaaaggtcctgcctaaacatagccttctctatgagtacttcaccgtttataatgagctgacaaaggtgaaatacgtgacggaaggaatgcggaagcccgcctttctgagcggcgagcagaaaaaggccattgtcgacctcctgttcaaaaccaacagaaaggtgacagttaagcagcttaaagaagattatttcaagaaaatcgagtgttttgactccgtggaaatttctggggtcgaggaccgcttcaatgctagcctgggaacctaccacgatctcctgaagatcatcaaagacaaggattttctggacaacgaggaaaatgaggatattcttgaagacatcgtgctcacactgaccctgttcgaggatcgggaaatgattgaggagagactcaagacgtatgcccatctgtttgacgataaagttatgaagcagcttaaacggcgcagatacacaggctggggccggctgtccagaaagctcatcaacgggattcgcgacaaacaaagcggaaagaccatcctggatttcctgaagtctgacggctttgctaaccggaatttcatgcagcttatccacgatgactccctcacctttaaagaagacattcagaaggcccaggtgagcgggcaaggagattctctgcatgagcacatcgcgaacctggccggctcccctgctattaaaaaggggatcctccagacagtcaaagtggtcgacgaactggtgaaggttatgggcagacacaagcccgagaatattgtgatcgaaatggcccgcgagaaccagaccacacagaaaggacaaaagaatagcagagagcggatgaaacgcatcgaagagggcattaaggaacttgggtcccagatcctgaaagagcatcccgtcgagaacacgcagctccagaatgaaaagctgtacctgtattaccttcaaaacggaagagatatgtatgtggaccaggagctggatattaatcggctctctgactacgatgttgaccacatcgtgcctcagagcttcattaaagatgactccatcgataacaaggtcctgacccgctctgacaagaatagaggcaaaagcaacaatgtgccgtccgaagaggtggttaagaaaatgaagaactattggcggcaactcctgaatgctaaacttatcacacagcgcaagtttgacaacctgaccaaggccgaaagagggggactcagcgagctggataaagcgggcttcattaagcggcagctggtcgagacacgccagatcaccaaacatgtggcccaaattcttgactctagaatgaacacgaagtacgatgaaaatgacaaactgatccgggaggtgaaggtcattaccctcaagtccaaactggtgagcgattttagaaaggacttccagttctataaagttcgcgaaatcaacaattaccaccacgctcatgatgcctacctcaacgctgtggtcgggacagccctgattaagaaatatcccaaacttgagtctgaatttgtgtacggcgactataaggtttacgatgtgcggaagatgatcgccaagtccgagcaggagatcggaaaagctaccgcgaagtatttcttttacagcaatattatgaacttctttaaaacagaaatcaccctggccaatggcgagattagaaagcgccctctcatcgaaacgaacggggagacaggagaaattgtctgggacaagggccgggatttcgctaccgtgagaaaagttctgtctatgccccaggtgaatatcgtcaagaaaacagaggtgcaaaccgggggatttagcaaggagtccatcctgcctaaacgcaacagcgacaaacttattgcccggaagaaggattgggaccccaagaaatatggcgggttcgactctccgaccgtggcctactccgtcctggttgtggctaaggtggaaaaaggcaagagcaaaaagctcaagtccgtcaaagagctgctcggaatcacaattatggaaagatctagctttgagaagaatcctatcgatttcctggaggccaaaggctacaaggaagtgcgcaaagaccttattgttaagctgcccaagtattccctgtttgagctcgaaaacgggcggaaaagaatgctggcgtctgctggagagcttcagaagggcaatgaactggccctccctagcaaatacgtgaacttcctgtatctcgcctcccactacgagaagctgaaagggtctcccgaggataatgaacagaagcagcttttcgtcgagcaacataagcactatctggacgaaatcatcgagcagattagcgaattttccaaacgggtgatcctggctgatgccaacctcgacaaggttctgagcgcgtacaacaaacatcgcgataagcctattagagagcaggctgagaatatcattcaccttttcacgctgaccaacctcggagcccccgccgcttttaaatatttcgacacaaccatcgatcggaagcgctacacatctaccaaagaagtgctggacgccacgtttattcaccaatccatcacaggcctctacgagaccagaatcgatctgagccagcttgggggcgactga

SEQ ID NO: 4277 - RNA, 4107 nt, synthetic construct
  misc_feature 1..4107: note = Cas9 variant
  source 1..4107: mol_type = other RNA
atgagcagaccctacaacatcggcctggacattgggacctcctctatcggatggagcgtggtcgatgaccagtccaagctcgtttctgtgcggggcaaatatgggtacggagtgcgcctgtatgatgagggccaaacagccgctgaaagacggagcttccgcacgaccagacggcgccttaagagacggaaatggcgcctggggctcctgagagagatttttgaaccttacatcacaccgattgacgataccttctttcttcggcagaagcagtccaatctgtctcccaaagaccagcgcaagctctatacacaaaccagcctgttcaacgatagaacagaccgggccttttacgatgactatcctaccatctaccatctgcgctacagactcatgacggagaagcggcagttcgatatcagagaaatttatctggcgatgcaccacatcgtcaaataccgcggacattttcttaatgaggctcccgtgtccagcttcaagtcttccgagattaacctggttgcccactttgaccggctcaataccatcttcgccgatctgtttagcgaatctggcttccagcttgagacagacaaactggctgaagtgaaggccctcctgctggacaaccagcaatccgctagcaatagacagcgccaggccctctctctgatttataccccttccacaaacaaagcggtcgagaagcagaataaggccatcgctaccgagcttctgaaagccattctcggcctgaaggctaaatttaacgtgcttacggggatcgaagccgaggatgttaaggcgtggacactgaccttcaatgccgaaaacttcgacgaggaaatggtgaaactcgagagctccctggatgacaatgctcatcaaatcattgagtctctgcaggaactctacagcggagtcctgcttgccggcatcgtgcccgagaaccagtccctgagccaagctatgattacaaagtatgatgaccaccagaaacacctcaagatgctgaaggccgtgcgggaagcccttgctcctggggatagacagcgcctgaaacaggcgtacgaccaatatgtcgatggacaggagaataccaaggcctactctaaagaagacttttacggcgatatcaccaaggctctcaaaaacaacccggaccatcccattgtttccgagatcaagaagctgatcgagctggaccagttcatgcctaaacagcggacaaaggataatggggccattccccaccaactccatcagcaggaactggacagaatcattgagaaccagcaacagtattacccttggcttgccgaactgaatcccaacagcaaacgccagacggtggctaagtataaactcgatgagctggtggcctttcgggtcccgtactatgtgggacctctgatcaccgcggaacagcaaagacagtctagcgacgctaagttcgcctggcttattcgcaaggccgagggccggatcacaccctggaattttgatgacaaagttgatagacaggcttccgccaacgagttcatcaagcggatgaccacaaccgacacgtacctcctggctgaagatgtgctgcctaaacaatctctcatttatcagcgctttgaggtcctgaatgaacttaacggcctgaagatcgacgatcagcccattacaaccgagctcaaacaggccatcttcaccgacctgtttatgcaaaagattagcgtgacagttaagaatatccaggattacctggtgtccgagaaaagatacgcgagccggcccgccattaccgggctttctgacgaaaacaagttcaattccagactcagcacatatcacgacctgaaaatgatcgtcggagatgctgtggacgatgtcgacaagcaggccgatctggagaaatgcatcgaatggtctacgatttttgaggacggcaagatctactccgctaaactcaacgaaattgattggctgaccgaccagcaacgcgtgcagcttgccgcgaagcggtatagagggtggggacgcctgagcgccaagctcctgacacagatcgttaatgctaacggccagagaattatggatctgctttgggacaccacagataatttcatgcggatcgtgcactccgaggactttgataaactcatcaccgaggccaaccaaatgatgctggctgaaaacgacgtccaggacgtgattaatgatctgtacacgtctcctcagaacaagaaagccctccgccaaatcctgcttgttgtgaatgacattcagaaggccatgaaagggcaggctccggagagaatcctgattgagttcgcgcgggaggatgaagtcaacagccgcctctccgtgcagagaaagcggcaagtggagcaggtttatcagaatatctctaacgagctgctgaataacaccgaaatccgcaatgagcttaaggacctcagcaactccgccctgagcaatacaagactgttcctctactttatgcagggaggccgggatatgtataccggcgactctctgaacattgatcgcctttccacatacgacatcgatcatattctgccccagagcttcatcaaagacaattctctcgataacagagtcctggtgtcccaaaagatgaatcggagcaaagctgaccaggtgcctaccgactttacgtctgtcgaactggggcagaagatgcaaattcagtgggagcagatgcttagagccggactgatcacaaagaagaagtacgataacctcaccctgaaccccgaccacatcagcaaatatgccatgaagggcttcattaatcgccagctcgtggaaacacggcaagttatcaaactggctaccaaccttctgatggagcagtacggggaggataatattgaactcatcaccgtgaagtccggactgacacatcagatgagaacggagtttgacttccctaaaaaccgcaatctgaacaatcaccatcacgcctttgatgcgtatcttaccgctttcgtcggcctgtacctcctgaagcggtatcccaagctcaaaccgtactttgtgtatggggaataccaaaaggccagccagcaggacaaatggagaaacttcaattttctgaacggccttaagaaagatgagctggttgacgagaatacagaagccgtgatttgggataaggagtctggactcgcttacctgaacaaaatctatcagttcaagaagattctggtcacccgcggcgtgcacgaaaattccggggccctttttaaccaaacactgtacgcggctaaagacgataaggccagcggacagggcgggaaacagctcatccctgccaagcaggaccggtccaccgctctgtatggaggctactctgggaaaacggttgcctatatgtgtatcgtgagaattaagaataagaaaggcgatctctacaaggtctgcggagtggagacaagctggctggctcaacttaaacagctgaccgacgaagactcccagaaggccttcctggagcagaaaatctctccccaattcaccaaggtgaagaaacagaagggcaacattatcgaggcggtcgaagagtttgaagttattgcccctcatatcctcatcaaccagcgcttctttgataatgggcaagagctgacacttggaagcgctacctataaacacaacgaacaggagctgattctcgacaagacagccgtgaaactgctcaatggcgctctgccccttacgcagtccgaggaactggccgaacaggtgtacgatgaaatcctggaccaagtcatgcattacttccctctctatgataccaaccagtttcgggccaagctgtctacagggaaggctgcgttcatgaaacttccctggaaaagccagtgggacggaaataaaatggtgcaggttggccaacaggtgattctggatagaatcctcattgggctgcacgccaacgctgccatgtccgacctcaaggtcctgaaaatgaccacaccgtttggcatgatccagcagagcaccggaatcacgctttctgccgatacccaaattatctaccagtcccctacaggcctgttcgagcggcgcgtggctctgagagacctctga

SEQ ID NO: 4278 - RNA, 4107 nt, synthetic construct
  misc_feature 1..4107: note = Cas9 variant
  source 1..4107: mol_type = other RNA
atggacaagaaatacagcatcggcctggatattgggaccaactccgtgggatgggccgtcatcacagacgattataaggttccctctaaaaagttcaaagtgctcggcaatacggacagacacagcattaagaagaacctgatcggggcccttctgtttgattccggagagaccgccgaagcgacacggctcaaacgcaccgctagacggcgctacacaagacggaagaatcgcatttgctatctgcaggagatcttctctaacgaaatggccaaagtggacgatagctttttccatagacttgaggaatcctttctggtcgaggaggacaagaaacacgaacggcatcctatcttcggcaatattgtggatgaggttgcctaccacgaaaagtatccgaccatctaccatctccgcaagaaactggtggactctacagataaggctgacctgagactcatttatctggcccttgctcacatgatcaaatttcgggggcacttcctgattgagggagatctcaaccccgacaatagcgacgtcgataagctgtttatccaacttgtgcagacctacaaccagctgttcgaggaaaatcctattaacgcctccggcgttgacgcgaaagccatcctcagcgctcgcctgtctaagtccagacggctggagaatctcatcgcccagctgcccggcgaaaagaagaacgggctttttggaaatctgattgctctcagcctgggccttacgcctaacttcaagtctaattttgatctggccgaggacgcgaaactccaactgtccaaggatacctacgacgatgacctggataacctcctggcccagatcggggaccagtatgctgatcttttcctggccgctaaaaacctcagcgacgccattctgctttctgacatcctgcgcctcaattccgaaattacaaaggctcccctgagcgcttccatgatcaaaagatacgatgagcatcaccaggacctgaccctcctgaaggcgcttgtgcggcaacagctgcctgagaagtataaagaaatcttctttgatcagtctaagaacggatacgccggctatattgacgggggagctagccaggaggaattttacaaattcatcaagccgattctcgagaaaatggatggcacagaggaactgctggccaagctgaatagagaggacctcctgcgcaagcaacggaccttcgataacggctccatcccccatcagattcacctgggggaactccacgccatcctgagacgccaggaggacttttatcctttccttaaagataatcgggaaaagatcgagaaaattctgacgtttagaatcccctactacgtcggacctctcgctcgcggcaacagccggttcgcctggatgacaagaaagtctgaagagaccattacaccctggaattttgaggaagtggtggacaaaggggcgtccgctcaatctttcatcgagcgcatgaccaactttgataagaatctgccgaacgaaaaggtcctgcctaaacatagccttctctatgagtacttcaccgtttataatgagctgacaaaggtgaaatacgtgacggaaggaatgcggaagcccgcctttctgagcggcgagcagaaaaaggccattgtcgacctcctgttcaaaaccaacagaaaggtgacagttaagcagcttaaagaagattatttcaagaaaatcgagtgttttgactccgtggaaatttctggggtcgaggaccgcttcaatgctagcctgggaacctaccacgatctcctgaagatcatcaaagacaaggattttctggacaacgaggaaaatgaggatattcttgaagacatcgtgctcacactgaccctgttcgaggatcgggaaatgattgaggagagactcaagacgtatgcccatctgtttgacgataaagttatgaagcagcttaaacggcgcagatacacaggctggggccggctgtccagaaagctcatcaacgggattcgcgacaaacaaagcggaaagaccatcctggatttcctgaagtctgacggctttgctaaccggaatttcatgcagcttatccacgatgactccctcacctttaaagaagacattcagaaggcccaggtgagcgggcaaggagattctctgcatgagcacatcgcgaacctggccggctcccctgctattaaaaaggggatcctccagacagtcaaagtggtcgacgaactggtgaaggttatgggcagacacaagcccgagaatattgtgatcgaaatggcccgcgagaaccagaccacacagaaaggacaaaagaatagcagagagcggatgaaacgcatcgaagagggcattaaggaacttgggtcccagatcctgaaagagcatcccgtcgagaacacgcagctccagaatgaaaagctgtacctgtattaccttcaaaacggaagagatatgtatgtggaccaggagctggatattaatcggctctctgactacgatgttgaccacatcgtgcctcagagcttcattaaagatgactccatcgataacaaggtcctgacccgctctgacaagaatagaggcaaaagcgacaacgtgccgtccgaagaggtggttaagaaaatgaagaattattggcggcaactcctgaacgctaaacttatcacacagcgcaagtttgataatctgaccaaggccgaaagagggggactcagcgagctggacaaagcgggcttcattaagcggcagctggtcgagacacgccagatcaccaaacatgtggcccaaattcttgattctagaatgaacacgaagtacgacgaaaacgataaactgatccgggaggtgaaggtcattaccctcaagtccaaactggtgagcgactttagaaaggatttccagttctataaagttcgcgaaatcaataactaccaccacgctcatgacgcctacctcaatgctgtggtcgggacagccctgattaagaaatatcccaaacttgagtctgaatttgtgtacggcgattataaggtttacgacgtgcggaaaatgatcgccaagtccgagcaggagatcggaaaagctaccgcgaagtatttcttttacagcaacattatgaatttctttaaaacagaaatcaccctggccaacggcgagattagaaagcgccctctcatcgaaacgaatggggagacaggagaaattgtctgggataagggccgggacttcgctaccgtgagaaaagttctgtctatgccccaggtgaacatcgtcaagaaaacagaggtgcaaaccgggggatttagcaaggagtccatcctgcctaaacgcaatagcgataaacttattgcccggaagaaggactgggaccccaagaaatatggcgggttcgattctccgaccgtggcctactccgtcctggttgtggctaaggtggaaaaaggcaagagcaaaaagctcaagtccgtcaaagagctgctcggactgacaatcatggaaagatctagctttgagaagaaccctattgacttccttgaggccaaaggctacaaggaagtgaaaaaggatctgatcattaagctgcccaaatattccctctttgagctggaaaatgggcgcaagcggatgcttgcgtctgctggagagctgcagaaaggcaacgaactcgccctgcctagcaagtacgttaatttcctctatctggcctcccactacgagaaacttaaggggtctcccgaggacaacgaacagaagcagctgttcgtggagcaacataaacactatctggatgaaatcatcgagcagattagcgaattttccaagagagtcatcctcgctgacgccaatctggataaagtgcttagcgcgtacaacaagcatcgggacaaacctattcgcgagcaggctgagaacatcattcacctgttcacgctcaccaatctgggagcccccgccgcttttaagtatttcgatacaaccatcgacagaaaacggtacacatctaccaaggaagttctcgatgccacgctgattcaccaatccatcacaggcctttacgagacccgcatcgacctgagccagcttgggggcgattga

SEQ ID NO: 4279 - RNA, 4110 nt, synthetic construct
  misc_feature 1..4110: note = Cas9 variant
  source 1..4110: mol_type = other RNA
atgaagagaatcctgggcctcgacctggggaccaacagcattggatgggcccttgtgaatgaggctgaaacagtcaacgagaaatcctctatcgttaagctgggcgtgcgggtgaatcccctcacggtcgatgaacagaaaaacttcgaggccggaaagagcattcctaccaatgcgggacgcacactgaaaagaggcatgcggcgcaaccttcaaagatacaagctgcggcgcgactatctcatccagtgcctgaaggaatacgggtggattacctccgatacactgctctatgagtgtggaaatagaaccacatttgagacctaccggctgcgcgctaaagccgtggacgaagagatcgcccttgaagaactgggcagagttctcctgatgatcaacaagaaacggggctataagtctaatcgcaaagctaagagctccgatgaggggcagcttattgacggaatggccatcgctatggatatgtaccacaacggcacgaccccgggggaatatgtgtactctctgctcagcaaggggaaaaagtacattcccgtcttctatagatccgacctgctggatgagtttgaccggatctgggattaccagtgcgcctattaccctgacattctcacaagccaattcaaagaactgatccgcggcaagtcttcccaggtgaccagcaaactttttaagcagcagtataatctgttcacagcggataacaaagagaaggacaagagactccaagcctactgtcggagagctgacgccctgaaaaagcgccttcccgttgaagaggtggctgccgcgctgtgcgatgtcaatcgggacgtgaacgcctcttccgggtatctcggaaccattagcgatagatctaaaaagctgtttttcaataaacagacggtgggccagtacctgatgctcgagctggacaaggattcccattttagcgtcaagaacgaagttttctaccgccaggactatcttaacgagtttgaagctatctgggagaaacaagccgaataccaccctgagctgacacccgatcggaagaaaatcctcagagacgtggtgattttctatcagcgccctctgaagtcccagaaagatcttgtcgcttgttgcgagctggaacggagacgcatcgaggtgatgaaggacggcaaggttcggtctgtggaaattgggccgaaagtctgtcccaagagctcccctctctttcaagatttcaaaatctggcatgtgctgaataacctgaaggttagagacaaagccaccggagacgagcgcttcctcgaactggatgagaaggagattctttttagcgaactggccatcaagtctaaactctccaagacagaggctctgaaactgctttaccagaagcccaaaggcctcgacctgaattatgatagcgtggaagggaacaccacccaggcggccctgttcgaggcttaccagacagtcatcgccatgacgggacacggcgagtatgtgttttctaagatgagcgcctccgaagtcatgtctgtggttgagggggtgttcggaggcctcggctttaataccagcgtcctgcggttcgactcccttctgcaagggaaagaactcgagaagcaggatagctacagactgtggcatctgctttactcttatgaaggagacaactccgtgacaggcaccgatgggctcgttgctaaggtggccagcctgctgcggtgcgacgaggagtacgcgaaagtcgtggctggagtgacatttcagcctgattatggctctctctccgccaaggccattcgcagaatcctgccccacatgcgggctgggaatgaatacagccttgcctgtgagtatgctggctacaaacactccagacgctctctgaccaaggaggagctcgaacagaaagactataaggatcatctggagctgcttccgcggaacagcctcagaaatcctgttgtcgagaagattctgaaccaaatggtgaatgtggtcaacgccgtggttgacgcgtacggaaaacccgatgaaatccgcattgagatggccagagaactgaagaaatccgctaaggagcgggaagagatgacggccgctatcaataaagccacatctgagcacgaacgcatcaaggagattctcaacaaggaatttggcatccagcatgtgagccacaatgacattgtcagatacaaactgtattgcgagcttaagaacaacgggtacaaaaccctgtattccgacacctacatccctcaggagaagctctttagcaaagaagtggatattgagcacatcctgccccaggcgcggctgttcgacgattctttttccaataagacacttgaatatcgcagcgttaacattgagaagtctaatcaaaccgcctgggactacgtggctgccaaatggggagaagagggctccctcagatataagaaacgggtcgatgacctgctggctgccggggtgatcggaaagagcaaacatgataagctcctgatgaaacaggaggacatccccacagatttcattaaccgcgaccttagagatacgcagtacatcgcccggaaggctcgcgaaattctggaggacctcgttcctatggtggtctctaccacaggcgcggtgaccgatagactgcgggaagactggcagctggtggacgtcatgcaagagcttaattgggataagtacgccatgaaagggctgacagaagagtggaccgacaaggatggcagacgcatcagccggattaaagagtggacgaagagaaacgaccaccgccatcacgctatggatgccctcaccatcgcctttacaaaacattccttcatccagtatctgaataacctcaatgctcggagcgacaagtctggatccatttacgccatcgaacagaaggagctgtatagagataaccacggcaaacttcgcttcattatgccgtttgaagggttccggagcgaggcgaagagacaactggaaaatatcctcgtttccattaaagctaagaacaaagtggtgacccgcaatgtcaacaatgcccggagaggatctggccggcaggccaaggtgcagctgacaccccgcgggcagctgcacaacgagaccatctacggaagcatccatagatatgttacgaaacttgagaaggtgggcgggaactttgacggcgaacaaattgctaaggtcgccaatctgcggtaccgcgaggcgctccaggctagacacgaagccttcggaggcgatgccaaaaaggcttttacagggaaaaacgccctggacaagaatcctctctatctgaaggatacccggacagaggtgccccttaaagttaagaccgtgtccaccgagacactgtacacgatcagaaaagctgtcgcccctgacctcaacgtggacaaggttattgatgcgaaagtgcgcaaggtcctggaggaacggctgcaggaatacggaggcgaccccaagaaagccttcgtgaatcttgatgagaacccgatctatctgaataaggctaaagggattaccatcaagagagtggccatcacaggagtcaacaatgctattgccctccatgacaaaaaggatgttggcgggcacgtgatgctggacgcctctggccgcaaacagcctgtggattttgtcaacaccggaaataaccaccatgtggctatctaccgggacgcggaaggcagcctccaagaggttgtggtctccttctatgaggccgtggctagagtttctctggggcttcccgtgattgatcgcgaataccggaaggaggacggatggcagtttctgttcacaatgaagcagaatgaatattttgtcttccctaaccccgagaccggctttaatcctcaggaagtggatctgacggacgagacaaactacgccctcatcagccccaacctgttcagagtccaaaaattcaccattaaggattatttcttccgccaccatcttgagaccacagtggaagacagaaaagagctgaaggacatgacctggaaacggtgtgggctcggaggcatcattggcatcgttaaggtgcgcgtcaatcacatcgggagaattgtgtccgttggagaatactga

SEQ ID NO: 4280 - RNA, 4110 nt, synthetic construct
  misc_feature 1..4110: note = Cas9 variant
  source 1..4110: mol_type = other RNA
atggccaagacctacaacatcggcctggacattgggacaaatagcatcggatgggctgtggtcgatgaccagaaccacctcatgtccattaaaggcaagtatgggtacggagttagactgtatgatgagggcaaaacggccgaagaacggcgctctttcagaaccacacggcgcagacttaagcggcgcaaatggagactgagcctcctgcgggaaatctttgagccccaaattacccctcttgacaatacattctttctgcgccagaagcagtcctctctcagctccaaggataacagaaaactgtacccggaaatgtctctgttcaatgaccggaccgatacagacttttatacccagtaccccacgatctatcatctcagccgcgatctgatgaccaagaacaaacaattcgacatcagagagatttaccttgcgatgtaccacatcgtgaagtatcgggggcattttctgaatgagtcccctgtgagctctttcaaatccagcgaaattaagctcgctgagaactttgaaacactgaatcagatcttcaacgagcgctttaatgagtctatgttccagcttgccgtcaacgattttgacgatctgaaggccctcctgctgaatgaccagcaatccgctagcaacagacagaaaaaggccctcggaatgatttacgtgcccaatgaaaacaaatctctggagaagcagaacaaagctatcgccaccgaacttctgaaggcgattctcggcctgaaagccaagttcaatgttcttacaggcatcgaggtggacgatgctaagccttggaccctgtccttcaacagcgaatcctttgacgaggatatcgacaaagccgctacgaatattgatgacgattctcgggagatcattgccatcctccaggggctgtatagcgggattctgctcgcgggcatcatccccgaaaaccaatccctgagcgaggccatggtcgaaaagtacgaccagcacgctgcccatcttaaacagctgaagtctatttatcctctcctgtccatcagcgataaaaaggctattcaacaggcctacaattattacatcgacgggcaggataacgccaaggcttactctagagaggacttctatgcggccacaaccaaagctcttaagagctaccaggacaatgaaacaattgccgagatcctgaaactcatcgagctggaacaatttatgccgaagcagcgcaccaaagataacggagccattccccaccagctgcaccagcaagagctcgaacggatcattgagaatcagcagaagtattacccttggctggctgaacttaaccccaatgagtccagacgcaagatcgccaaatataagctggacgagctcgtggcgttccgggttccttactatgtgggccccctgattacctctgaacagcaacagcagagctccaacaaaaagtttgcttggatgatcagaaaagccgaggggaagattacaccgtggaatttcgatgaaaaggtcgaccgccaggccagcgctaacgagtttatcaaacggatgacgaccacagatacctacctgcttgccgaggacgtgctccctaagcaatctctggtgtaccagagattcgaagtcctgaatgagctcaacggaatcaaaattgatgacgttcccatcacagtggaacagaagcaacgcatttttaacgatctgttcatgatgcaggcttccgtgagcgtcaaaaatatccaggactatcttgtgtctaagggctactttgcctcccggcctgagattaccggcctgagcgatgaaaacaaagttatctccagactctctacgtatcatgacctgaaggcgatccttgggggaattgtggatgaggccaataagcaggctgaccttgagaaatgcgtcgaatggagcacaatcttcgaggacggcaagatttttgtggaaaaactcaacgagatcgaatggctgaccgatgagcaacgcaagcggctgtcctctaaaagataccgggggtggggacgcctcagcaataagctgcttaaccagattgttaatgagaacggccagagaatcatggacctgctctgggataccacagacaatttcatgcggatcgtgcactccgaagagttcgataagctgattagcgccgctaaccagaccctgctttctaaaaatgacgtccaagatgtgatcaacgacctctatacaagcccccagaataagaaagccctgagacagattctgctcgtcgtgtccgatatccagaaggcgatgaaaaaccaagccccctctaagattctgatcgaatttgctcgcgaggacgaagccaatcctcggctttccgttcagagaaagcgccaggtggagcaagtctaccagaacatcagcaaagatattctgtctgacagcgatgtgaaggctgagctcaaagacctgacgaacaccgccctggccaatacaagacttttcctctattttatgcagggaggacatgacatgtacaccggcgaaacactgaacatcgatcggctgtccgagtacgacattgatcacatcctcccgcaggctttcattaaggacaatagcctggataaccgcgttcttgtgtctgcgaaaatgaatagatccaagagcgaccaagtccccctgaacgattataccgaggagcggtttggctccaagatgcgcgtgcagtgggagcagatgctcagagccgggctgatcacgaaacggaagtacgacaatctgacccttaaccctgatcgcatttctaaatatgctatgaagggattcatcaatagacagctggtggaaacacggcaagttatcaaactcgtcaccaacctgctcatggaccactacgaggatgacgaagtgcagctgattacagtcaagagcggccttatccatcagatgcgcgagatgtttgacttccccaaaaatagaaacctgaataaccaccatcacgcctttgatgcctatctcaccgctttcgtggggatttacctgctgaagcggtatcctaagctgacgccctttttcgtgtacggatcctaccagaaaaataacacaaacgacaagtggagaaattttaacttcctgaatgatctcaaaaaggaagaggttatcgactctgatagccatgaggtgatttggaacaaagcccaaggcctggtcgaactcgacaagatctatcagttcaagaaaatcctggtgacccgcgaggttcacgaaaatacaggggcgctttacaaccagaccctgtattccgctaaggatgacaaagcctctggccagggaggcaagcaactcattccggccaaacaggatcggcctaccgctctgtacgggggatatagcggcaagacagtggcctacatgtgtatcgtcagaattaagtccaaaaaggaggacacgtataaagtgtgcggggttaagaccagctgggtggcggaactggagcgcctttctgattccaatgagcagctggctagcctcaaagccaagctgatgcccaagtttacaaagaacaagaaacaaaagggaaaaaccatccaggtcacagaagacttcgagattatcgtgcctcgggtgctcatcaatcagagattttacgataacggccaggaaattaccctggggtctgccacgtacaagcacaatgagcaagaacttatgctgaacaagaaagctgtcaagctgctcaatggccagctgtcccttgttgaggccgagacactggctccccaggtgtatgacgaaatcctcaaacaggtgatgaagtacttccctctgtatgacaccaaccaatttcgcaccaaactcaagatgggaaaagagcagttcattaagctgccctggaagaataaatgggatggcaacaaacttatccatgtcgggcagcagacagtgctggaccggattctgatcggactccacgccaatgcggccgttagcgatctgtctacccttaaagtgacaacgccgtttggcaagctgcaacagccttccgggattgctctcagcctgaacaccaaaatcatctaccagtcccccacaggactcttcgaaagacgcgtcgccctgcggggcctttga

SEQ ID NO: 4281 - RNA, 4110 nt, synthetic construct
  misc_feature 1..4110: note = Cas9 variant
  source 1..4110: mol_type = other RNA
atggacaagccctacaacatcggcctggatattgggagccactccatcggatggaccgtggtcgacgataattctaaactcgttagaattaagggcaaactggggtatggagtgcggcttttcgacgagggcaagacagccgaagaacgcagacagtttcggacgacccgcagacggctgaaacgcagaaagtggcggctccgcctgcttagagaaatcttcgagcctcatattgctccgctggatgaaacatttttcctccggcaaaagcagagcaacctggtgcccacccagaaaaagctgcctcagctctccctgtttaatgaccgctctgatgccgagttctaccacaaatatcccacaatctaccatcttagaaacgcgctgatgaccgagaagcggcaatttgacctccgcgaaatctatctggctattcaccatatcgtcaaatacagagggcacttccttaatgccgcccctgctgccagctttaagtccggaaagttcgatctggagaacaaatttgaccagctcaatctgctgttcgcttctgcctatagcgatctcgactttacactgcggaccgataacgtggaccaggttaaggcgattcttctgaatgaagacctctccgccagcacgagacagcgccaagctctgccccttatctaccagacctctgccgatcagaaagctgccaagaaactgacaaagtccctcgcgaccgagctgctgaaagccattctcggcctgaaggctaagttcgacgtgcttacaggcatcgagaccgatgacacgaaagcctggcggctgacattcaacgctgaagattttgacgataagctcaatgagctgaacgtcaccgacaatgaagccgccacacagattatcgagatccttagagaactgtacagctctattctcctggctgcgatcgtgcctgagaactataccctgtcccaagccatgatggctaaatacaatgcccacaagcagcatctcagcctgcttcgccaggttaaaaccacactgccggccaagaagcaaaaagagctccaggctgcctatgatgactacattgatcagcatctgcccctggacaagttctatgcgaaacttacgaaggtgctccctaaagaaaaggacaccgataacccccagatcattcaaatcctgaacctgatcgacctcgatcagtttctgcctaagcagcggacaaaagacaatggggctattccccaccagcttcaccaacaggagctggatcagatcattgacaaccagaaggcctactatccgtggctcgcccaactgaatcctaacgaaaagagacagaagatcgctaaatacaagctggatgagcttgtcgccttccgcgtgccctactatgtgggacctctcattgaagctaagacccagcagaaaacatctggcgccaattttgcgtggatgatccggaaggagcccgggaccacgacacccatcaccccttggaacttcgacgagaaagtcaatagacaagcctccgctaacgaatttattaagcgcatgaccacaaccgatacatacctgctgggagaggacgttctcccgaaacacagcctgctttatcagcggttcgaagtgctgaatgagctcaacggcatcaagattgatcagaaaagagtgacggtccgccaaaagcaggccatctttaatgacctgttcctgaagcagcccaacgtgaccgttaaaaagctccagcaataccttcaggctaaaggggaatatgcctccgcgcctattatcacaggactgtctgatcccaagaaatttaatagccagctgtccacctaccatgagtataagaagattttcggcggcctcatcgacgaccctgataaacaggccgactttgagaagtgcatcgaatggagcacaattttcgaggattctcaaatcctgaaagacaaacttaaagaaattaactggctgacccccgagcagcggcacaaggtggctaataagagataccaggggtggggacggctctccaaaaagctgctgacgcagcttgtcgattacaacggccaacgcatcattgacatcctctggaacaccacagataatttcatgcagatcgtgcatagcgaggcctttgacaaagctattatcaaggaaaaccaggccctgctgacccaatataatccgcaggccgttattgatgacctctacacatctcctcagaacaaaaaggctctgagacagatccttctggtggtcaatgatattcaaaaggcgctcaaagggcaggcccccagccggatcctgatcgagttcgctagagaaggacaggagaaccctcgcctgtccacccagcggaagcaacaggtggaaaatgcctataaagaggcctctgacgcccttctgagctccgctgaggtcagacaggaactcaagggcctggataacaaagcgctcgctaatacgcgcctgtttctttacttcatgcaagggggaagagacatttatacaggcaagagcctgaacatcgacgatctctctaaatacgacattgatcacatcctgccccaggcctttattaaggacaattccctggataaccgggtgcttgttagcgccaagatgaatcgctctaaatccgaccaggtgcctctgaacgatttcgctgagatcagatatggcaagcagatgcggcagcaatgggagaaaatgctccgcgccgggctgatcaccagaaagaaataccataatctcacactgaaccccgagagcattaacaagtacaccgcgaagggatttatcaatcggcagcttgtcgaaacccgccaggtgacaaaactggctacgaacctcctggttgaccaatatgccgaggatgacgtgcagctgattaccgtcaagtccaatcttacacaccagatgagagaggagttcgattttccgaaaaaccggaatgtgaacaatcaccatcacgccttcgacgcttacctgaccgcctttgtgggcctctatctgctcaagcgctaccctaaactggctccctatttcgtttacggggactatcagaagggagcctctcaaaacagcaagtggagaaattttaacttccttggcaatctgcatcgggagaaagtcgtggataagaacacaggggaaatcatttggcagagagacgcgggcctgggagagctcaatcgcatctacaacttcaaaaagattctggtgacccgggcccttagagtcaatcgcggccccatgtttaaacagacgatctacaaggctgaagaggataagtcctctgggcggggaagcaaacagctgatccctacaaagaaaaacagaccgaccgagctctatggcgggtacaccaacaaggaaacagcctatctgtgtctcgtgaaagagccccacaagaagggagacatttaccgcatctgctccgttctgaatatgtggcttaccgaactggatcggattgctgaccctatcgccaaagcccaaaagctgacagagctcctgacgccccagttcaccacaaccaaaaagaaacagggccagaagattcctgtggtcaaaccctttaaggtggttatccctaagatccttattaaccaaagattctttagccgcgggcaggagctgacagtggcttctcccatgtatatgcacaatgaacaggaactcttcctgaacaaaaagaccatcaaactcctgaatggccaacttgcgaagaacgaagcccatgagctggctccgaaaatttaccagcagatcctggatcaggtcaatgactattttcctctctacgatatgtacaagttccgggacacgctgaacgcctccaaggaaatttttgtgaatcttccctggcaagatcagagacaggacaaaaagatcagccagtctggacaaaaatccatcctgaacaagattctcatcggcctgcacgccaatgctgcccggattaaactcaccgagctgaacttcaagagcgattttgggcttctgtctcagcgcagcggaatcgcgttctcccctgacgaccagattatctatcagagccccacaggcctgttcgagagacgggttaccctcaaggatctgtga

SEQ ID NO: 4282 - RNA, 4110 nt, synthetic construct
  misc_feature 1..4110: note = Cas9 variant
  source 1..4110: mol_type = other RNA
atgaaggtgaacaattaccacatcggcctggacattgggaccagctccatcggatgggtcgccatgggcgaggatgggaaacccctcagagttaagggaaaaacagctattggcgcccggctgttccgcgaagggaaccctgcggctgacagacggatgtttcgcacgaccagacggcgccttaatagacggaagtggcgcctgaaactcctggatgagatcttcgacccgtatattacacccgtggattctacctttttcgccagacttaagcagagcaactggtcccctaaggactctcggaaagcctttaaggatagcacactgttccccgacctcaccgataaacaataccatctggactatcctacaatctaccaccttcgccatgctctcatgacccaggataagcagtttgacatcagaatggtgtatctggcccttcaccatattgtcaaataccggggaaatttcctgaactccacgcccgtggattcttttaaggctagcaaggttaatttcgacgaccagtttaaaaagctcaacgaactgtataccgccatcaatcctgaggaatccttccaaattaactttgcgaatagcgagaaaatcggccagcagttccttgatccgtctattcgcaagttcgacaaaaagaaacagatctccaagattgtgcccgtcacaatggatgacaaggccgtggataaactgaacggcaagatcgctagcgagatcgttaatgccattctcgggtacaaatctaagctggacgtggctgtccaatgcgatcctgaagactccaaaccctgggccgtgaagtttgatgacgaggatatcgacgcgaagctgcagaaaattctccctgaaatggacgagaaccagcagagcatcattggaatcatccaagatctgtactctcaggtgacccttaatcagattgtccccaacggcatgtccctgagcgagtccatgatcaagaaatataacgaccaccacgatcatctcaagctgtacaaaaagctgattgggcaaatctctgacagcaagaaaaagacagccctgaaaaaggcttatgatcagtacgttggaaatgacggcaaagtgattgaacaggatgacttctattccagcgtgaagaagaacctcgatgactctgagctgtccaaacagatcatggatctgatcgacgccgataagtttatgccgaaacaaagaaccagccagaatggggtcattcctcaccagctccatcagcgggaactggacgagatcattgaacaccaatctaagtactatccctggcttgctgagagcaaccctaataaacacgacctgcatctcgccaagtacaaaatcgaggaactggtggccttccgcattccctactatgttggacccatgatcacgcctgaggatcagaagaagtccggcgctgcggtgttttcttggatgaaaagaaaggaaccgggccagattacaccctggaacttcgaccagaaagtcgatcggatggagagcgccaataagtttatcaaaagaatgaccacaaaggacacctaccttatcggggaagatgtgctgcctgacgagtccctcctgtatgagaagttcaaagttctgaacgaactcaatatggtgcgcgtcaacggagatagcctgaaggtggctgacaaacaagccatttaccaggatctttttgagaattataagcacatctctgtcaaaaagatgcagaactacattaaggacaaaaccggcctgcccaataaccctgatatctccgggctcagcgaccccgatcatttcaataactctctgggaacatataacgactttaagaaactgttcggcgacaaggtggatgacccggatcttcaggacgattttgaaaagattgttgagtggtccacggtgttcgaagacaagaagatcctccgggccaaactgaatgagatcagctggctgtccgataagcaaaaagacgatctcgagtctagcagataccagcgctgggggcggctgtccaagaaacttctgaccggaattgtcaacgaccagggcgaaagaatcattgatgagctctggaatacaaacaagaatttcatgcaaatccagtctgacgacgattttgctaaacgcattcacgaagccaacgcggaccagatgaaggctaccgatgtggaggacgttctggccgatgcctacacaagccctcagaataagaaagctatccggcaagtggtcaaggtggtggacgatatccagagagccatgggcggggttgctcccaaattcatttccatcgagtttacccgcagcgaagaccggaaccctagacggacgatttctcgcgagagacagctggaagatacacttaaggacaccgccaaaaccctcgtcaagtccatgaatcccgatatcctgagcgagctggacaacgcgtctaagtccaaaaagggactcacagatcggctgtatctttacttcacccagctgggcagagacatgtatacagggaaacctattaatatcgacgaaatcagcaactacgatattgaccatatcctcccccaagcctttattaaggatgactctctgagcaatcgcgtgctggtgtccaaagctgtcaacaatggaaagagcgccaacgtgccgcttaaactcttcggcgttaaaatggctcacttttggaagcagctggccgaggcggggctgatcaacaaacggaagctcaaaaatctgcagacgaaccctgataccatttctaagttcgccatgcacggctttatcagacgccagcttgtggagacatcccaagtcattaagctggtggctaatatcctcggagacaaatatagaaacgatgacaccaagatcattgaaatcacagcccggatgaatcatcagatgcgcgatgagttcgcttttattaaaaacagagaaatcaatgactaccaccatgccttcgatgcctatctgaccgcttttctgggccggtacctttaccaccgctatattaagctcagaccctacttcgtttatggggacttcaaaaagtttcgggaggataaggtgacgatgcgcaacttcaattttctgcacgacctgaccgacgatacacaggcgagaatcgccgacaccgaaacaggagaggtcatctgggatcgggagaccagcattaaacaactccgcgacgtgtaccattataagttcatgctgatctcccaggaagtttacacgcttagaggcgctatgtttaaccagacaatttatcccgccgatgaggccgggcggaaaaagctgatccctaccaaagctgacaaggccgtggatgtctacggaggctactctgggagcaatgacgcgtatatggctattgtgagaatccacgataaaaagggcgacaagtacaaagtggtcggagttccgatgcgcgccctcgatcggctgaacgccgctaagaatgtgtccgacgccaaatatgaccaggtgctgaaggatgtccttacaccccaattcaccaaatctaaaaagagcagaaagaccggcgaaatctcccagacagtggaggactttgaagttgtgctggggaaggtcatgtaccgccagctcgtgattgatggagacaaaaagttcatgctgggctctagcacgtatcagtacaacgcgaaacaactcgttctgtccgatgagagcgtgaagacccttgcttctaaggggaaactggacgaggcccaggaatccgccgcttatgataatgtctacgacgagatcctcgataaggtggaccggtactttgccctgtatgatcagagaaactaccgcacaaacctgcatgaaggagagcagaaattcattggccttcctctgcacgacacctttgatgggagcaagaaagttgctaatggcaagcgggagacaatctctgacattctcaacggactgcatgccaatgcgaccatgacgaacctcaaggtgctgggcatctccagccccttcgggatgttccaatctcacggacctattaatcttaaccccgaaacaatcatcctgtgtcagtcccctaccggcctctttgagagacgcattatcctgcgggacctgtga

SEQ ID NO: 4283 - RNA, 4113 nt, synthetic construct
  misc_feature 1..4113: note = Cas9 variant
  source 1..4113: mol_type = other RNA
atgaagaaaagaaactacaatatcggcctggacattgggaccagctccatcggatggacaattgtggatgacaacgcccagatcatgcgggctaagggcaaaaatgggtatggagtccgcattttcgccgagggcaagacggcggctgatagacgggggtttcgcaccacaagacggcgcctcaaaagacggaagtggcgcctgagacttctgcaagagttctttgaaccctacatcctccctatcgacgaaaacttctttatgcggcagaaggagtctaatctggttccgcaggatcccaacaaacacttcaagggaagcattctttttaatgaccgcaccgatcaggagttccatgaacaatatcctacaatctaccacctgagatatgccctcatgaccgagcatcggcagtttgacgtgcgcgaaatttactgggccatccaccatattgtgaaatatagaggccacttcctgaactccacactggcttctaagtttaaaggcggggagctccggctggccgataagttcgaaagccttaataagctgtttctcagagtccaggctgagaccggattcgagctgtccgaagacaacgtggataaaatcaagacggttcttctggacaatggcaaatctcgcctcgatcggcagagagaggtgctgaagattgtctacctgaccagcgaagacaaagacacagagaagaaacgcaaggccgtggcgaccgagttcatcaaggccgttctcgggctgaaaacaaaactttttatcgtgctggctaaaaaccccaccgccgaaacggattggaagttctcctttgacgctgaggatattgacgataaactcgacagcatctctgaacaactgacagatgacgatcacgagattgtcgaacttatctccgagattcatagcatcatcaccctgacaggagtggtgcctgaaggcatggggctctctgagtccatgattgccaagtacgaccagcaccagctggatctgaagaaactcaagagcctgatgcgggaccttgacgtcaaacaggcgagaaagctgcaagatgcctatgacgagtacatcgatggactcaaaccctctgaagaggctttctattccgccgttagctccgtgattcagaagatggacgatcctcgcgctaagaaaatcaccgccgaaattgagctggaagagtttatgccgaagcagcggaccaaagccaatggccaaatcccccatcagcttcaccagcaggagctggaccaaatcattgaaaaccagaaggagtactatccttggctcgctgaagagaatcccaacaaaagagagcacaacgcggcccctcataagctggatggcctggtgacattccgcgtcccctactatgtggggccgctcatcgaggcttctgttcagcagaagacgagcaattccaactttgcctggatggaacggaaagtgaagaatgacaccagcagaattacaccttggaacttcgaagagaaagtcgatcgcaatgcctctgctgaaaactttatcaagcggatgaccacaaaagacacctacctgcttaatgaggatgtgctgccccaacagtccctcctgtaccagagatatgaggttctgaacgaacttaataacgtgcgggtcaatgacaagaaactcgagaacaattgcaagcaggatgtgtacaaggacctgttcaaaaacaatacgacagtcagcattaagaaatttaaggactatctggtggccaactgtgaatacgcggataaccctaaaatcgagggactcgctgacgaatctattttcctgagctccctttctaccgagaataagtttaaggatatcttcggcgcccaaatcgacgatcccaactatttcgaggactttgaacacattatcgagtgggccaccattttcgaagataataaaatcctgcgcgctaagctcgacgagattagctggctgaacgaatcccagaaaaaggagctggccaaacttagaatgcgggggtggggaagactcagccgcaagctgatcgctgagatcacagatgaaaatggctctcggattatcgacctgctctgggagcatatggataactttatggttgtggtcaatcaggacgtgttcaaggaaaagattgttgccgagaacaaacaggtgtttaaggagctgaatccccttgatatcattaacgaacaattcacctcccctcagaataagaaagcgctgagacagatcctcctggtcgtggccgacatccaaaaggctatgaacggggtgacaccgagcaatatttttatcgagttcgcccgcgaagacgagagaaacccccggcgctctattcagagactgcggcaggttgaaaatatgtaccgcgatatctccgacacggtccttgctgatcctgaggtgagaaacgagctcagcaacattaagaataccgaactggcccgggaccgcgtgtttctgtatttcctccagggaggcagagatgtctacacaggcgagcccctgaacatcgacaaactttccgaatacgatatcgaccacattctgcctcaagcgtttatcaaggataattctctcgacaaccgggtgctggttagcgcctccctgaatcgctctaaaagcgattccgtgccccttgacgacttcaccagcgagatgtttgggagaaagatggaaccgctctgggagcagatgcagcgggctggactgatttctaaaaagaaactggccaacctcaagttcaatcctgagaacatcaataagtatacaagaaacggcttcattaatcgccagctggtcgaaacccggcaagtgatcaaacttgctgccaacattctgaaggatcattacggggaggaaacggagatcgttaatgtgaaagccggactcacccaccagtttagaaaggacttcgattttcccaaaaaccgcaatgtcaacaactatcaccatgctttcgacgcgtacctgacagccctggtgggcacctatcttctgaagaagtaccctaaactcgaatcctattttgtttacgggaagttcaaaaagggcgatggaatcacaaatctgaaaaactttaatttcctccacggctttaacaagcccgggaagattatcaataaagagaccggagagattctgttcgaccgggataagcagcttggctacatgaacagcatctatgacctgagaaaagtgattgtcacgcatgaactctctacacgccacggggctatgtacgatcagaccctgtataaggcctccgacgataaagacagcggacggggcgggaagcaactgatcagaaagaaagataatcttcctacagagatctacggcggatataccggctctaccgacgcctttatgagcattatccgcatgaagaaaaaggacaaactgtactataaggtgattggggtgcccacacgggtcgctcacgaagttctccagtccgatggaaagatcaacattttcacgctgaataaattcatcgagcagaagctcaccaaagagaaggtgaacaaaaagacaggcgccatcaccagaattacagactggtttgaactggtgatcgcgaaagtcatgtacgggcaagtgattgatgacggaggccagccgttcatgcttgggagctctaccctgccttacaatgttcgggagctctatctggctaaggatctggtgaaggtcatcaacaaaggctccacgagcaagtcctcttaccttgacgtgtatgatgaactggttaaaagcctcaataagtactttcccatgtatgaccgcaacatgttcagacagaaaattacagatgcccgggacaagtttgagaagctgcccaaacgcgataaggtgtccaatggaaaactccagcaaatcggccaggtcaccattatcgacagaatcctgattgggcttcataccaacgccggagtgtctaatctgaaggatctgggcatcgctacacctttcgggtttatgcagcagggaaacggcattagcctcacctccacagccaaaatcatttaccaatctagcacggggctgttcgaaaagtccaaggcgcttgacgacctgaacccgctcgcttga

SEQ ID NO: 4284 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctatcattacagatgactataaggtccctgccaagaaaatgagagttctcggcaacacggataaggagtacatcaaaaagaatctgattggggcccttctgttcgacggaggcaacaccgctgcggatcggcgcctcaagagaacagctcggcgcagatatacccggcgcagaaatcggatcctgtaccttcaggaaatctttgccgaggaaatgagcaaagtggacgattccttctttcaccgcctggaggactctttcctcgtggaagaggataagagagggagcaaatatccgatttttgccacaatgcaagaggaaaagtactatcatgagaaattccccaccatctaccatctgcggaaggaactggctgacaagaaagagaaggccgatctccgcctgatttaccttgctctggcccacatcattaaatttagaggacacttcctcatcgaggacgatcggtttgacgtccgcaacacagacattcagaagcagtatcaggcgttcctggaaatctttgataccacgttcgagaataacgaccttctgtcccaaaatgtggatgttgaagccatcctcaccgacaaaatttctaagagcgctaaaaaggatagaatcctggcccggtaccctaaccagaagtccacaggcatttttgctgagttcctgaaactcatcgtgggcaatcaggccgacttcaagaaacattttaacctggaagataagacaccccttcagttcgcgaaagacagctatgatgaggacctggagaatctcctggggcaaattggagatgaatttgccgaccttttctctgctgccaagaagctgtacgactccgtcctcctgagcggcatcctgaccgtgaccgatctctctacgaaagctcctctgtccgccagcatgatccagagatatgacgagcaccgcgaagatcttaagcagctgaaacagtttgttaaggcctctctccccgagaaataccaagaaattttcgctgactccagcaaggatgggtatgcgggatacatcgagggcaagacaaaccaggaggccttttacaaatatctgtccaaacttctgaccaaacaggaagggtctgagtacctcctggaaaagattaaaaatgaggacttcctgcggaagcaaagaacatttgataacggaagcatccctcaccaggtgcatctcaccgaactgcgcgctattatccggagacagtccgagtattacccgttccttaaggagaacctggaccgcatcgaaaagattctcacctttcggatcccctattacgtcggccctctggccagagaaaagagcgatttcgcctggatgacacgcaaaacggacgattctattcggccctggaattttgaagacctggtggataaggagaaatccgctgaggccttcatccacagaatgaccaacaatgacctttatctccctgaagagaaggtgctgcccaaacatagcctgatttacgaaaagttcacagtctacaacgagctcaccaaggttcgctttctggcggaaggcttcaaagactttcagttccttaatcggaagcaaaaagagacaatctttaactctctgttcaaggagaaaagaaaggtgaccgaaaaggatattatcagctttctcaataaagtggacgggtatgagggaatcgctattaagggcatcgaaaaacagttcaacgcctccctgtctacgtaccacgatctgaagaaaattcttgggaaggactttctcgataatacagacaacgagctgatcctggaagatattgtccagaccctcaccctgttcgaggaccgggagatgatccgcaagagacttgatatctataaagactttttcacagaaagccagctgaagaaactctaccggagacactataccggatggggccgcctgtccgccaagctgattaatgggatccggaacaaagagaatcaaaagacaattcttgattacctcatcgacgatggaagcgctaacagaaattttatgcagctgattaaggacgccggcctgtctttcaaaccgatcatcgacaaggctcgcacgggctcccatagcgataacctcaaagaagtggttggggagctggccggatctcctgcgattaagaaaggcatccttcagtccctgaagattgtggacgaactcgtcaaagtgatggggtatgagcccgagcagatcgttgtggaaatggccagagagaaccaaaccacagctaagggactgagccggctgcgccagagacttaccacactccgggaatccctggccaatctgaagtctaacattctcgaggagaaaaagcctaaatacgtcaaggatcaggtggaaaatcaccatctgagcgacgatcgccttttcctgtactatctccagaacggcaaagacatgtacaccgatgacgagctggatatcgacaatctgtcccaatatgatatcgaccttattatcccccaggcttttattaaggacgattctatcgacaacagagtcctggtgagctccgccaagaatcgggggaaaagcgatgacgttccctctgtggaaattgtcaaggattgcaaagtgttctggaagaaactcctggacgcgaagctcatgtcccagcgcaagtacgataacctgacgaaagccgagagaggcggacttaccagcgacgataaggctcggtttatccaacgccagctggttgaaacaagacagattaccaaacacgtggcccggatcctcgacgagagattcaataacgagctggattctaagggccgccggatcagaaaagtcaagattgtgacactgaagtccaatcttgtgagcaactttcgcaaagaatttgggttttataagatccgggaggttaataactaccatcacgctcacgacgcctatctgaatgccgtcgtggctaaagcgattctcaccaagtaccctcagctggaaccggagttcgtgtacggagattatcccaaatacaactcttataagacgagaaagagcgccacagaaaaactctttttctactccaacatcatgaatttcttcaagaccaaagtcacactggctgacggcaccgtggttgtgaaggacgatattgaggtcaacaatgacaccggggagatcgtgtgggataaaaagaaacatttcgccacagttcgcaaggtgcttagctatcctcaagtcaacatcgtgaagaaaacggaaattcagaccggaggcttttctaaggagtccatcctggcccacgggaatagcgacaaactcattccccggaagacaaaagatatctacctggaccctaagaagtatggcggattcgattcccccattgttgcttactctgtgctggtcgtggccgacatcaaaaagggcaaagcgcagaaacttaagaccgtgacagaactgctcgggatcaccattatggagagaagccgctttgaaaagaacccgtccgctttcctggagtctaagggatacctcaatatccgggatgacaaactgatgattcttcctaagtatagcctgtttgagctggaaaacggcagacggcgcctcctggcctccgccgatgagcttcagaaagggaatgaactggctctccccacgcaattcatgaagtttctgtacctcgcctctagatataacgagctgaaaggaaagcctgaggaaatcgagcagaagcaggagttcgtcgttcagcatgtgagctactttgacgatattcttcaaatcattaatgacttctccaaccgggtgatcctggcggacgctaatctggagaaaatcaacaagctctatcaggataataaagaaaacattcccgtcgacgagctggccaacaatatcattaacctttttacattcaccagcctgggcgcccctgctgcctttaagttcttcgataaaatcgtggaccgcaagagatacacctctacaaaagaggttctcaattccaccctgattcaccagagcatcacagggctctatgaaacgcggatcgatctgggcaaacttggagaggactga

SEQ ID NO: 4285 - RNA, 4113 nt, synthetic construct
  misc_feature 1..4113: note = Cas9 variant
  source 1..4113: mol_type = other RNA
atgaccaagaaaaactacagcatcggcctggacattgggacaaattccgtgggatgggccgtcatcacggatgactataaggttcccgctaaaaagatgaaagtgctcggcaacaccgataagaagtacattaaaaagaatctgcttggggcccttctcttcgactctggagagacagcggaagctaccagactgaaacggacagcccgcagacggtatacccgcagaaagaaccggcttcgctacctgcaggagatctttgccgaagagatgacaaaagtggatgagagcttcttttatagactcgacgagtccttcctgaccacggatgagaaggactttgaacggcaccctattttcggcaataaggctgaggaagatgcctaccatcaaaaatttccgaccatctatcatctgcgcaactacctcgctgactctagcgagaaggccgatctgagacttgtctacctggcgctcgcccacatgatcaaatatcgggggcacttcctgattgagggaaagctgaatgctgaaaacacagacgtgcagaaactgtttaccgatttcgttggcgtgtacgaccgcacatttgacgattcccatctctctgagatcaccgtcgacgtggccagcacgctgacagaaaagatttccaaaagcagacggctggagaatctcatcaagtattaccccaccgaaaagaaaaacacactgttcggcaatcttattgctctggccctcgggctgcagcctaactttaagatgaatttcaaactttctgaggatgcgaagctgcagttctccaaagacacctatgaggaagatctcgaggaactgctgggaaagatcggcgacgattacgccgacctctttaccagcgctaagaacctgtatgatgccattcttctgtctgggatcctcacagttgacgataattccacgaaagctcccctgagcgcctctatgatcaagcgctacgtggagcaccacgaagaccttgagaaactgaaggagttcattaaagccaacaagtccgaactctaccatgacatctttaaggataaaaacaagaatggatatgctggctacattgagaacggggtcaaacaagacgagttctataagtacctgaaaaataccctgagcaagatcgatggatccgactattttctcgataagattgagagagaagacttcctgcggaaacagagaacatttgataacggctctatccctcaccagatccatcttcaggagatgcacgcgattctgcgccggcaaggcgactactatcccttcctcaaggagaaacaggatagaatcgaaaagattctgacctttcgcatcccttactacgtggggccgctggtgcggaaagacagcagattcgcctgggctgagtatcgctccgatgaaaagattacaccctggaattttgacaaagtcatcgataaggaaaagagcgccgagaaattcatcacccggatgacgcttaacgacctctacctgcctgaagagaaggttctgcccaaacactctcatgtgtatgaaacatacgccgtgtataatgagctcaccaagattaaatacgtcaacgaacagggaaaggagtcctttttcgacagcaatatgaagcaggagatcttcgatcacgtgtttaaagaaaacagaaaggttaccaaagagaagctgcttaattatctgaacaaagagttccctgaataccgcattaaggacctcatcggcctggataaggaaaataaatcttttaacgctagcctggggacataccatgaccttaagaaaattctcgataaggccttcctggacgataaagtgaatgaggaggtcatcgaagacattatcaagaccctgacactctttgaggataaggacatgatccacgaacggctgcaaaaatattccgatattttcacggcgaaccagcttaagaaactggagagacgccattacaccggatggggccggctctcttataagctgatcaacgggattagaaataaagaaaacaataagacaatcctggactaccttattgatgacggaagcgctaaccggaattttatgcagctcatcaacgacgataccctgcccttcaaacaaatcattcagaagtcccaggtggttggcgacgtggatgacatcgaggccgtcgtgcacgatctgccgggcagccctgccattaagaaagggatcctccagtctgtcaagattgtggacgagctggttaaagtgatgggagataatcccgacaacatcgtcatcgaaatggctcgcgagaatcaaacaaccaacagaggccggtcccagagccagcagagacttaagaaactgcaatcttccctcaaggaactggggagcaatattctgaacgaggagaagccttcctatatcgaagataaagtggaaaattctcaccttcagaacgaccagctctttctgtactatattcagaatggaaaggatatgtacacgggcgacgaactggacatcgatcatctcagcgactacgatattgaccacatcatcccccaagccttcattaaagatgactccatcgataaccgcgttctgacctctagcgctaagaaccgggggaaatccgacgatgtgcccagccttgacattgtcagagcccgcaaggcggagtgggtgagactgtataagtctggcctcatctccaaacggaagtttgataatctgacaaaagccgaacgcggaggcctgaccgaggctgacaaggccgggttcattaaaagacagcttgtggagacacggcagatcaccaagcatgttgctcagattctggatgcccgctttaacacggaacacgacgagaatgacaaggtcatcagagatgtgaaagtgatcacactcaagagcaacctggtctctcaattccggaaagacttcgaattttacaaggtgcgcgagattaatgattatcaccatgcgcacgacgcctacctcaacgctgttgtgggaaccgccctgcttaaaaagtatcctaagctggcttccgagttcgtctacggcgaatataaaaagtacgatatcagaaaatttattacaaatagctctgacaaggccaccgccaaatacttcttttatagcaacctcatgaatttctttaagaccaaagtgaagtacgctgatgggacagttttcgagcggccgatcattgaaacgaacgcggacggagagatcgcctggaataagcagatcgattttgaaaaagtgcgcaaggtcctgtcctatccccaggtgaacattgttaaaaaggtggagacccaaacaggcgggttcagcaaagaatctatcctgcctaagggcgactccgataaacttattcccagaaagaccaagaaagtctactgggacacaaagaaatatggaggctttgatagccctaccgtggcttactccgtgttcgtcgttgccgacgtggagaaggggaaggccaaaaagctgaaaacggtgaaggagctcgtcggaatctctattatggaacggagcttctttgaggaaaatcccgtggagttcctggagaacaaaggctatcataatatcagagaagacaagctcatcaagctgccgaaatactccctttttgagttcgaagggggacgccggagactgctcgcttctgccagcgagctgcagaagggcaacgaaatggttctgcctgggtaccttgtggagctgctctatcacgcgcatcgcgctgataactttaattccacagagtacctgaactatgtctctgaacacaaaaaggagttcgaaaaagtgctcagctgcgttgaggactttgccaatctgtacgtggatgtcgaaaagaacctttccaaaattcgggccgtggctgacagcatggataatttctctatcgaggagatttccaacagctttatcaatctgctgaccctcaccgccctgggcgcgcccgctgacttcaactttcttggagaaaagattcctagaaagcgctatacatctaccaaagagtgtctgacagccacgctcatccaccagtccattaccggcctgtacgaaacacggatcgatctcagcaagctgggggaggaatga

SEQ ID NO: 4286 - RNA, 4113 nt, synthetic construct
  misc_feature 1..4113: note = Cas9 variant
  source 1..4113: mol_type = other RNA
atgaagaacgccaataaagtgaccggcaagtactatctggggttcgacatcggaacaaacagcgtcggctgggctgttacggatgagaattacaacctctgcaaatttaagaaaaagtccatgtgggggattagactgttcgaagacgccaagaccgcggaggaacggcgcggacagagagcttctcggcgcagacttcaacggcgcaaacagagaatcgatctgctccaggagatttttgccgaagagatcaataaggtggacgagacattctttattcggctgaacgaaagccgccttcacctggatgacaaaaccgtgtccgagaagcatcccctcttcatcggctctgaatatagcgagaaagagtactatagagaataccctacaatctttcatctgcggaaggagctgatggaatcctctgagccgcacgatattcgcctcgtctatctggccatccaccatattcttaagaatagagggcacttcctgatcgacggagaactcagcaaagctaactcctttgatgccgctttctaccagatgaaggaggtgctgtgtaatgagcttgacctggaaattgatggcgagaacaccacagaagttgagcggaccctccgcgacagaaatatcagcaaatctgataaggtgaaactgctggccgcgctcctggccatgaaccaaaatgaaacggagtccaaggagaccaaaaagaagattgaaaacatctgcaaacttctggctggcaataagggggacatcagcaaaatttttggacagacacccgagggcgtcgaaaagacctctttctcctttggggaggccgactacgatgaaagcatccggcctaacctcgaggagtctattcccgaccagtgtttcgtgatcgattccattaaagctctgtatgactggaacgttcttgccgatatcctgaatggacagacatacctcagctgcgcgaaggtgaaccaatatgaaacccacaagaataacctgaaagagctgaagctcctggtcaatagatactgttcccgcgaagagtataaacggttctttaagtctgccgtggagaaagctaactacagcaattatatcggctccgccaagcaggggaacaagattatcgacgtgaaaagatgcgctgaagaggatttctacaaggaacttaaaattctgctcagcaagatcgagcctgaagaggccgaccgcgagctgtacgaacggattaaaagagaggccgaagagggatctcttctgcccctccagcgcaataaggataactccgtcgttcctaatcagatgcataaggctgaactggcgctgatcctcgagaacgccggcagctatctgggctttcttaatgagaaagacgaagatgggctgtctccggctgagaagatcattgaactcttcagctttcggatcccctactatgtgggacctctgtccgacagacacaaagaccgcggctctaacgcctggattgtgcggaaggccgaggggagaatcctgccctggaatttcgatgaaaaagtcgaccgcgaaaagagcaacgaggcttttattgaacggatgacgaacaaatgtacataccttctcggaaaggatgtggttgccaaaaattccctgatctatagccatttcatggtgctgaacgagctcaataacctgtctgtctgcggcaataaaatttccgtgcaagttaagcaggacatctacagagaactttttcagcggcacaccaaagtgagcaagaaaatgctgctccaatattgtcgcgagaagatgatgaacaaggatctggaggaagaggacctgtctgggttcgatggagactttaaagcgaaactttccagctacctcgatttcgaaaagaaggtctttggcgctaaaatggaggaagacagaatccggaagattacagaggatatcattagatggaagaccatctacggcgacgatgggaaaatgctgcaggccgtggtcgagaaggaatatcctggagagctggactccgaccagctcaaagccgtgaagcagttccgctactctggctgggggaatttcagcgaagagtttctgaacggaattgttggcaccgaaaaacccacagggcaaatgttcacgatcatcgaggctctttggcagaccaattgcaacctgatgcagctcctgtccaagaattttacattcatggaggaaattgagaagcacaaccgggaactggccggccagatcaccgatatttcttatgacaaacttgtgaaggatctctacatcagcccggctaataaaagagccgtctggcaaacagtgcgcattgcggaggaagttaagaaaatcatgggatgtgagcctgccaagatctttgtggagatggctagaggcggggaaaaagagaagaagcggaccatttcccgcaaaaagaaactgctggaactctatgccgcttgcaagaaagacgccagagattggaaccgggagatcgaggaccgcgatgaaagagagttcaatagcgacaagctgtacctttattacacgcagatgggacggtgcatgtactctggcgaacgcattgatctgcatgagctcatgtccgcgaacagcaagtgggacatcgatcacatttatccccagtctaaagtcaaggacgattccctggacaacagagtgctgagccttaaaaagatcaataacgaaaaagggaataagcctctctctcgggacatccagcaaagccagcagaagtggtggacagagctgctgcagctcgagtttattaccaaaaagaaatacgatcgcctgatgcatagaggagaactttccgaggaggagctgagcggcttcatcaaccggcaactcgtggaaaccagacagtctacaaaggccgctgccgagctgctggggcgcatgtataataactccaaagttgtctacgtgaaggctccccttgtgagccagtttcggaaggacgatctgaatattctcaaatccagactggccaacgactatcaccatgccaaggatgcttacctcaatatcgcggtcggcaacgtgtataatgagaaattcaccgacaaccccctgcgctggattgaaaagcacgccggagagaattactctatcaaccgggtttttgattacgacattgtggctggcgatggggcccctgtctgggccgctccgcttagagacgaaaagaataagctgcgcaagaacgaggtgggagaaaaatatggcgggacaatcgatgttatccggaagacggtgaaaagaaacgacgtcctctacaccgagcacacatattgtggaaagggcgagctgttcaatgccaccattgcgaaaaaggacgggggcgctgaaatccccctgaaagccggacttcaaacaggcaagtacgggggatataagagccctaacacctcctactttgccgctattgagttcgatggcaaaaagggggaacgcgtgaaaaatatcatggaggttcccgtgtatattgccaacatcctgctccatgacatcgatgcgtacattcggtactgcgagacggtcaagggactgaaaaatgtgaagatcctcagaccttgtattaagaaaaacgctctgatctctgtggacggctatcccatgcggattcgcggggccaatgaaaagaacatccttctgaaaaataacctccagccgatcttcggcagacacgaggaaaccgtccggcgcattgagaagtacgttgagaaaaatcaggaatttgaggtggatgaaaagttcgacggactgaacgaggccaatctgacagatctttatgacgatatcaccgaaaagctgtgcggcccttacgtggagagacccagcaaccagggggaatatctcatggagaatcgggagaaatttctgaacatttccctcaaggaaaaagctaagctgcttgcccaaatgatcaaactggtcagatgtgacacagagaccaaggctgatctgcgctctattggagccagcaagaatgcgggcgtgatctccgttaacaaaaacacgctcgggggaaagcggctgattcttatcaatcagagcgtgacaggcctgttcgaaaacagaatcgagctctga

SEQ ID NO: 4287 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctatcattacagatgactataaagtccctgccaagaaaatgagagttctcggcaacacggataaggagtacatcaaaaagaatctgattggggctctgctgttcgacggaggcaacaccgccgcggatcggcgcctcaagagaacagctcggcgcagatatacccggcgcagaaatcggatcctgtaccttcaggaaatctttgccgaggaaatgagcaaagtggacgattccttctttcaccgcctggaggactctttcctcgtggaagaggataagagagggagcaaatatccgatttttgccacaatgcaagaggaaaagtactatcatgagaaattccccaccatctaccatctgcggaaggaactggctgacaagaaagagaaggccgatctccgcctgatttaccttgctctggcccacatcattaaatttagaggacacttcctcatcgaggacgatcggtttgacgtccgcaacacagacattcagaagcagtatcaggcgttcctggaaatctttgataccacgttcgagaataacgaccttctgtcccaaaatgtggatgttgaagccatcctcaccgacaaaatttctaagagcgctaaaaaggatagaatcctggcccggtaccctaaccagaagtccacaggcatttttgctgagttcctgaaactcatcgtgggcaatcaggccgacttcaagaaacattttaacctggaagataagacaccccttcagttcgcgaaagacagctatgatgaggacctggagaatctcctggggcaaattggagatgaatttgccgaccttttctctgctgccaagaagctgtacgactccgtcctcctgagcggcatcctgaccgtgaccgatctctctacgaaagctcctctgtccgccagcatgatccagagatatgacgagcaccgcgaagatcttaagcagctgaaacagtttgttaaggcctctctccccgagaaataccaagaaattttcgctgactccagcaaggatgggtatgcgggatacatcgagggcaagacaaaccaggaggccttttacaaatatctgtccaaacttctgaccaaacaggaagggtctgagtacctcctggaaaagattaaaaatgaggacttcctgcggaagcaaagaacatttgataacggaagcatccctcaccaggtgcatctcaccgaactgcgcgctattatccggagacagtccgagtattacccgttccttaaggagaacctggaccgcatcgaaaagattctcacctttcggatcccctattacgtcggccctctggccagagaaaagagcgatttcgcctggatgacacgcaaaacggacgattctattcggccctggaattttgaagacctggtggataaggagaaatccgctgaggccttcatccacagaatgaccaacaatgacctttatctccctgaagagaaggtgctgcccaaacatagcctgatttacgaaaagttcacagtctacaacgagctcaccaaggttcgctttctggcggaaggcttcaaagactttcagttccttaatcggaagcaaaaagagacaatctttaactctctgttcaaggagaaaagaaaggtgaccgaaaaggatattatcagctttctcaataaagtggacgggtatgagggaatcgctattaagggcatcgaaaaacagttcaacgcctccctgtctacgtaccacgatctgaagaaaattcttgggaaggactttctcgataatacagacaacgagctgatcctggaagatattgtccagaccctcaccctgttcgaggaccgggagatgatccgcaagagacttgatatctataaagactttttcacagaaagccagctgaagaaactctaccggagacactataccggatggggccgcctgtccgccaagctgattaatgggatccggaacaaagagaatcaaaagacaattcttgattacctcatcgacgatggaagcgctaacagaaattttatgcagctgattaaggacgccggcctgtctttcaaaccgatcatcgacaaggctcgcacgggctcccatagcgataacctcaaagaagtggttggggagctggccggatctcctgcgattaagaaaggcatccttcagtccctgaagattgtggacgaactcgtcaaagtgatggggtatgagcccgagcagatcgttgtggaaatggccagagagaaccaaaccacagctaagggactgagccggtcccgccagagactgaccacacttcgggaatctctcgccaatcttaagagcaacattctggaggagaaaaagcctaaatacgtcaaggatcaggtggaaaatcaccatctctccgacgatcgcctgttcctttactatctgcagaacggcaaagacatgtacaccgatgacgagctcgatatcgacaatctgtctcaatatgatatcgaccacattatcccccaggcttttattaaggacgatagcatcgacaacagagtcctggtgtccagcgccaagaatcgggggaaatctgatgacgttccctccgtggaaattgtcaaggattgcaaagtgttctggaagaaacttctggacgcgaagctcatgagccagcgcaagtacgataacctgacgaaagccgagagaggcggactcacctctgacgataaggctcggtttatccaacgccagctggttgaaacaagacagattaccaaacatgtggcccggatccttgacgagagattcaataacgagctggattccaagggccgccggatcagaaaagtcaagattgtgacactcaagagcaatctggtgtctaactttcgcaaagaatttgggttttataagatccgggaggttaataactaccaccacgctcatgacgcctatctgaatgccgtcgtggctaaagcgattcttaccaagtaccctcagctggaaccggagttcgtgtacggagattatcccaaatacaacagctataagacgagaaagtccgccacagaaaaactctttttctacagcaacatcatgaatttcttcaagaccaaagtcacactggctgacggcaccgtggttgtgaaggacgatattgaggtcaacaatgacaccggggagatcgtgtgggataaaaagaaacacttcgccacagttcgcaaggtgctctcttatcctcaagtcaacatcgtgaagaaaacggaaattcagaccggaggcttttccaaggagagcatcctggcccatggcaattccgacaaacttattccccggaagacaaaagatatctacctggaccctaagaagtatgggggattcgattctcccattgttgcttacagcgtgctcgtcgtggccgacatcaaaaagggcaaagcgcagaagctgaaaaccgtgacagaactgcttgggatcaccattatggagagatcccgctttgaaaagaacccgtctgctttcctggagagcaagggatacctcaatatccgggatgacaaactgatgattctccctaagtattccctgtttgagcttgaaaacggcagacggcgcctgctggcctctgccggggagctccagaaaggaaatgaactggcccttcccacgcaattcatgaagtttctgtacctcgctagcagatataacgagctgaaaggcaagcctgaggaaatcgagcagaagcaggagttcgtcgttcagcacgtgtcctactttgatgacattctccaaatcattaatgatttcagcaaccgggtgatcctggcggacgctaatcttgagaaaatcaacaagctgtatcaggacaataaagaaaacattcccgtcgatgagctggccaacaatatcattaacctctttacattcacctctctgggggcccctgctgcctttaagttcttcgacaaaatcgtggatcgcaagagatacacctccacaaaagaggttcttaatagcaccctgattcaccagtctatcacaggcctctatgaaacgcggatcgacctgggaaagctcggcgaggattga

SEQ ID NO: 4288 - RNA, 4113 nt, synthetic construct
  misc_feature 1..4113: note = Cas9 variant
  source 1..4113: mol_type = other RNA
atgaccaagatcaaagacgattacattgtgggcctggacatcgggacagatagctgcggatgggtcgccatgaactccaataacgacattctcaagctgcagggcaaaacggctatcgggtctagacttttcgagggaggcaagagcgccgcggaacggcgcctgtttagaaccacacaccggcgcattaaaagacggcgctggagactcaagctgcttgaggagttctttgatccctatatggctgaggttgacccttacttctttgcccggctgaaggaatccgggctctctccgctggataaacgcaagaccgtgagctccatcgtgttccccacatctgccgaggacaaaaagttttatgatgactaccctaccatctatcatctgagatacaaactcatgacagaggatgaaaagttcgacctgcgggaggtctatcttgctattcaccatatcattaagtaccgcggaaattttctgtacaacaccagcgtgaaagatttcaaggcctccaaaatcgacgttaagagctctattgaaaaactcaatgagctgtatgagaaccttggcctggacctcaatgtggaatttaacatctccaatacggctgagattgaaaaggtcctgaaagataagcaaatcttcaagagagacaaagtgaagaaaatcgccgagctgtttgcgattaagaccgataacaaagaacagagcaagcggatcaaggacatttctaaacaggttgccaatgctgtgctcggctacaagacacgcttcgataccatcgccctgaaagagatttccaaggacgagcttagcgattggaacttcaaactgtctgacatcgatgctgactccaagtttgaagccctcatggggaatctggatgagaacgaacaggcgatccttctgacaattaaggaactcttcaatgaagtcaccctgaacggaatcgtggaggacggcaacacgctgagcgagtccatgattaataaatataacgaccacagagatgacctcaagctgcttaaagaagtgatcgagaatcatattgatcggaagaaagccaaggaactggctctcgcctacgacctgtatgtcaacaatagacacgggcgccttctgcaagctaagaaaaagctcggaaaaatcaagccccggtctaaagaggatttttacaaggttgtgaacaaaaatctggacgatagcagagcctccaaggaaatcaagaaaaagattgagctggacagcttcatgcctaaacagcgcacaaacgccaatggcgtgatcccctatcagctccagcaactggagcttgataagattatcgaaaaccagtctaaatactacccttttctgaaggagattaatccggtctccagccacctcaaggaagctccctataaactggacgagctgatccggttcagagtgccttactatgttgggccccttatttctcctaacgagagcaccaaggatatccagaccaaaaagaatcagaactttgcgtggatgatccgcaaagaagagggacggattacaccctggaatttcgaccaaaaggtggatagaatcgaatccgccaacaagtttattaaacgcatgaccacaaaggacacgtacctcttcggcgaggacgtcctgccggctaactctctgctctatcagaaatttaccgtgctgaatgaacttaacaatatccggattaacggcaagagaatcagcgttgatctgaaacaggagatctacgagaatctcttcaagaagcatacaaccgtgacagtcaaaaagctggaaaactatctgaaagagaatcacaaccttgtgaaggtcgaaattaaagggctcgccgacgagaagaaatttaattccggactgaccacgtacaaccgcttcaagaatctgaacatcttcgataatcaaattgacgatctcaagtaccggaacgactttgagaaaatcattgagtggagcacaatcttcgaggataagtctatctataaagaaaagctgagatccattgactggcttaatgagaaacagatcaacgccctgagcaacattcggctccagggctgggggcgcctgtctaagaagctgcttgctcagctccatgatcacaatggacaaaccatcattgaacagctgtgggactcccagaacaattttatgcagatcgtgacccaagccgatttcaaagacgcgatcgctaaggccaaccagaatctgctcgttgccacaagcgtggaggatattctgaacaatgcttacacctcccctgccaacaaaaaggctatcagacaggtcattaaagtggttgacgacatcgtgaaggccgcgtctggcaaggtccccaaacagattgccatcgaatttacacgggatgctgacgagaatcctaagagaagccaaacgcgcgggtccaaacttcagaaggtgtataaagatctgtctaccgagctcgccagcaagacaattgctgaagaactgaacgaagccatcaaggacaaaaagctggtgcaggataaatactatctttacttcatgcagctcggacgggacgcgtataccggcgagcccatcaatattgatgagatccaaaagtacgacattgatcacatcctgccccagtcctttattaaagacgatgccctggacaacagagttctcgtcagccgcgctgtgaataacggcaagtctgacaatgtgcctgtcaagctgttcgggaacgaaatggccgctaaccttggaatgacaatcagaaaaatgtgggaggaatggaagaatatcggcctgatttccaaaaccaagtacaacaatctcctgacggatccggaccatatcaacaaatataagagcgccgggtttattcggcgccagctggtggagacctctcaaatcattaaacttgtttccacaatcctgcagagcagataccccaataccgaaatcattacagtgaaggccaagtataaccactacctccgggagaaattcgatctgtataagtctcgcgaggtcaatgactaccatcacgctatcgatgcgtatctcagcgccatttgtggaaacctgctttaccagaattaccctaacctgagaccctttttcgtgtatggccagtacaaaaagttttccagcgaccctgataaagaaaaggagatcttcaataagacccggaaattctcttttatttcccaaatcctcaagaacaaaagcgaaaattccaaggagattgctgaaaaactgaagcgcgcctatcagttcaagtacatgctggtttctagagagacggagacaaaagaccaggaaatgtttaagatgaccgtgttcccccgggagacaccggggaaccttatccctaaaaagaaaggcatggcccccgaaatctatggaggctacaccaagaatagcgatgcttatatggtcattgtgaagatcgacaaaaagaaagagaccgaataccgcattctggggatccctacaagagagctcgttaacctgaagaaagccgagaaggaagatcattacgagtcctatctcaaagaaattctggcgccccggatcctttacaataagaacggaaagagagacaaaaagatcacgtcttttgagattgtgaaaagcaagatcccttataaacaggtcattcaagatggcgacaagaagttcatgctggggtcctctacctacgtgtataacgctaaacagctcacactgagcaccgagtccatgaaggccatcacaaataactttgacaaagatagcgacgaaaatgatgccctgattaaggcttacgacgagatccttgataaagtggacaagtatctgcccctcttcgatatcaacgcctttcgcaagaaactgcactctggacgggaaaagttcgtcgagctctccctggaagacaaaaaggatattatccttaaagttctgattggcctgcacgacaatccggcgaccagcgatctcaagacgctggggttttcttccacagagcttggcaagatgcagaaaaacagcggaatcgtgctgtctggcaatgctaagctcatttaccagtcccctaccgggctgttcaaaaagagcgtgaaaatctccgacctctga

SEQ ID NO: 4289 - RNA, 4113 nt, synthetic construct
  misc_feature 1..4113: note = Cas9 variant
  source 1..4113: mol_type = other RNA
atgaccaagatcaaagacgattacattgtgggcctggacatcgggacagatagctgcggatgggtcgccatgaactccgacaatgatattctcaagctgcagggcaaaacggctatcgggtctcaccttttcgaggccggaaagagcgcggctgacagacggctgtttcgcaccacacatagacggattaaacgcagacggtggcgcctcaagctgcttgaagagttctttgatccctatatggccaaggttgacccttacttctttgccagactgaaagaatccggcctctctccgctggataagcggaaaaacgtgttcagcatcgtgtttcccaccgctgccgaggacaagaaattctatgatgactaccctacaatctatcacctccgctacaagctcatgaccgaagatgagaagtttgacctgagagaggtctatcttgctattcatcacatcattaaataccgggggaatttcctgtacaacacatccgtgaaggactttaaagcctctaagatcgatgttaaaagctccattgaaaagctcaatgagctgtatgaaaaccttggactggacctcaatgtggagttcaacatcagcaataccgcggagattgaaaaagtcctgaaggataagcaaatctttaaacgcgacaaggtgaaaaagatcgccgagctgttcgctattaaaacggataacaaggaacagtctaagagaatcaaagacatttccaagcaggttgccaatgctgtgctcggctacaaaacccggttcgatacaatcgccctgaaggaggtcagcaaagacgaactttctgattggaactttaagctgtccgacattgatgcggacagcaagttcgaggccctcatgggcaatctggacgagaacgaacaggctatccttctgaccatcaaagagctctttaatgccgtgacactgaacgggattgtggaagatggaaacaccctgtctgagtccatgatcaataagtataacgaccatcgcgatgacctcaaactgcttaaggaagtcattgagaatcacatcgatagaaagaaggctgttaagctggccctcgcctacgacctgtatgtgaacaatcggcacggccaacttattcaggctaaaaagaaactggggaagatcaaacccggaagcaaggaggatttctacaaagtggtcaacaagaatctcgacgattcccaggcgtctaaggaaatcaaaaagaaaattgagctggacagctttatgcctaagcagagaacgaacgccaatggcgtgatcccctatcaactgcatcagctcgaactggataaaattatcgagaaccagtccaagtactaccctttccttaaggaaattaatccggttagctctcacctgaaagaggctccctataagctcgacgagctgatccgctttcgggtgccttactatgtcgggcccctgatttcccctaacgaaagcacaaaagatatccagaccaagaaaaatcaaaacttcgcctggatgatcagaaaggaggaaggacgcattacaccctggaattttgaccagaaggtggaccggatcgagtctgccaacaaattcattaagagaatgaccaccaaagatacatacctttttggcgagaacgttctcccggctaatagcctgctgtatcagaagttcacggtgctcaacgaactgaataacatccgcattaatggcaaacggatctccgtcgaccttaagcaagagatctacgaaaacctgtttaagaaacataccacagtgaccgtcaagaaactcgagaattatctgaagcagaaccacaatctggtgaaagttgaaattaaggggcttgccgatgagaaaaagttcaactctggactcacaacctacaatagattcaagaacctgaatatctttgacaaccagattgatgacctgaaataccgcaaggatttcgagaaaatcattgaatggagcacgatctttgaggacaagtccatctataaagaaaagctccggagcattgattggctgaatgagaagcagatcaacgcgctttctaacattagactgcaaggctgggggcgcctctccaaaaagctgctggctcagcttcacgaccataatggacagacaatcattgaacagctctgggatagccaaaacaatttcatgcagatcgtgacccaggccgactttaaagatgccatcgctaaggccaaccagaatctgctggtcgctacctctgtggaggacattctcaacgacgcctacacatcccctgcgaataaaaaggccatccggcaagttattaaggtggtcgatgacatcgtgaaagctgccagcggcaaggtgcccaaacagattgctatcgagttcaccagagatgccgacgataaccctaagcggtcccagacacgcgggtctaaactgcagaaggtttataaggaccttagcacggaactggcgtccaaagccattgctgaggaactcaatgaggccatcaaggataaaaagctggtccaagacaaatactatctgtactttatgcagcttggaagagatgcttataccggcgaacccatcaacattgacgagatccagaagtacgatattgaccacatcctcccccaatctttcattaaggacgatgccctggacaatcgggtgctggtgagcaaagccgtcaacaatgataagtccgacaacgtgcctgttaaactctttggcaatgagatggctgggaacctgggaatcacaatcagaaagatgtgggaagagtggaaaaacattggccttatcagcaagaccaaatacaataacctgctcacagatccggaccatattaataagtatgaatctgcggggttcatccgccggcagctggtggagacctcccagattatcaagctggtcagcacgatccttcagtctagataccccaacaccgagattatcacagtgaaagccaagtataatcactacctgcgcgaaaaatttgatctctataagtccagagaggttaacgactaccatcacgctattgatgcctatctgagcgccatctgtggaaatctcctgtaccaaaactaccctaatcttcggcccttctttgtgtatggccagtacaaaaagttctctagcgaccctgataaggaaaaagagattttcaacaagacccgcaaattttccttcatcagccagattctgaagaataaatctgaaaactccaaggagatcgctgagaagctcaaaagagcctatcagtttaagtacatgctggtcagccgggaaacagagaccaaagaccaagaaatgttcaagatgacggtgtttccccgcgagacaccggggaatctgatccctaaaaagaagggcatggcgaccgaaatttatggaggctacaccaaaaactccgatgcttatatggttatcgtgaagattgacaaaaagaaagagacagagtacagaatccttgggattcccacccgggaactggtcaatctcaagaaagccgagaaggaagaccactacgagtcttatctgaaggaaatcctcgcccctcgcatcctgtacaacaaaaatggaaagagagataaaaagattacgagcttcgagatcgtgaaatccaagattccctataaacaggtgatccaggacggcgataaaaagtttatgcttgggtctagcacatacgtctataacgctaaacagctgaccctctccacagagtctatgaaggccattaccaacaatttcgacaaagatagcgacgaaaacgatgcgctgatcaaggcttacgacgagatcctggataaggttgacaaatatcttcctctgtttgatattaatgccttccggaagaaactccattccggacgcgaaaagtttgtggagctgagcctcgaggacaaaaaggatatcattctgaaggtgcttatcggcctgcacgacaaccccgccacatctgacctgaaaaccctcgggttctccagcacggaactgggcaagatgcagaaaaattctggaattgtcctttccggcaacgctaagctgatctaccaaagcccgacagggctgttcaaaaagtctgtgaaaatttccgatctgtga

SEQ ID NO: 4290 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctatcattacagatgactataaagtccctgccaagaaaatgagagttctcggcaacacggataaggagtacatcaaaaagaatctgattggggctctgctgttcgacggaggcaacaccgccgcggatcggcgcctcaagagaacagctcggcgcagatatacccggcgcagaaatcggatcctgtaccttcaggaaatctttgccgaggaaatgagcaaagtggacgattccttctttcaccgcctggaggactctttcctcgtggaagaggataagagagggagcaaatatccgatttttgccacaatgcaagaggaaaagtactatcatgagaaattccccaccatctaccatctgcggaaggaactggctgacaagaaagagaaggccgatctccgcctgatttaccttgctctggcccacatcattaaatttagaggacacttcctcatcgaggacgatcggtttgacgtccgcaacacagacattcagaagcagtatcaggcgttcctggaaatctttgataccacgttcgagaataacgaccttctgtcccaaaatgtggatgttgaagccatcctcaccgacaaaatttctaagagcgctaaaaaggatagaatcctggcccggtaccctaaccagaagtccacaggcatttttgctgagttcctgaaactcatcgtgggcaatcaggccgacttcaagaaacattttaacctggaagataagacaccccttcagttcgcgaaagacagctatgatgaggacctggagaatctcctggggcaaattggagatgaatttgccgaccttttctctgctgccaagaagctgtacgactccgtcctcctgagcggcatcctgaccgtgaccgatctctctacgaaagctcctctgtccgccagcatgatccagagatatgacgagcaccgcgaagatcttaagcagctgaaacagtttgttaaggcctctctccccgagaaataccaagaaattttcgctgactccagcaaggatgggtatgcgggatacatcgagggcaagacaaaccaggaggccttttacaaatatctgtccaaacttctgaccaaacaggaagggtctgagtacctcctggaaaagattaaaaatgaggacttcctgcggaagcaaagaacatttgataacggaagcatccctcaccaggtgcatctcaccgaactgcgcgctattatccggagacagtccgagtattacccgttccttaaggagaacctggaccgcatcgaaaagattctcacctttcggatcccctattacgtcggccctctggccagagaaaagagcgatttcgcctggatgacacgcaaaacggacgattctattcggccctggaattttgaagacctggtggataaggagaaatccgctgaggccttcatccacagaatgaccaacaatgacctttatctccctgaagagaaggtgctgcccaaacatagcctgatttacgaaaagttcacagtctacaacgagctcaccaaggttcgctttctggcggaaggcttcaaagactttcagttccttaatcggaagcaaaaagagacaatctttaactctctgttcaaggagaaaagaaaggtgaccgaaaaggatattatcagctttctcaataaagtggacgggtatgagggaatcgctattaagggcatcgaaaaacagttcaacgcctccctgtctacgtaccacgatctgaagaaaattcttgggaaggactttctcgataatacagacaacgagctgatcctggaagatattgtccagaccctcaccctgttcgaggaccgggagatgatccgcaagagacttgatatctataaagactttttcacagaaagccagctgaagaaactctaccggagacactataccggatggggccgcctgtccgccaagctgattaatgggatccggaacaaagagaatcaaaagacaattcttgattacctcatcgacgatggaagcgctaacagaaattttatgcagctgattaaggacgccggcctgtctttcaaaccgatcatcgacaaggctcgcacgggctcccatagcgataacctcaaagaagtggttggggagctggccggatctcctgcgattaagaaaggcatccttcagtccctgaagattgtggacgaactcgtcaaagtgatggggtatgagcccgagcagatcgttgtggaaatggccagagagaaccaaaccacagctaagggactgagccggtcccgccagagactgaccacacttcgggaatctctcgccaatcttaagagcaacattctggaggagaaaaagcctaaatacgtcaaggatcaggtggaaaatcaccatctctccgacgatcgcctgttcctttactatctgcagaacggcaaagacatgtacaccgatgacgagctcgatatcgacaatctgtctcaatatgatatcgaccacattatcccccaggcttttattaaggacgatagcatcgacaacagagtcctggtgtccagcgccaagaatcgggggaaatctgatgacgttccctccgtggaaattgtcaaggattgcaaagtgttctggaagaaacttctggacgcgaagctcatgagccagcgcaagtacgataacctgacgaaagccgagagaggcggactcacctctgacgataaggctcggtttatccaacgccagctggttgaaacaagacagattaccaaacatgtggcccggatccttgacgagagattcaataacgagctggattccaagggccgccggatcagaaaagtcaagattgtgacactcaagagcaatctggtgtctaactttcgcaaagaatttgggttttataagatccgggaggttaataactaccaccacgctcatgacgcctatctgaatgccgtcgtggctaaagcgattcttaccaagtaccctcagctggaaccggagttcgtgtacggagattatcccaaatacaacagctataagacgagaaagtccgccacagaaaaactctttttctacagcaacatcatgaatttcttcaagaccaaagtcacactggctgacggcaccgtggttgtgaaggacgatattgaggtcaacaatgacaccggggagatcgtgtgggataaaaagaaacacttcgccacagttcgcaaggtgctctcttatcctcaagtcaacatcgtgaagaaaacggaaattcagaccggaggcttttccaaggagagcatcctggcccatggcaattccgacaaacttattccccggaagacaaaagatatctacctggaccctaagaagtatgggggattcgattctcccaaagttgcttacagcgtgctcgtcgtggccgacattaagaaaggcaaggcgcagaaactgaagaccgtgacagaactgcttgggatcaccatcatggagagatcccgctttgaaaagaacccgtctgctttcctggagagcaaaggatacctcaatattcgggatgacaagctgatgatcctccctaaatattccctgtttgagcttgaaaacggcagacggcgcctgctggcctctgccggggagctccagaagggaaatgaactggcccttcccacgcaattcatgaaatttctgtacctcgctagcagatataacgagctgaagggcaagcctgaggaaattgagcagaaacaggagttcgtcgttcagcacgtgtcctactttgatgacatcctccaaattatcaatgatttcagcaaccgggtgattctggcggacgctaatcttgagaagatcaacaaactgtatcaggacaataaggaaaacatccccgtcgatgagctggccaacaatattatcaacctctttacattcacctctctgggggcccctgctgcctttaaattcttcgacaagattgtggatcgcaaaagatacacctccacaaaggaggttcttaatagcaccctgatccacaagtctattacaggcctctatgaaacgcggatcgacctgggaaaactcggcgaggattga

SEQ ID NO: 4291 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctatcattacagatgactataaagtccctgccaagaaaatgagagttctcggcaacacggataaggagtacatcaaaaagaatctgattggggcccttctgttcgacggaggcaacaccgccgcggatcggcgcctcaagagaacagctcggcgcagatatacccggcgcagaaatcggatcctgtaccttcaggaaatctttgccgaggaaatgagcaaagtggacgattccttctttcaccgcctggaggactctttcctcgtggaagaggataagagagggagcaaatatccgatttttgccacactgcaagaggaaaaggactaccatgagaaattctccaccatctatcatctgcggaaggaactcgctgataagaaagagaaggccgacctgcgccttatttacatcgctctggcccacattatcaaatttagaggacacttcctcattgaggatgactcttttgacgtccggaacacagatatcagcaagcagtaccaggacttcctggaaatctttaataccacgttcgagaacaatgatcttctgtcccagaacgtggacgttgaagcgattctcaccgataaaatcagcaagtctgccaaaaaggaccgcattctggctcaatatcccaatcagaagtccacaggcatctttgccgagttcctgaaactcattgtgggcaaccaggctgatttcaagaaatactttaatctggaagacaagacccctcttcagttcgccaaagatagctatgacgaggatctggagaacctcctggggcaaatcggagacgaatttgcggaccttttctctgccgctaagaagctgtacgattccgtcctcctgagcggcatcctgacagtgattgacctctctaccaaagctcccctgtccgctagcatgatccagagatatgatgagcatcgggaagaccttaagcagctgaaacagtttgttaaggcctccctccctgagaaataccaagaaattttcgccgattctagcaaggacgggtatgctggatacatcgagggcaagacgaatcaggaggcgttttacaaatatctgtccaaacttctgacaaagcaggaagatagcgagaacttcctcgaaaagattaaaaacgaggactttctgagaaagcaacgcaccttcgataatgggtctatcccccaccaggtgcacctgacagaactcaaggccatcattcggagacagtccgagtactatccttttctgaaagagaaccaggaccgcatcgaaaagattcttaccttccggatcccgtactatattggacccctggctagagagaaaagcgattttgcctggatgacccgcaagacagacgattctatccggccttggaatttcgaagacctcgtcgacaaagaaaagagcgccgaggctttcattcatagaatgacgaacaatgatttttacctgcccgaagagaaagtgctgcctaagcactcccttatctatgaaaagttcaccgtgtacaacgagctcacaaaagtccgctacaagaatgaacaaggcgagacctatttcttcgactctaacatcaaacaggagatttttgatggcgttttcaaggaacatcggaaagtgagcaagaagaaactgctggactttctcgccaaggagtacgaagagttcagaatcgtggatgtcattgggctggacaaagaaaataaggcgtttaacgcttcccttggaacatatcacgatctggagaaaatcctcgacaaggatttcctggacaatcccgataacgagagcattctggaagacatcgtgcagacccttacgctctttgaggatcgcgaaatgatcaagaaacggctggagaattacaaggacctgttcacagaatctcagctcaaaaagctgtatagacggcactacaccggctgggggcgcctttccgccaaactgattaacggaatcagagacaaggagagccaaaagaccattctcgattatctgatcgacgatggccggtctaatagaaactttatgcagctgattaacgacgatgggctttccttcaaaagcatcatctccaaggcccaggctggatctcatagcgacaatctcaaagaggttgtgggcgaactggccggctccccggctattaagaaagggatcctgcagtctctcaagattgtcgatgagctggtgaaagttatgggatacgaacctgagcaaatcgtggtcgagatggcccgcgaaaaccagacaaccaatcagggccggagaaacagccgccagagatacaaacttctggacgatggggtgaagaatctcgcgtccgacctgaacggaaatattctgaaggagtatcccacagataaccaagcccttcagaatgaacgcctcttcctgtactatctgcagaacggccgggacatgtacacgggggaggctctcgacatcgataatctgagccaatatgacatcgatcacattatccctcaggcctttattaaggacgattctatcgacaacagagtccttgtgtccagcgctaaaaatcggggcaagtctgatgacgttccctccctggaaattgtgaaagattgcaaggtcttctggaagaaactcctggacgccaagctgatgagccagcgcaaatacgataaccttaccaaggcggagagaggaggcctgacatctgacgataaagcccggtttatccagcgccaactcgtggagaccagacagattacaaagcatgttgctcggatcctggacgaacgcttcaataacgagctcgacagcaaggggagacggatcagaaaagtgaagattgtcaccctgaaatccaaccttgtgagcaattttcgcaaggaatttggattttataaaatccgggaggtgaacaattaccaccatgcccacgatgcttacctgaacgccgttgtcgccaaggctattctcacgaagtatccccagctggaacctgagttcgtgtacggcgactatccgaaatacaattcttataagaccagaaaatccgcgacagagaagctgtttttctacagcaacatcatgaactttttcaaaaccaaggtgacacttgccgatgggaccgtcgtggttaaggacgatattgaagtgaataatgacacgggagagatcgtctgggataaaaagaaacacttcgctacagtgcgcaaggttctgtcctatccccagaacaatatcgtgaaaaagaccgaaattcaaacaggcgggttttctaaagagagcatcctcgcccatggcaactccgacaagctgattcctcggaagaccaaagatatctacctcgaccccaagaaatacggaggcttcgattctcctattgtcgcctatagcgtgctggttgtggctgacatcaagaaagggaaggcccagaaacttaagaccgtcacagaactgctcggaatcacgattatggagagatcccgctttgagaagaatccctctgcgttcctggaaagcaaaggctacctgaacatccgggctgataaacttattatcctgccgaagtattccctctttgagctggaaaatgggagacgccggctcctggccagcgccggagagcttcagaagggcaacgagctggctctgcctacccagttcatgaagtttctctacctggcctctagatataacgaatccaaagggaagcccgaggaaattgagaaaaagcaagagttcgtgaatcagcacgtgagctactttgacgacatccttcagctgattaacgatttctctaaacgggtcatcctcgcggacgctaatctggagaagatcaacaagctctatcaagataataaagagaacatttccgttgacgaactggccaataacatcattaatctttttacattcaccagcctgggcgcccctgctgcctttaagttcttcgataaaatcgtggaccgcaagagatacacatctaccaaagaggtgctgaactccacgctcattcatcagagcatcacaggactgtacgaaacccggatcgatcttggcaagctgggggaggactga

SEQ ID NO: 4292 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctatcattacagatgactataaagtccctgccaagaaaatgagagttctcggcaacacggataaggagtacatcaaaaagaatctgattggggcccttctgttcgacggaggcaacaccgccgcggatcggcgcctcaagagaacagctcggcgcagatatacccggcgcagaaatcggatcctgtaccttcaggaaatctttgccgaggaaatgagcaaagtggacgattccttctttcaccgcctggaggactctttcctcgtggaagaggataagagagggagcaaatatccgatttttgccacactgcaagaggaaaaggactaccatgagaaattctccaccatctatcatctgcggaaggaactcgctgataagaaagagaaggccgacctgcgccttatttacatcgctctggcccacattatcaaatttagaggacacttcctcattgaggatgactcttttgacgtccggaacacagatatcagcaagcagtaccaggacttcctggaaatctttaataccacgttcgagaacaatgatcttctgtcccagaacgtggacgttgaagcgattctcaccgataaaatcagcaagtctgccaaaaaggaccgcattctggctcaatatcccaatcagaagtccacaggcatctttgccgagttcctgaaactcattgtgggcaaccaggctgatttcaagaaatactttaatctggaagacaagacccctcttcagttcgccaaagatagctatgacgaggatctggagaacctcctggggcaaatcggagacgaatttgcggaccttttctctgccgctaagaagctgtacgattccgtcctcctgagcggcatcctgacagtgattgacctctctaccaaagctcccctgtccgctagcatgatccagagatatgatgagcatcgggaagaccttaagcagctgaaacagtttgttaaggcctccctccctgagaaataccaagaaattttcgccgattctagcaaggacgggtatgctggatacatcgagggcaagacgaatcaggaggcgttttacaaatatctgtccaaacttctgacaaagcaggaagatagcgagaacttcctcgaaaagattaaaaacgaggactttctgagaaagcaacgcaccttcgataatgggtctatcccccaccaggtgcacctgacagaactcaaggccatcattcggagacagtccgagtactatccttttctgaaagagaaccaggaccgcatcgaaaagattcttaccttccggatcccgtactatattggacccctggctagagagaaaagcgattttgcctggatgacccgcaagacagacgattctatccggccttggaatttcgaagacctcgtcgacaaagaaaagagcgccgaggctttcattcatagaatgacgaacaatgatttttacctgcccgaagagaaagtgctgcctaagcactcccttatctatgaaaagttcaccgtgtacaacgagctcacaaaagtccgctacaagaatgaacaaggcgagacctatttcttcgactctaacatcaaacaggagatttttgatggcgttttcaaggaacatcggaaagtgagcaagaagaaactgctggactttctcgccaaggagtacgaagagttcagaatcgtggatgtcattgggctggacaaagaaaataaggcgtttaacgcttcccttggaacatatcacgatctggagaaaatcctcgacaaggatttcctggacaatcccgataacgagagcattctggaagacatcgtgcagacccttacgctctttgaggatcgcgaaatgatcaagaaacggctggagaattacaaggacctgttcacagaatctcagctcaaaaagctgtatagacggcactacaccggctgggggcgcctttccgccaaactgattaacggaatcagagacaaggagagccaaaagaccattctcgattatctgatcgacgatggccggtctaatagaaactttatgcagctgattaacgacgatgggctttccttcaaaagcatcatctccaaggcccaggctggatctcatagcgacaatctcaaagaggttgtgggcgaactggccggctccccggctattaagaaagggatcctgcagtctctcaagattgtcgatgagctggtgaaagttatgggatacgaacctgagcaaatcgtggtcgagatggcccgcgaaaaccagacaaccaatcagggccggagaaacagccgccagagatacaaacttctggacgatggggtgaagaatctcgcgtccgacctgaacggaaatattctgaaggagtatcccacagataaccaagcccttcagaatgaacgcctcttcctgtactatctgcagaacggccgggacatgtacacgggggaggctctcgacatcgataatctgagccaatatgacatcgatcacattatccctcaggcctttattaaggacgattctatcgacaacagagtccttgtgtccagcgctaaaaatcggggcaagtctgatgacgttccctccctggaaattgtgaaagattgcaaggtcttctggaagaaactcctggacgccaagctgatgagccagcgcaaatacgataaccttaccaaggcggagagaggaggcctgacatctgacgataaagcccggtttatccagcgccaactcgtggagaccagacagattacaaagcatgttgctcggatcctggacgaacgcttcaataacgagctcgacagcaaggggagacggatcagaaaagtgaagattgtcaccctgaaatccaaccttgtgagcaattttcgcaaggaatttggattttataaaatccgggaggtgaacaattaccaccatgcccacgatgcttacctgaacgccgttgtcgccaaggctattctcacgaagtatccccagctggaacctgagttcgtgtacggcgactatccgaaatacaattcttataagaccagaaaatccgcgacagagaagctgtttttctacagcaacatcatgaactttttcaaaaccaaggtgacacttgccgatgggaccgtcgtggttaaggacgatattgaagtgaataatgacacgggagagatcgtctgggataaaaagaaacacttcgctacagtgcgcaaggttctgtcctatccccagaacaatatcgtgaaaaagaccgaaattcaaacaggcgggttttctaaagagagcatcctcgcccatggcaactccgacaagctgattcctcggaagaccaaagatatctacctcgaccccaagaaatacggaggcttcgattctcctattgtcgcctatagcgtgctggttgtggctgacatcaagaaagggaaggcccagaaacttaagaccgtcacagaactgctcggaatcacgattatggagagatcccgctttgagaagaatccctctgcgttcctggaaagcaaaggctacctgaacatccgggatgacaaacttatgattctgccgaagtattccctctttgagctggaaaatgggagacgccggctcctggctagcgccggagagcttcagaagggcaacgagctggccctgcctacccagttcatgaagtttctctacctggcttctagatataacgaatccaaagggaagcccgaggaaatcgagaaaaagcaagagttcgtgaatcagcacgtgagctactttgacgatattcttcagctgatcaacgacttctctaaacgggtcattctcgccgatgcgaatctggagaagatcaacaagctctatcaagacaataaagagaacatctccgttgatgaactggctaataacattatcaatctttttacattcaccagcctgggcgcccctgccgcttttaagttcttcgacaaaattgtggatcgcaagagatacacatctaccaaagaggtgctgaactccacgctcatccatcagagcattacaggactgtacgaaacccggatcgaccttggcaagctgggggaggattga

SEQ ID NO: 4293 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctatcattacagatgactataaagtccctgccaagaaaatgagagttctcggcaacacggataaggagtacatcaaaaagaatctgattggggctctgctgttcgacggaggcaacaccgccgcggatcggcgcctcaagagaacagctcggcgcagatatacccggcgcagaaatcggatcctgtaccttcaggaaatctttgccgaggaaatgagcaaagtggacgattccttctttcaccgcctggaggactctttcctcgtggaagaggataagagagggagcaaatatccgatttttgccacaatgcaagaggaaaagtactatcatgagaaattccccaccatctaccatctgcggaaggaactggctgacaagaaagagaaggccgatctccgcctgatttaccttgctctggcccacatcattaaatttagaggacacttcctcatcgaggacgatcggtttgacgtccgcaacacagacattcagaagcagtatcaggcgttcctggaaatctttgataccacgttcgagaataacgaccttctgtcccaaaatgtggatgttgaagccatcctcaccgacaaaatttctaagagcgctaaaaaggatagaatcctggcccggtaccctaaccagaagtccacaggcatttttgctgagttcctgaaactcatcgtgggcaatcaggccgacttcaagaaacattttaacctggaagataagacaccccttcagttcgcgaaagacagctatgatgaggacctggagaatctcctggggcaaattggagatgaatttgccgaccttttctctgctgccaagaagctgtacgactccgtcctcctgagcggcatcctgaccgtgaccgatctctctacgaaagctcctctgtccgccagcatgatccagagatatgacgagcaccgcgaagatcttaagcagctgaaacagtttgttaaggcctctctccccgagaaataccaagaaattttcgctgactccagcaaggatgggtatgcgggatacatcgagggcaagacaaaccaggaggccttttacaaatatctgtccaagctgctgaccaaacaggaagggtctgagtacctcctggaaaagattaaaaatgaggacttcctgcggaagcaaagaacatttgataacggaagcatccctcaccaggtgcatctcaccgaactgcgcgctattatccggagacagtccgagtattacccgcttctgaaggagaacctcgaccgcatcgaaaagattctgaccttccggatcccctattacgtcggccctctggccagagagaagtccgattttgcctggatgacacgcaaaacggacgattctattcggccctggaatttcgaagaccttgtggataaggagaaatccgctgaggcctttatccacagaatgaccaacaatgacctctatctgcctgaagagaaggtgctgcccaaacatagcctcatttacgaaaagttcacagtctacaacgagctgaccaaggttcgcttccttgcggaaggctttaaagacttccagtttctgaatcggaagcaaaaagagacaatcttcaactctctctttaaggagaaaagaaaggtgaccgaaaaggatattatcagcttcctgaataaagtggacgggtatgagggaatcgctattaagggcatcgaaaaacagtttaacgcctccctgtctacgtaccacgatcttaagaaaattctcgggaaggacttcctggataatacagacaacgagctgatcctcgaagatattgtccagaccctgaccctttttgaggaccgggagatgatccgcaagagactggatatctataaagacttctttacagaaagccagctcaagaaactgtaccggagacactataccggatggggccgcctgtccgccaaacttattaatgggatccggaacaaagagaatcaaaagacaattctcgattacctgatcgacgatggaagcgctaacagaaatttcatgcagctgattaaggacgccggcctctcttttaaaccgatcatcgacaaggctcgcacgggctcccatagcgataacctgaaagaagtggttggggagcttgccggatctcctgcgattaagaaaggcatcctgcagtccctcaagattgtggacgaactggtcaaagtgatggggtatgagcccgagcagatcgttgtggaaatggccagagagaaccaaaccacagctaagggactgagccggtcccgccagagacttaccacactccgggaatctctggccaatcttaagagcaacattctcgaggagaaaaagcctaaatacgtcaaggatcaggtggaaaatcaccatctgtccgacgatcgccttttcctgtactatctccagaacggcaaagacatgtacaccgatgacgagctggatatcgacaatctgtctcaatatgatatcgaccacattatcccccaggctttcattaaggacgatagcatcgacaacagagtccttgtgtccagcgccaagaatcgggggaaatctgatgacgttccctccgtggaaattgtcaaggattgcaaagtgttttggaagaaactgctcgacgcgaagctgatgagccagcgcaagtacgataacctcacgaaagccgagagaggcggactgacctctgacgataaggctcggttcatccaacgccagcttgttgaaacaagacagattaccaaacatgtggcccggatcctggacgagagatttaataacgagctcgattccaagggccgccggatcagaaaagtcaagattgtgacacttaagagcaatctggtgtctaacttccgcaaagaatttgggttctataagatccgggaggttaataactaccaccacgctcatgacgcctatcttaatgccgtcgtggctaaagcgattctgaccaagtaccctcagctcgaaccggagtttgtgtacggagattatcccaaatacaacagctataagacgagaaagtccgccacagaaaaactgttcttttacagcaacatcatgaatttctttaagaccaaagtcacactcgctgacggcaccgtggttgtgaaggacgatattgaggtcaacaatgacaccggggagatcgtgtgggataaaaagaaacacttcgccacagttcgcaaggtgctgtcttatcctcaagtcaacatcgtgaagaaaacggaaattcagaccggaggcttctccaaggagagcatccttgcccatgggaatagcgacaaactgattccccggaagacaaaagatatctacctcgaccctaagaagtatggcggatttgattctcccattgttgcttacagcgtgctggtcgtggccgacatcaaaaagggcaaagcgcagaagctgaaaaccgtgacagaacttctggggatcaccattatggagagatcccgcttcgaaaagaacccgtctgcttttctcgagagcaagggatacctggatatccgggacgataaactcatgattctgcctaagtattcccttttcgagctggaaaatggcagacggcgcctgctcgcctctgccggggagctgcagaaaggaaacgaacttgctctgcccacgcaatttatgaagttcctctacctggccagcagatataatgagctcaaaggcaagcctgaggaaatcgagcagaagcaggaatttgtcgttcagcacgtgtcctacttcgacgatattctgcaaatcattaacgactttagcaatcgggtgatccttgcggacgctaacctggagaaaatcaataagctgtatcaggataacaaagaaaatattcccgtcgacgagctcgccaacaacatcattaatctgttcacatttacctctcttggggcccctgctgccttcaagtttttcgataaaatcgtggaccgcaagagatacacctccacaaaagaggttctgaacagcaccctcattcaccagtctatcacaggcctgtatgaaacgcggatcgatctcggaaagctgggcgaggactga

SEQ ID NO: 4294 - RNA, 4113 nt, synthetic construct
  misc_feature 1..4113: note = Cas9 variant
  source 1..4113: mol_type = other RNA
atgaagaaaccctacagcatcggcctggacattgggaccaactccgtgggatgggccgtcgttacagatgactataaggtgcctgctaaaaagatgagagtgttcggcgatacggaccggtctcacatcaaaaagaatctcctggggacccttctgtttgatgacggaaacacagccgagagccgcagactcaagcggaccgcgcgcagacggtacacacgcagacggaatcgcattctgtatcttcaggaaatcttcaccgagtccatgaacgaaattgatgagagctttttccatagactggacgatagctttctcgtcccggaagacaaacggggctccaagtaccccatcttcgctacactgcaagaggagaaagaatatcacaagcagtttcctaccatctaccatctgcgcaaacagctcgccgattctaaggagaagtctgacgtgagactgatttatcttgccctggctcacatgatcaaataccgggggcatttcctctacgaagagacgtttgatattaagaataacgacatccagaaaattttcaatgagtttatcaacatttatgacaataccttcgaaggatccagcctgtctggccaaaacgcccaggttgaggctatctttacagataagatctccaaaagcgccaagcgcgaaagagtgcttaaactgttccccgacgagaagtctaccggcctcttctccgaatttctgaagctgattgtcgggaatcaggcggatttcaaaaagcactttgacctcgaggagaaagcccctctgcagttcagcaaggatacatacgacgaagaacttgaaaacctgctcggacaaatcggcgatgactttgctgatctgttccttattgccaaaaagctgtatgacgctatcctcctgtctgggattctgaccgtgacggatccctccacaaaggcccctctcagcgcgtccatgatcgagcggtacgaaaatcaccagaaagacctggccgctcttaagcagtttatcaaaaacaatctgccggagaagtatgttgaggtgttctctgaccagagcaaagatggatacgccggctatattgacgggaagaccacacaagaggctttttacaagtacatcaaaaacctcctgtccaagttcgagggagccgattattttcttgacaaaattgaaagagaggatttcctgcgcaagcagcggacctttgacaacggcagcatcccccatcagattcacctccaagaaatgaatgccatcctgagacgccagggcgagcattaccctttcctgaaagagaaccgggaaaagatcgagaagattctcaccttcagaatcccctattacgtcgggcctctggctcgcgataatcgggacttttcttggcttacaagaaactccgatgaacccattcgcccgtggaatttcgaggaggtggtggacaaagcgcggagcgccgaagattttatccacagaatgacgaactatgacctgtacctccctgaggaaaaggtcctgcccaaacactctctgctttatgagaccttcgctgtttacaatgaactcacaaaggtgaaatttattgccgagggactgcgcgattaccagttcctggacagcggccagaagaaacaaatcgtgaaccagctctttaaggagaagcggaaagtcaccgaaaaggacattatccattatctgcacaatgtggatgggtacgacggaatcgagcttaaaggcattgaaaagcagttcaacgccaatctgtccacatatcatgatctcctgaaaatcaccaaggacaaggagtttatggatgaccctaaaaacgaagagattctggagaatatcgttcacacgcttacaattttcgaagatagagagatgatcaagcagcggctcgctcaatacgacaccctgtttgatgaaaaagtgatcaaggccctgacccgcagacattatacagggtggggaaaactctctgcgaagctgattaacggcatccgggacaagcagagcggcaaaaccattcttgattacctgatcgacgatgacaagattaatagaaacttcatgcagctcatcaacgacgatgggctgtcctttaaagagatcattcagaaggctcaagtcgtgggaaaaacagacgatgttaaacaggtggtccaggaactgcccggcagccccgccatcaagaaagggattcttcagtctatcaagattgtggacgagctcgtcaaagtgatgggatatgccctggagtccatcgttatcgaaatggctcgcgagaatcaaacgaccgcccggggcaagaaaaacagccagcagagatacaagcgcattgaagatgctctgaaaaatctcgcccctgggctggactctaacatccttaaggagaatccgacagataacattcaactgaagaatgacagactcttcctgtactatctgcagaacggcaaagatatgtacaccggaaagccccttgacatcaatcagctctccagctatgatattgaccacatcattcctcaggcgttcatcaaagacgattccatcgacaaccgggtgctgacatctagcaaggataatcgcggcaaatccgacaacgtcccctctctggaggtggttcaaaagagaaaggccttttggcagcagctcctggatagcaaacttatttccgaacggaagttcaataacctgaccaaagctgagcgcgggggactcgacgaaagagataaggtgggctttatccggcgccagctggtcgagacgcaacagattaccaaaaatgtggcccagatcctggacgctagattcaacacagaagtgaaggagaagaaccagaaaattcggaccgttaagatcatcacacttaaaagcaatctggtctctaactttcgcaaggagttcgggctctacaaagtgagagaaattaataactatcaccatgcccacgatgcgtacctgaatgccgtggtcgctaaggccatcctcaagaaatatcctaagctggagcccgaatttgtgtacggagactaccaaaaatatgatcttaagaaatacatttcccggttcaagccgagcaaggagatcgaaaaagctaccgagaagtactttttctattctaacctgctcaactttttcaaagaggaagttctgtatgccgacggcacgattagaaagcgcgagaatatcgaatactccaaagatacaggggagatcgcctgggacaaggaaaaagacttcgctaccattaagaaggtgctgagctatcctcaggtcaatatcgtgaaaaagcgggaggttcagacaggcggattttctaaagagagcattcttcccaagggcaactccgataaactgatccctagaaagaccaaggacattctctgggataccacaaaatacgggggattcgacagccccgtgatcgcgtactctattctgctcatcgccgatatcgaaaagggcaaagctaagaaactgaagacggtcaagacccttgtggggattacaatcatggagaaagccgcctttgaagagaatcctattaccttcctggagaacaagggatatcataatgttcgcaaagaaaacatcctctgcctgcccaagtactccctgtttgagcttgaaaatggccggagacgcctgctcgctagcgccaaagagctgcaaaaggggaacgaaattgtgctcccggtctgtctgacaacccttctgtatcactccaagaacctgcacaaactcgacgagcctgagcatctggaatacatccagaagcaccggaatgagttcaaagatcttctgaacctcgtgtctgaatttagccagaagtatatcctggcggaggctaatctcgaaaagattaaggacctgtacgccgataacgagcaggccgacatcgagattcttgctaattccttcatcaacctgctgacgtttacagccctcggcgcgcccgctgccttcaaatttttcggaaaggatgtggacagaaagcgctataccaccgtctctgaaattctgaatgccacacttatccatcaaagcatcaccggcctgtacgagacacggattgatctctccaaactgggggaagagtga

SEQ ID NO: 4295 - RNA, 4113 nt, synthetic construct
  misc_feature 1..4113: note = Cas9 variant
  source 1..4113: mol_type = other RNA
atgaagaaaccctacagcatcggcctggacattgggaccaactccgtgggatgggccgtcatcacagatgactataaggttcctgctaaaaagatgaaagtgctcggcaatacggataagaactacattaagaaaaatctgcttggggccctcctgttcgactctggaaacaccgcggaggatagacggctgaagcgcacagctagacggcgctataccagacggcgcaatagacttctgtacctccaggacatctttagcgatgaaatgaacaaagtggacgagtccttctttcaccggctggaagattctttcctggtcagcgaggacaagcgcggcgatcatcacccgatttttgggaatgtggttgacgaagtgaaatatcatgagcaattccccacaatctaccacctcagaaagtatctggccgatacccctgagaaggccgaccttcggctggtctacctcgctctggcccatatgatcaaatttcgcggacacttccttattgacgatcccaagctggacgtgaaaaacacagattcccaggaactcttttctcagttcctgaccgcttacgacgttacgcaggaggatagccacctggccgacgtgaagatcaatatttccgatatcattaccgaaaagatgaacaagagcagaaaagtcgaggcgctcctgtttcatttcccttctcaaaagaaaaattcctttttcggcaaccttgtgagcctggtgttcggcctcctgcccaattttaaaacaaacttcaatcttgccgaggacgctaagctgcagctctctaaagattcctatgacgaagatctggagaacctgctcgggcagatcggagacgaatacaccgacgtctttgttgccgctcggaagctgtatgatagcattcttctgtctggcatcctcacagtgaacgacctgtccaccaaagccatccttagcgcgtccatggtgcgcagatacgaggaacacaataaggatctggccaagctcaaggctttcgtcaaggccaactttacgcatgacgtgttcaaagaggtgttttctgatgctagcaagaatgggtatgccggatacattgagggcaaaacatcccaggaagacttctataagtacgttaagaacctgatcgggaaagtcgatggaagcgccgactttattgagaagatcgatcgggaagacttcctgagaaaacaacgcacctttgataatggctctattcctcaccaggtgcacctcgctgagatgaaggcgatcctgcggagacagggcgaatactatccgttccttaaagagcatgccgagaagatccagcaaattctgacatttcgcatcccctactatgttgggcctctcgaccggcacggacattccgatttcgcttgggccagcttcaactctgaagagaaggtgaccccctggaattttgaagagattatcgacaaaaacaagagcgcccaggctttcattgaaagaatgaccaatcaggacctgtacctgcctaacgagaaagtccttcccaagcactccccgctctatgagaaatacacagtgtataatgaactgacgaagatcaaatacgtcaccgagacaggcaccgccaagtttttcgatgcgaacctgaagcaagaaatctttgacggactcttcaaaaaggagcgcaaagtgacaaagcggaaactgcttacctttctggagaagaatttcgatgaatttagaattgttgacatccaggggctcgataaggagacggaaacattcaacgcttcttacggcatttatcaggacctgctgaaaatcattaaggataaagcctttatggacgatagcgagaatgccgacatccttgaagatattgtgctcaccctgaccctgttcgaggaccgcgagatgatcaagcagcggctcgctaaatacgccgatctgtttgacaagaaggtcatcgacaaccttgctagacgccggtatacagggtggggaagactgtccgccaaactcctgaacggcattcgggataagcgcagcagaaaaaccatcatggactacctggtggatgacggccggtctaatagaaaccttatgcaactcattacagatgacaatctgacgttcaaggatgaaatcgcgaaagcccagtattccgacaacagcgatgacctgcatcaggttgtgcaggatctcgctgggtctcctgccattaagaagggaatcctgcaatccgtcaaaatcgtggacgagcttgtgaaggttatgggctacgaacccgagcagattgtcgtggaaatggctcgcgagaatcagaccacagccaaagggcggagaaacagccagcaacgctataagagactggaggaagcgatcaaaaatctcgaccgggatctgaactacaagattctgaaagagcaccctaccgacaatcaggcccttcagaacgatcgcctcttcctgtactatctgcagaatggaagagacatgtacacaggcgaatccctcgatatcaaccggctgtctgactatgatattgaccacatcatcccccaggcttttattaaggataatagcatcgacaaccgcgtgcttgtctcctctgccaagaatagagggaaaagcgatgacgtgccctccgaggatgttgtgaaccggatgcgccctttctggaacaagctgctcaattgcggcctgattagccaaagaaaatactctaacctgaccaagaaagaacttacgccgaatgacaaggctggatttatcaagcggcagctggtcgagacccgccaaattacaaaacatgtggccagaatcctcgacgagcacttcaacaaggaatttgatgaggacaaaaagcggatcagaaaagttaaggtggtcaccctgaagtccaatctcgtgagcaacttccgcaaagaatttgagctgtataaggttcgggagattaatgattaccatcacgcccacgacgcttatcttaacgcggtggtcgccaaagctctgctcatgaagtaccccaaactggaacctgagttcgtgtacggcgaatatcccaagtacaattcttatagagagcgcaagacagccacccagcggatgtttttctactccaacatcatgaatatgtttaaaagcaaggtgaaactggccgatgaaagaattatcgagcgccctatgattgaggtcaacgacgaaacgggggagatcgcttgggataagacaaaacatattgccaccgttaagaaggtgctttcttatccccagatcaatatcgtgaaaaaggtcgaggaacagacaggaggcctgaccaacgaaaccatttacccgcgggggagcttcgacaaactcctgaatagaaagaacacactcgaggcgtccaaatatggaggcttcgggagccctacggtggcttactgtgttctggtggtcgccgattctaagaacgagaatggcaaagtgaagaaacttaaactgggatccgaactcctgggcatcaccattctggagaagaacgactttgaaaataacagccttgatttcctgtcccgcaaagggtaccaaggagttcaggagaagaaaatcattaagctccccaagtattctctgtttgagttccaggacggcagccggagaatgctctcctctgtgatggccaatgataacaaacgcggggacctgcagaaggctaatgaaatgatccttcctgcctacctggtcaaactgctctatcacgcgaagcatatcaacagcgtgggagagcccgctcacaaaaattacattaacgaacattgctccgagtttcaagacctgcttaattatatccggcagttcgccgataagtttgttgacgtggataagaacctgtctaaaattagaagcctctccaagagcatggccgaatactctgtctccgagatctgtagctctttcgtgaatctgctcacactgaccgctcttggcgcccctgctgactttaaattctttgggacaaccattccccggaagcgctatggctccccgcagagcatcctgtctgccacgctgatccaccagtccattacaggactctacgagaccagaatcgatctgagcaaacttggcgaagactga

SEQ ID NO: 4296 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctatcattacagatgactataaagtccctgccaagaaaatgagagttctcggcaacacggataaggagtacatcaaaaagaatctgattggggctctgctgttcgacggaggcaacaccgccgcggatcggcgcctcaagagaacagctcggcgcagatatacccggcgcagaaatcggatcctgtaccttcaggaaatctttgccgaggaaatgagcaaagtggacgattccttctttcaccgcctggaggactctttcctcgtggaagaggataagagagggagcaaatatccgatttttgccacaatgcaagaggaaaagtactatcatgagaaattccccaccatctaccatctgcggaaggaactggctgacaagaaagagaaggccgatctccgcctgatttaccttgctctggcccacatcattaaatttagaggacacttcctcatcgaggacgatcggtttgacgtccgcaacacagacattcagaagcagtatcaggcgttcctggaaatctttgataccacgttcgagaataacgaccttctgtcccaaaatgtggatgttgaagccatcctcaccgacaaaatttctaagagcgctaaaaaggatagaatcctggcccggtaccctaaccagaagtccacaggcatttttgctgagttcctgaaactcatcgtgggcaatcaggccgacttcaagaaacattttaacctggaagataagacaccccttcagttcgcgaaagacagctatgatgaggacctggagaatctcctggggcaaattggagatgaatttgccgaccttttctctgctgccaagaagctgtacgactccgtcctcctgagcggcatcctgaccgtgaccgatctctctacgaaagctcctctgtccgccagcatgatccagagatatgacgagcaccgcgaagatcttaagcagctgaaacagtttgttaaggcctctctccccgagaaataccaagaaattttcgctgactccagcaaggatgggtatgcgggatacatcgagggcaagacaaaccaggaggccttttacaaatatctgtccaaacttctgaccaaacaggaagggtctgagtacctcctggaaaagattaaaaatgaggacttcctgcggaagcaaagaacatttgataacggaagcatccctcaccaggtgcatctcaccgaactgcgcgctattatccggagacagtccgagtattacccgttccttaaggagaacctggaccgcatcgaaaagattctcacctttcggatcccctattacgtcggccctctggccagagaaaagagcgatttcgcctggatgacacgcaaaacggacgattctattcggccctggaattttgaagacctggtggataaggagaaatccgctgaggccttcatccacagaatgaccaacaatgacctttatctccctgaagagaaggtgctgcccaaacatagcctgatttacgaaaagttcacagtctacaacgagctcaccaaggttcgctttctggcggaaggcttcaaagactttcagttccttaatcggaagcaaaaagagacaatctttaactctctgttcaaggagaaaagaaaggtgaccgaaaaggatattatcagctttctcaataaagtggacgggtatgagggaatcgctattaagggcatcgaaaaacagttcaacgcctccctgtctacgtaccacgatctgaagaaaattcttgggaaggactttctcgataatacagacaacgagctgatcctggaagatattgtccagaccctcaccctgttcgaggaccgggagatgatccgcaagagacttgatatctataaagactttttcacagaaagccagctgaagaaactctaccggagacactataccggatggggccgcctgtccgccaagctgattaatgggatccggaacaaagagaatcaaaagacaattcttgattacctcatcgacgatggaagcgctaacagaaattttatgcagctgattaaggacgccggcctgtctttcaaaccgatcatcgacaaggctcgcacgggctcccatagcgataacctcaaagaagtggttggggagctggccggatctcctgcgattaagaaaggcatccttcagtccctgaagattgtggacgaactcgtcaaagtgatggggtatgagcccgagcagatcgttgtggaaatggccagagagaaccaaaccacagctaagggactgagccggctgcgccagagacttaccacactccgggaatccctggccaatctgaagtctaacattctcgaggagaaaaagcctaaatacgtcaaggatcaggtggaaaatcaccatctgagcgacgatcgccttttcctgtactatctccagaacggcaaagacatgtacaccgatgacgagctggatatcgacaatctgtcccaatatgatatcgaccacattatcccccaggcttttattaaggacgattctatcgacaacagagtccttgtgagctccgccaagaatcgggggaaaagcgatgacgttccctctgtggaaattgtcaaggattgcaaagtgttctggaagaaactgctcgacgcgaagctgatgtcccagcgcaagtacgataacctcacgaaagccgagagaggcggactgaccagcgacgataaggctcggtttatccaacgccagcttgttgaaacaagacagattaccaaacatgtggcccggatcctggacgagagattcaataacgagctcgattctaagggccgccggatcagaaaagtcaagattgtgacactgaagtccaatctggtgagcaactttcgcaaagaatttgggttttataagatccgggaggttaataactaccaccacgctcatgacgcctatcttaatgccgtcgtggctaaagcgattctgaccaagtaccctcagctcgaaccggagttcgtgtacggagattatcccaaatacaactcttataagacgagaaagagcgccacagaaaaactgtttttctactccaacatcatgaatttcttcaagaccaaagtcacactcgctgacggcaccgtggttgtgaaggacgatattgaggtcaacaatgacaccggggagatcgtgtgggataaaaagaaacacttcgccacagttcgcaaggtgctgagctatcctcaagtcaacatcgtgaagaaaacggaaattcagaccggaggcttttctaaggagtccatccttgcccatgggaatagcgacaaactgattccccggaagacaaaagatatctacctcgaccctaagaagtatggcggattcgattcccccattgttgcttactctgtgctggtcgtggccgacatcaaaaagggcaaagcgcagaagctgaaaaccgtgacagaacttctggggatcaccattatggagagaagccgctttgaaaagaacccgtccgctttcctcgagtctaagggatacctgaatatccgggatgacaaactcatgattctgcctaagtatagcctttttgagctggaaaacggcagacggcgcctgctcgcctccgccgatgagctgcagaaagggaatgaacttgctctgcccacgcaattcatgaagtttctctacctggcctctagatataacgagctcaaaggaaagcctgaggaaatcgagcagaagcaggagttcgtcgttcagcacgtgagctactttgacgatattctgcaaatcattaatgacttctccaaccgggtgatccttgcggacgctaatctggagaaaatcaacaagctgtatcaggataataaagaaaacattcccgtcgacgagctcgccaacaatatcattaacctgtttacattcaccagccttggcgcccctgctgcctttaagttcttcgataaaatcgtggaccgcaagagatacacctctacaaaagaggttcttaattccaccctcattcaccagagcatcacagggctgtatgaaacgcggatcgatctcggcaagctgggagaggactga

SEQ ID NO: 4297 - RNA, 4113 nt, synthetic construct
  misc_feature 1..4113: note = Cas9 variant
  source 1..4113: mol_type = other RNA
atggagaagaacaaagaatacgtgatcggcctggacattgggaccggaagcgtcggctggtccgccatctctacagataattatcagctcattagacaaaaggggaaaaacctgatcggagttcggcttttcaatagcgctgagacggccgaagaacgcagaggctaccggaccacacgcagacggctgtcccgcagacggtggcgcatgtctctcctgaacgacatttttagacccgaacttaatgagatcgatgagaacttcctggcgcggctcaagtatagctgggtgtcccctctggaccagaaaaatccgcagctgaacgaacaggggaccaatgcttctctctacggagatatcgaggccgaccaagcctttcaccgcgcttatcccacaatttaccatctgagaaagacccttatggaagataaccagaagcacgacctgcgggaggtgtatctcgccatccatcacattgtcaaataccgcggccatttcctgacacctgattttgacgctaatagccagaccatcgatattaagggccttttcaaacagctgggggacgtgtccggaagcatcgagctccaagccgatcagacgtctaccgttattgcggcctttcagtccatcctgctggacttcacaaagacccccacagaaagcggcagactcgctgggcagctgttttctgaccaaaacaaagataagcaggccaagaaacaggtggaggaacttttcaagctgctccggggaggcaaagggtccctggctgacatgtttcttctgaccgatctcgacaaggtcgtgaaaaatcaactgaagttcgcctttgatgacgcggttgatgagaacctgaatctcatcagcaacctgattaacgaggagcagtacgagcttctgctcaatatccagaaactgagaggaacgattatccttaagcagattctgggcgacgatgaaacagtgtctgacgccaaggtccgctcctatgaggaacacgctcaccaactcaaagagctgaaggcccaggtgctgaccaaagataacaaggaaaaattcgaggaggcttaccagctcatccagaagggcgacgccagccggatcgacgggctgaagaaacttaagacaattatcaatcaagaacatgaggccctgagactcgataaatatgaagctgacaagctgctgaaacttattgagctcgatcagctgctgcctgtgcagcgctccaagcggaacggagaaatcccccaccagctccatgagttcgagctgaagaaaattatcgaaaagcaaggcagatactatccttttcttcgcgagaccttcgaacgggacgggcaggagtttaataaaatcggacagctggtcaacttccgcattccgtactatgttggccccctcgtggatcctagactggcggggatccagtctggagaccaaaccaatcactggatgacacagaagaaagccggcaagattacgccctggaactacaccgagctgatcgatattgacaagagcgctgccgaatttatcaaacggatgacaggcaccgatacataccttgtgggggagccttccctccacaaggccagcctgatttatcaggactacaatgtcctgcaagaactcaacaatctgagatatgatggaaaaccccttccggtggacgctaagcaggagatctactctaacctgcaggtttccctcaaaaatgccaccaagaacaaaatcaatagcttcctgatttctgaaggctatctgcaggatggggaggagcttacgggatttgcgggcaaggaactcaagaacaaactgagctccttccattactttaagaacatcttcgggcctgagcgcatgaatacactgggcaccgacaacctcgagaaaattaccgagctgcaaacagtgtttgaagaccggcacatgcttaagagacagctgcagaaactcggattcctggatgacgatgagtgcgagaagctggctggcaagcattttaccgggtggggaaatctttctaaaaagctcctgaacacacccgccatcattgaccctgaaatcaatgagaacaaaatcagcctgattgatgccctctataagggccagcggaatctgtccttctacgtcaacaatatggacgataaataccaattccgcgactggatcgaaagcgagaaccagtctcaacaggtggaaatttcccttgatgagaagatcaagaatctggctgggagccccgccattaaaagaggaatcacgcagtctatggctgttatccaggacattatccgggccaacaatggcatttcccccaagagaatctatctcgagtttgcgcgcgaaagccagaactcctaccaacctaattctcggattaaacagatcgagaagatctatgatcagaacaaaaaggaactgatgaaggtgtacccggacgtcttcaaagatgtgcagggggtcctgaacaatgtggacgagaacaatagcctttccgagaaggcctttctgtatttcatgcaactcggcaaagacatgtacaccggagaagctctggattttgacaagctctatacatacgatattgaccacatcattccccaggccatgaccaaagataactcttgggacaataaggttctggtgacagctatcaaaaacagagaaaagagcaatcaggtccttgataacgccattcaggcgaagatgcataatttctggctgcaactcaaaaaggtgaacctgctgtcccagcgcaaatacgacacccttatgaagacgaattttagcaaaggcgatgaaaagaagttcatcgccagatctctggttgagacccggcagattatcaaaaacgtggctgaactcatcaagtccgagtttgaccacgtcgaggccattcctatccgccaggaactgacaagcgatatgagacaactcatggactataaaaagaatcggctggtgaacgactaccaccatgctcacgatgcccttctgattgccaccgtgggggagttcatgcagaaacgcggatttatgcagggcatgaatccctctcagaacgtttatcatgggtacacacaatatgtcaagaagtggctctccatggctaaaaaggcgagaagcgccgaaaaacctgagcggatcttccccctgcagtttgtggtgggatctatgcgcatggctgtcagagacggccaggtggataaggttacccacccggccacgggggaaatttgttggacagccgacaacgaggcttacctgcggaaagtgcttggctataagaatatcctggtcacccgcaaggtgaaaaacgccggaaagctctaccaaagagttacagtgaaacctaagggcagcggggaggcgcccgtcaatcaccagaaatccgatatcaacatttacggaggcgtgaccagcgaacaggctgccgagctggttctcatccggattaaggccaagaataacgctaaaaatatggtgatcaagattcctaccgccatcgcgaaccaggtcgctaataaaacaacgacctatgacgcctacgtgagatctctgaacatccccaattatgccgggattatccttgatcaaattcctctgggacagctggtgttcgacgaacgcacatccttctacctcgctagcgccgagatcaagcataacgctcggcagctgtgggtcaatcagcacattaacaatgttcttaccaaaaagaacatcaatgatgaagagagagacaacattctgaacctcctgacaaatgagaaaaacctcgaacgctttaagctgcttgagcccgatctgaagcgggtgaaagccgcgaagcaacagtgggcctcctgcgacgatcaggaacagatgcaaatcctgagaatcattatcaataaaatgcatgacgacgcttctccgcagattcctggcaagatcgatcccttcaaaaactatctcgacaagcaggggaagggctggcgcgatctgcggaccaaaaagggaatgaaacttagcgacaatgccgagtttgtgtaccaatcccccacgggcctgtatcacagaaagatttctatcaacgagctcctgaaacagaagcagctcgaatga

SEQ ID NO: 4298 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctatcattacagatgactataaggtccctgccaagaaaatgagagttctcggcaacacggataaggagtacatcaaaaagaatctgattggggcccttctgttcgacggaggcaacaccgctgcggatcggcgcctcaagagaacagctcggcgcagatatacccggcgcagaaatcggatcctgtaccttcaggaaatctttgccgaggaaatgagcaaagtggacgattccttctttcaccgcctggaggactctttcctcgtggaagaggataagagagggagcaaatatccgatttttgccacaatgcaagaggaaaagtactatcatgagaaattccccaccatctaccatctgcggaaggaactggctgacaagaaagagaaggccgatctccgcctgatttaccttgctctggcccacatcattaaatttagaggacacttcctcatcgaggacgatcggtttgacgtccgcaacacagacattcagaagcagtatcaggcgttcctggaaatctttgataccacgttcgagaataacgaccttctgtcccaaaatgtggatgttgaagccatcctcaccgacaaaatttctaagagcgctaaaaaggatagaatcctggcccggtaccctaaccagaagtccacaggcatttttgctgagttcctgaaactcatcgtgggcaatcaggccgacttcaagaaacattttaacctggaagataagacaccccttcagttcgcgaaagacagctatgatgaggacctggagaatctcctggggcaaattggagatgaatttgccgaccttttctctgctgccaagaagctgtacgactccgtcctcctgagcggcatcctgaccgtgaccgatctctctacgaaagctcctctgtccgccagcatgatccagagatatgacgagcaccgcgaagatcttaagcagctgaaacagtttgttaaggcctctctccccgagaaataccaagaaattttcgctgactccagcaaggatgggtatgcgggatacatcgagggcaagacaaaccaggaggccttttacaaatatctgtccaaacttctgaccaaacaggaagggtctgagtacctcctggaaaagattaaaaatgaggacttcctgcggaagcaaagaacatttgataacggaagcatccctcaccaggtgcatctcaccgaactgcgcgctattatccggagacagtccgagtattacccgttccttaaggagaacctggaccgcatcgaaaagattctcacctttcggatcccctattacgtcggccctctggccagagaaaagagcgatttcgcctggatgacacgcaaaacggacgattctattcggccctggaattttgaagacctggtggataaggagaaatccgctgaggccttcatccacagaatgaccaacaatgacctttatctccctgaagagaaggtgctgcccaaacatagcctgatttacgaaaagttcacagtctacaacgagctcaccaaggttcgctttctggcggaaggcttcaaagactttcagttccttaatcggaagcaaaaagagacaatctttaactctctgttcaaggagaaaagaaaggtgaccgaaaaggatattatcagctttctcaataaagtggacgggtatgagggaatcgctattaagggcatcgaaaaacagttcaacgcctccctgtctacgtaccacgatctgaagaaaattcttgggaaggactttctcgataatacagacaacgagctgatcctggaagatattgtccagaccctcaccctgttcgaggaccgggagatgatccgcaagagacttgatatctataaagactttttcacagaaagccagctgaagaaactctaccggagacactataccggatggggccgcctgtccgccaagctgattaatgggatccggaacaaagagaatcaaaagacaattcttgattacctcatcgacgatggaagcgctaacagaaattttatgcagctgattaaggacgccggcctgtctttcaaaccgatcatcgacaaggctcgcacgggctcccatctcgataacctgaaagaagtggttggggagcttgccggaagccctgcgattaagaaaggcatcctgcagtctctcaagattgtggacgaactggtcaaagtgatggggtatgagcccgagcagatcgttgtggaaatggccagagagaaccaaaccacagctaagggactgtcccggagccgccagagacttaccacactccgggaatccctggccaatctgaagtctaacattctcgaggagaaaaagcctaaatacgtcaaggatcaggtggaaaatcaccatctgagcgacgatcgccttttcctgtactatctccagaacggcaaagacatgtacaccgatgacgagctggatatcgacaatctgtcccaatatgatatcgaccacattatcccccaggcttttattaaggacgattctatcgacaacagagtccttgtgagctccgccaagaatcgggggaaaagcgatgacgttccctctctggaaattgtgaaggattgcaaagtcttctggaagaaactcctggacgcgaagctcatgtcccagcgcaagtacgataacctgacgaaagccgagagaggcggacttaccagcgacgataaggctcggtttatccaacgccagctggtggaaacaagacagattaccaaacatgttgcccggatcctcgacgagagattcaataacgagctggattctaagggccgccggatcagaaaagtgaagattgtcacactgaagtccaatcttgtgagcaactttcgcaaagagttcgggttttataagatccgggaggtgaataactaccaccacgctcatgacgcctatctgaatgccgttgtcgctaaagcgattctcaccaagtaccctcagctggaaccggagttcgtgtacggagattatcccaaatacaactcttataagacgagaaagagcgccacagaaaaactctttttctactccaacatcatgaactttttcaagaccaaagtgacactggctgacggcaccgtcgtggttaaggacgatattgaggtgaataatgacaccggggagatcgtctgggataaaaagaaacacttcgccacagtgcgcaaggttcttagctatcctcaagtgaacatcgtcaagaaaacggaagtgcagaccggaggcttttctaaggagtccattctggcccatgggaatagcgacaaactcatcccccggaagacaaaagatatttacctggaccctaagaagtatggcggattcgattcccccatcgttgcttactctgtgctggtcgtggccgacattaaaaagggcaaagcgcagaaacttaagaccgtgacagaactgctcgggatcaccatcatggagagaagccgctttgaaaagaacccgtccgctttcctggagtctaagggatacctcaatattcggacggataaactgatcattcttcctaagtatagcctgtttgagctggaaaacggcagacggcgcctcctggcctccgccggggagcttcagaaaggaaatgaactggctctccccacacaatacatgaagttcctgtatctcgcctctagatacaacgagctgaaaggcaagcctgaggaaatcgagcagaagcaggaatttgtcgttcagcacgtgagctatttcgacgatattcttcaaatcattaatgacttttccaaccgggtgatcctggcggatgctaatctggagaaaatcaacaagctctaccaggacaataaagaaaacattcccgtcgacgagctggccaacaatatcattaaccttttcacctttaccagcctgggggcccctgctgccttcaagtttttcgataaaatcgtggaccgcaagagatatacatctaccaaagaggttctcaattccacactgattcaccagagcatcacgggcctctacgaaacccggatcgatctgggaaaacttggcgaggggtga

SEQ ID NO: 4299 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctatcattacagatgactataaagtccctgccaagaaaatgagagttctcggcaacacggataaggagtacatcaaaaagaatctgattggggcccttctgttcgacggaggcaacaccgccgcggatcggcgcctcaagagaacagctcggcgcagatatacccggcgcagaaatcggatcctgtaccttcaggaaatctttgccgaggaaatgagcaaagtggacgattccttctttcaccgcctggaggactctttcctcgtggaagaggataagagagggagcaaatatccgatttttgccacactgcaagaggaaaaggactaccatgagaaattctccaccatctatcatctgcggaaggaactcgctgataagaaagagaaggccgacctgcgccttatttacatcgctctggcccacattatcaaatttagaggacacttcctcattgaggatgactcttttgacgtccggaacacagatatcagcaagcagtaccaggacttcctggaaatctttaataccacgttcgagaacaatgatcttctgtcccagaacgtggacgttgaagcgattctcaccgataaaatcagcaagtctgccaaaaaggaccgcattctggctcaatatcccaatcagaagtccacaggcatctttgccgagttcctgaaactcattgtgggcaaccaggctgatttcaagaaatactttaatctggaagacaagacccctcttcagttcgccaaagatagctatgacgaggatctggagaacctcctggggcaaatcggagacgaatttgcggaccttttctctgccgctaagaagctgtacgattccgtcctcctgagcggcatcctgacagtgattgacctctctaccaaagctcccctgtccgctagcatgatccagagatatgatgagcatcgggaagaccttaagcagctgaaacagtttgttaaggcctccctccctgagaaataccaagaaattttcgccgattctagcaaggacgggtatgctggatacatcgagggcaagacgaatcaggaggcgttttacaaatatctgtccaagctgctgacaaaacaggaagatagcgagaacttcctcgaaaagattaaaaacgaggactttctgagaaagcaacgcaccttcgataatgggtctatcccccaccaggtgcacctgacagaactcaaggccatcattcggagacagtccgagtactatccttttctgaaagagaaccaggaccgcatcgaaaagattcttaccttccggatcccgtactatattggacccctggctagagagaaaagcgattttgcctggatgacccgcaagacagacgattctatccggccttggaatttcgaagacctcgtcgacaaagaaaagagcgccgaggctttcattcatagaatgacgaacaatgatttttacctgcccgaagagaaagtgctgcctaagcactcccttatctatgaaaagttcaccgtgtacaacgagctcacaaaagtccgctacaagaatgaacaaggcgagacctatttcttcgactctaacatcaaacaggagatttttgatggcgttttcaaggaacatcggaaagtgagcaagaagaaactgctggactttctcgccaaggagtacgaagagttcagaatcgtggatgtcattgggctggacaaagaaaataaggcgtttaacgcttcccttggaacatatcacgatctggagaaaatcctcgacaaggatttcctggacaatcccgataacgagagcattctggaagacatcgtgcagacccttacgctctttgaggatcgcgaaatgatcaagaaacggctggagaattacaaggacctgttcacagaatctcagctcaaaaagctgtatagacggcactacaccggctgggggcgcctttccgccaaactgattaacggaatcagagacaaggagagccaaaagaccattctcgattatctgatcgacgatggccggtctaatagaaactttatgcagctgattaacgacgatgggctttccttcaaaagcatcatctccaaggcccaggctggatctcatagcgacaatctcaaagaggttgtgggcgaactggccggctccccggctattaagaaagggatcctgcagtctctcaagattgtcgatgagctggtgaaagttatgggatacgaacctgagcaaatcgtggtcgagatggcccgcgaaaaccagacaaccaatcagggccggagaaacagccgccagagatacaaacttctggacgatggggtgaagaatctcgcgtccgacctgaacggaaatattctgaaggagtatcccacagataaccaagcccttcagaatgaacgcctcttcctgtactatctgcagaacggccgggacatgtacacgggggaggctctcgacatcgatgacctgagccaatatgatatcgaccacattatccctcaggcctttattaaggatgactctatcgataatagagtccttgtgtccagcgctaaaaaccggggcaagtctgacgatgttccctccctggaaattgtgaaagactgcaaggtcttctggaagaaactcctggatgccaagctgatgagccagcgcaaatacgacaatcttaccaaggcggagagaggaggcctgacatctgatgacaaagcccggtttatccagcgccaactcgtggagaccagacagattacaaagcatgttgctcggatcctggacgaacgcttcaacaatgagctcgatagcaaggggagacggatcagaaaagtgaagattgtcaccctgaaatccaaccttgtgagcaactttcgcaaggaatttggattttataaaatccgggaggtgaataactaccaccatgcccacgacgcttacctgaatgccgttgtcgccaaggctattctcacgaagtatccccagctggaacctgagttcgtgtacggcgattatccgaaatacaactcttataagaccagaaaatccgcgacagagaagctgtttttctacagcaatatcatgaactttttcaaaaccaaggtgacacttgccgacgggaccgtcgtggttaaggatgacattgaagtgaataacgatacgggagagatcgtctgggacaaaaagaaacacttcgctacagtgcgcaaggttctgtcctatccccagaataacatcgtgaaaaagaccgaaattcaaacaggcgggttttctaaagagagcatcctcgcccatggcaattccgataagctgattcctcggaagaccaaagacatctacctcgatcccaagaaatacggaggcttcgactctcctattgtcgcctatagcgtgctggttgtggctgatatcaagaaagggaaggcccagaaacttaagaccgtcacagaactgctcggaatcacgattatggagagatcccgctttgagaagaacccctctgcgttcctggaaagcaaaggctacctgaatatccgggctgacaaacttattatcctgccgaagtattccctctttgagctggaaaacgggagacgccggctcctggccagcgccggagagcttcagaagggcaatgagctggctctgcctacccagttcatgaagtttctctacctggcctctagatataacgaatccaaagggaagcccgaggaaattgagaaaaagcaagagttcgtgaaccagcacgtgagctactttgacgatatccttcagctgattaatgacttctctaaacgggtcatcctcgcggatgctaacctggagaagatcaataagctctatcaagacaacaaagagaatatttccgttgatgaactggccaacaatatcattaacctttttacattcaccagcctgggcgcccctgctgcctttaagttcttcgacaaaatcgtggatcgcaagagatacacatctaccaaagaggtgcttaattccacgctcattcatcagagcatcacaggactgtacgaaacccggatcgaccttggcaagctgggggaggattga

SEQ ID NO: 4300 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctatcattacagatgactataaagtccctgccaagaaaatgagagttctcggcaacacggataaggagtacatcaaaaagaatctgattggggcccttctgttcgacggaggcaacaccgccgcggatcggcgcctcaagagaacagctcggcgcagatatacccggcgcagaaatcggatcctgtaccttcaggaaatctttgccgaggaaatgagcaaagtggacgattccttctttcaccgcctggaggactctttcctcgtggaagaggataagagagggagcaaatatccgatttttgccacactgcaagaggaaaaggactaccatgagaaattctccaccatctatcatctgcggaaggaactcgctgataagaaagagcgcgccgacctgagacttatttacatcgctctggcccacattatcaagtttcggggacacttcctcattgaggatgactcttttgacgtccgcaacacagatatcagcaaacagtaccaggacttcctggaaatctttaataccacgttcgagaacaatgatcttctgtcccagaacgtggacgttgaagcgattctcaccgataagatcagcaaatctgccaagaaagaccggattctggctcaatatcccaatcagaagtccacaggcatctttgccgagttcctgaagctcattgtgggcaaccaggctgatttcaaaaagtactttaatctggaagacaaaacccctcttcagttcgccaaggatagctatgacgaggatctggagaacctcctggggcaaatcggagacgaatttgcggaccttttctctgccgctaaaaagctgtacgattccgtcctcctgagcggcatcctgacagtgattgacctctctaccaaggctcccctgtccgctagcatgatccagagatatgatgagcatagagaagaccttaaacagctgaagcagtttgttaaagcctccctccctgagaagtaccaagaaattttcgccgattctagcaaagacgggtatgctggatacatcgagggcaagacgaatcaggaggcgttttacaagtatctgtccaaacttctgacaaagcaggaagatagcgagaacttcctcgaaaagattaagaacgaggactttctgcgcaaacaacggaccttcgataatgggtctatcccccaccaggtgcacctgacagaactcaaggccatcattagacgccagtccgagtactatccttttctgaaggagaaccaggaccggatcgagaaaattcttaccttcagaatcccgtactatattggacccctggctcgcgaaaagagcgattttgcctggatgacccggaaaacagacgattctatcagaccttggaatttcgaagacctcgtcgacaaggagaaaagcgccgaggctttcattcatcgcatgacgaacaatgatttttacctgcccgaagagaaggtgctgcctaaacactcccttatctatgaaaagttcaccgtgtacaacgagctcacaaaggtccggtacaaaaatgaacaaggcgagacctatttcttcgactctaacatcaagcaggagatttttgatggcgttttcaaagaacatagaaaggtgagcaaaaagaagctgctggactttctcgccaaagagtacgaagagttccgcatcgtggatgtcattgggctggacaaggaaaataaagcgtttaacgcttcccttggaacatatcacgatctggagaagatcctcgacaaagatttcctggacaatcccgataacgagagcattctggaagacatcgtgcagacccttacgctctttgaggatcgggaaatgatcaagaagagactggagaattacaaagacctgttcacagaatctcagctcaagaaactgtatcggcgccactacaccggctgggggagactttccgccaagctgattaacggaatccgggacaaagagagccaaaagaccattctcgattatctgatcgacgatggcagatctaatcgcaactttatgcagctgattaacgacgatgggctttccttcaagagcatcatctccaaagcccaggctggatctcatagcgacaatctcaaggaggttgtgggcgaactggccggctccccggctattaaaaaggggatcctgcagtctctcaaaattgtcgatgagctggtgaaggttatgggatacgaacctgagcaaatcgtggtcgagatggcccgggaaaaccagacaaccaatcagggcagacgcaacagcagacagcggtacaaacttctggacgatggggtgaagaatctcgcgtccgacctgaacggaaatattctgaaggagtatcccacagataaccaagcccttcagaatgaacgcctcttcctgtactatctgcagaacggcagagacatgtacacgggggaggctctcgacatcgatgacctgagccaatatgatatcgaccacattatccctcaggcctttattaaagatgactctatcgataatcgggtccttgtgtccagcgctaagaaccgcggcaaatctgacgatgttccctccctggaaattgtgaaggactgcaaagtcttctggaagaagctcctggatgccaaactgatgagccagagaaagtacgacaatcttaccaaagcggagcggggaggcctgacatctgatgacaaggcccgctttatccagagacaactcgtggagacccggcagattacaaaacatgttgctcgcatcctggacgaaagattcaacaatgagctcgatagcaaggggcggagaatccgcaaggtgaaaattgtcaccctgaagtccaaccttgtgagcaactttcggaaagagttcggattttataagatcagagaagtgaataactaccaccatgcccacgacgcttacctgaatgccgttgtcgccaaagctattctcacgaagtatccccagctggaacctgagttcgtgtacggcgattatccgaagtacaactcttataaaacccgcaagtccgcgacagagaaactgtttttctacagcaatatcatgaactttttcaagaccaaagtgacacttgccgacgggaccgtcgtggttaaggatgacattgaagtgaataacgatacgggagagatcgtctgggacaagaaaaagcacttcgctacagtgcggaaagttctgtcctatccccagaataacatcgtgaagaaaaccgaaattcaaacaggcgggttttctaaggagagcatcctcgcccatggcaattccgataaactgattcctagaaagaccaaggacatctacctcgatcccaaaaagtacggaggcttcgactctcctattgtcgcctatagcgtgctggttgtggctgatatcaaaaaggggaaagcccagaaacttaagaccgtcacagaactgctcggaatcacgattatggagcgctcccggtttgagaaaaacccctctgcgttcctggaaagcaagggctacctgaatatcagagctgacaaacttattatcctgccgaagtattccctctttgagctggaaaacgggcgccggagactcctggccagcgccggagagcttcagaaaggcaatgagctggctctgcctacccagttcatgaagtttctctacctggcctctcggtataacgaatccaaggggaaacccgaggaaattgagaagaaacaagaatttgtgaaccagcacgtgagctactttgacgatatccttcagctgattaatgacttctctaagcgcgtcatcctcgcggatgctaacctggagaaaatcaataagctctatcaagacaacaaggagaatatttccgttgatgaactggccaacaatatcattaacctttttacattcaccagcctgggcgcccctgctgcctttaaattcttcgacaagatcgtggatagaaaacggtacacatctaccaaggaggtgctcaattccacgctgattcatcagagcatcacaggactgtacgaaacccgcatcgaccttggcaaactgggggaggattga

SEQ ID NO: 4301 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctatcattacagatgactataaagtccctgccaagaaaatgagagttctcggcaacacggataaggagtacatcaaaaagaatctgattggggctctgctgttcgacggaggcaacaccgccagcgatcggcgcctcaagagaacagcgcggcgcagatatacccggcgcagaaatcggatcctgtaccttcaggaaatctttgctgaggaaatgtccaaagtggacgattctttctttcaccgcctggaggacagcttcctcgtggaagatgacaagagagggtccaaatatccgatttttgccacaatgcaagaggagaaggattaccatgaaaaattccccaccatctatcatctgcggaaggagctggccgacaagaaagaaaaggctgatctccgcctgttttaccttgccctggctcacattatcaaattcagaggacactttctcattgaggacgactctttcgatgtccggaacacagacatccagcgccagtaccaggcctttctggagattttcgataccacgtttgaaaataaccatcttctgagccaaaatatcgacgtggagggcatcctcaccgataagatttccaaaagcgcgaagaaagacagaatcctggcccagtatcctaaccagaagtctacaggcattttcgctgaatttctgaagctcatcgttgggaatcaggccgattttaaaaagcacttcaacctggaggacaaaacaccccttcaatttgctaaggattcctacgacgaagatctggagaatctcctgggacagattggcgacgagttcgccgacctttttagcgtggcgaaaaagctgtatgattctgtcctcctgtccgggatcctgaccgtgaccgacctcagcacgaaggcccctctgtctgcttccatgatccagcggtacgatgaacacagagaggaccttaaacagctgaagcaattcgttaaagccagcctccccgaaaagtatcaggagatttttacagattcctctaaagacggatacgctggctatatcgaagggaagaccaaccagggagccttctacaagtacctgagcaaacttctgacaaagcaagagggctccgagtattttctcgaaaagattaagaatgaggatttcctgcgcaaacagcggacctttgacaacggcagcatccctcatcaggtgcacctgaccgaactcaaggccattatcagacgccagtctgagtactatccgttcctgaaggaaaaccttgatcggatcgagaaaattctgacatttagaatcccctactatgtcgggcctctcgctcgcgagaagtccgacttcgcgtggatgacgcggaaaaccgatgacagcattagaccctggaatttcgaggaactggtggataaggaagcctctgctgaggcctttatccatcgcatgacaaacaatgacctgtaccttcctgaggaaaaagtgctccccaagcacagcctgatttatgagaaattcaccgtctacaacgaactgacaaaggttcggtacaagaatgagcaaggagaaacctatttcttcgactccaacatcaaacaggagatttttgatggcgtgttcaaggagcacagaaaagtgtctaagaaaaagctcctggactttcttgccaaggaatacgaggagttccgcatcgtcgatgtgatcgggctggacaaagaaaataaggcttttaacgccagcctcggaacgtatcatgatctgaaaaagattctggacaaagatttccttgacaatccggataacgaatccatcctcgaggacattgttcagacactgaccctgtttgaggatcgggaaatgatcaagaagagactcgagaattacaaagacctgttcaccgaaagccagcttaagaaactgtatcggcgccactacacaggctgggggagactctctgcgaagctgattaacggaatccgggataaagagtcccaaaagaccatcctggactatcttattgacgatggcaagagcaatagaaactttatgcagctcatccatgacgatggcctgtctttcaaatccattatcagcaaggctcaggccgggtcccactctgacaatctgaaagaagtggtcggagagctcgccggcagccctgctattaagaaagggatcctgcagtcccttaagatcgtggatgagctggttaaagtgatgggatacgaacccgagcaaattgtcgtggaaatggcccgcgagaaccagacaacgaaccagggccggagaaattctcgccagagatacaagctcctggacgatggggtcaagaacctggctagcgaccttaatggcaacatcctcaaagagtatcctaccgataatcaagccctgcagaacgaacggctgttcctctactatctgcagaatggacgcgacatgtacacaggcaaggcgcttgatattgacaacctgtcccaatatgacatcgatcatattatcccccaggcctttatcaaagacgatagcattgacaatagagtgctcgtttcttccgctaagaaccgggggaaaagcgatgacgtgccctctctggagatcgtcaaggattgcaaggtgttctggaaaaagctgcttgacgccaaactgatgtcccagcgcaagtacgataatctcaccaaagctgaaagaggaggcctgacaagcgacgataaggcccggtttattcagcgccaactcgttgagaccagacagatcacgaagcacgtggcgcggattctggacgaacgcttcaacaatgagcttgattctaaagggagacggatcagaaaggtcaaaattgtgacccttaagagcaacctcgtgtccaattttcgcaaagagttcggattttataagatccgggaagttaacaactaccaccatgcccacgacgcttacctgaatgccgtcgtggctaaggccatcctgacaaaatatcctcagcttgagccggagttcgtgtacggcgactatcccaagtacaacagctataaaaccagaaagtctgccacagaaaaactgtttttctactccaatattatgaactttttcaagaccaaggtcacgctcgctgatgggacagtggttgtgaaagacgatatcgaagtcaataacgacaccggcgagattgtgtgggataagaaaaagcatttcgcgacagttcgcaaagtgctgagctatcctcaggtcaatatcgtgaagaaaaccgagattcaaaccggaggcttttccaaggaatctatcctcgcccacgggaacagcgacaagctgatcccccggaaaacaaaggatatttaccttgaccctaaaaagtacggaggcttcgattcccccatcgttgcttattctgtgctggtcgtggccgacattaaaaaggggaaggcccagaaactcaagacggtgaccgagctgctgggaatcacaattatggaaagaagccgctttgagaaaaatccgtccgctttccttgaatctaagggctacctgaacatccgggatgacaaactcatgatcctgcctaagtatagcctctttgagctggagaatgggagacgccggcttctggcctccgcgggcgaactgcagaagggaaacgagctcgctctgcccacccagttcatgaaatttctttacctggccagcagatataatgaactcaagggcaaacctgaggagattgaacaaaagcaggagttcgtcgttcagcacgtgtcttactttgatgacatcctgcaaattatcaacgacttctccaatcgggtgattctcgccgatgctaacctggagaaaatcaacaaactttatcaggacaataaggaaaacattagcgtcgatgaactggccaataacatcatcaatctgtttacattcacctctctcggggcgcccgctgcctttaaattcttcgacaagattgtggatcgcaaaagatacacgtccacaaaggaggttctgaacagcacccttatccatcagtctattaccggactgtacgagacacggatcgacctcggcaaactgggggaagattga

SEQ ID NO: 4302 - RNA, 4113 nt, synthetic construct
  misc_feature 1..4113: note = Cas9 variant
  source 1..4113: mol_type = other RNA
atgaacaagccctacagcatcggcctggacattgggaccaattccgtgggatggtctatcattacagatgactataaagtccctgccaagaaaatgagagttctcggcaacacggataaggagtacatcaaaaagaatctgattggggctctgctgttcgacggaggcaacaccgccgcggatcggcgcctcaagagaacagctcggcgcagatatacccggcgcagaaatcggatcctgtaccttcaggaaatctttgccgaggaaatgagcaaagtggacgattccttctttcaccgcctggaggactctttcctcgtggaagaggataagagagggagcaaatatccgatttttgccacaatgcaagaggaaaagtactatcatgagaaattccccaccatctaccatctgcggaaggaactggctgacaagaaagagaaggccgatctccgcctgatttaccttgctctggcccacatcattaaatttagaggacacttcctcatcgaggacgatcggtttgacgtccgcaacacagacattcagaagcagtatcaggcgttcctggaaatctttgataccacgttcgagaataacgaccttctgtcccaaaatgtggatgttgaagccatcctcaccgacaaaatttctaagagcgctaaaaaggatagaatcctggcccggtaccctaaccagaagtccacaggcatttttgctgagttcctgaaactcatcgtgggcaatcaggccgacttcaagaaacattttaacctggaagataagacaccccttcagttcgcgaaagacagctatgatgaggacctggagaatctcctggggcaaattggagatgaatttgccgaccttttctctgctgccaagaagctgtacgactccgtcctcctgagcggcatcctgaccgtgaccgatctctctacgaaagctcctctgtccgccagcatgatccagcactatgacgagcacagagaagatcttaagcagctgaaacagtttgttaaggcctctctccccgagaaataccaagaaattttcgctgactccagcaaggatgggtatgcgggatacatcgagggcaagacaaaccaggaggccttttacaaatatctgtccaaacttctgaccaaacaggaagggtctgagtacctcctggaaaagattaaaaatgaggacttcctgcgcaagcaacggacatttgataacggaagcatccctcatcaggtgcacctcaccgaactgagagctattatccgccggcagtccgagtattacccgttccttaaggagaacctggacagaatcgaaaagattctcacctttcgcatcccctattacgtcggccctctggcccgggaaaagagcgatttcgcctggatgacaagaaaaacggacgattctattcgcccctggaattttgaagacctggtggataaggagaaatccgctgaggccttcatccatcggatgaccaacaatgacctttatctccctgaagagaaggtgctgcccaaacacagcctgatttacgaaaagttcacagtctacaacgagctcaccaaggttagatttctggcggaaggcttcaaagactttcagttccttaatcgcaagcaaaaagagacaatctttaactctctgttcaaggagaaacggaaggtgaccgaaaaggatattatcagctttctcaataaagtggacgggtatgagggaatcgctattaagggcatcgaaaaacagttcaacgcctccctgtctacgtaccacgatctgaagaaaattcttgggaaggactttctcgataatacagacaacgagctgatcctggaagatattgtccagaccctcaccctgttcgaggacagagagatgatccggaagcgccttgatatctataaagactttttcacagaaagccagctgaagaaactctacagacggcattataccggatggggcagactgtccgccaagctgattaatgggatccgcaacaaagagaatcaaaagacaattcttgattacctcatcgacgatggaagcgctaaccggaattttatgcagctgattaaggacgccggcctgtctttcaaaccgatcatcgacaaggctagaacgggctcccacagcgataacctcaaagaagtggttggggagctggccggatctcctgcgattaagaaaggcatccttcagtccctgaagattgtggacgaactcgtcaaagtgatggggtatgagcccgagcagatcgttgtggaaatggcccgcgagaaccaaaccacagctaagggactgagcagatcccggcagcgcctgaccacacttagagaatctctcgccaatcttaagagcaacattctggaggagaaaaagcctaaatacgtcaaggatcaggtggaaaatcatcacctctccgacgatcggctgttcctttactatctgcagaacggcaaagacatgtacaccgatgacgagctcgatatcgacaatctgtctcaatatgatatcgaccatattatcccccaggcttttattaaggacgatagcatcgacaaccgcgtcctggtgtccagcgccaagaatagagggaaatctgatgacgttccctccgtggaaattgtcaaggattgcaaagtgttctggaagaaacttctggacgcgaagctcatgagccagcggaagtacgataacctgacgaaagccgagcgcggcggactcacctctgacgataaggctagatttatccaacggcagctggttgaaacacgccagattaccaaacacgtggccagaatccttgacgagcggttcaataacgagctggattccaagggcagacgcatccggaaagtcaagattgtgacactcaagagcaatctggtgtctaactttagaaaagaatttgggttttataagatccgcgaggttaataactaccaccatgctcacgacgcctatctgaatgccgtcgtggctaaagcgattcttaccaagtaccctcagctggaaccggagttcgtgtacggagattatcccaaatacaacagctataagacgcggaagtccgccacagaaaaactctttttctacagcaacatcatgaatttcttcaagaccaaagtcacactggctgacggcaccgtggttgtgaaggacgatattgaggtcaacaatgacaccggggagatcgtgtgggataaaaagaaacatttcgccacagttagaaaggtgctctcttatcctcaagtcaacatcgtgaagaaaacggaaattcagaccggaggcttttccaaggagagcatcctggcccacggcaattccgacaaacttattccccgcaagacaaaagatatctacctggaccctaagaagtatgggggattcgattctcccattgttgcttacagcgtgctcgtcgtggccgacatcaaaaagggcaaagcgcagaagctgaaaaccgtgacagaactgcttgggatcaccattatggagcggtccagatttgaaaagaacccgtctgctttcctggagagcaagggatacctcaatatccgcgatgacaaactgatgattctccctaagtattccctgtttgagcttgaaaacggccggagacggctgctggcctctgccggggagctccagaaaggaaatgaactggcccttcccacgcaattcatgaagtttctgtacctcgctagccgctataacgagctgaaaggcaagcctgaggaaatcgagcagaagcaggagttcgtcgttcagcacgtgtcctactttgatgacattctccaaatcattaatgatttcagcaacagagtgatcctggcggacgctaatcttgagaaaatcaacaagctgtatcaggacaataaagaaaacattcccgtcgatgagctggccaacaatatcattaacctctttacattcacctctctgggggcccctgctgcctttaagttcttcgacaaaatcgtggatcggaagcgctacacctccacaaaagaggttcttaatagcaccctgattcatcagtctatcacaggcctctatgaaacgagaatcgacctgggaaagctcggcgaggattga

SEQ ID NO: 4303 - RNA, 4116 nt, synthetic construct
  misc_feature 1..4116: note = Cas9 variant
  source 1..4116: mol_type = other RNA
atgaaggtgaacaattaccacatcggcctggacattgggaccagctccatcggatgggtcgccattggcgaggatgggaaacccctcagaatcaagggaaaaacagctattggcgcccggctgttccaggaagggaaccctgcggctgaccgcagaatgtttcggacgacccgcagacggctttctcgcagaaagtggcggctgaaactcctggaggaaatcttcgatccgtatatcacacccgttgacagcacctttttcgcccgccttaagcaatccaatctgtctcctaaggatagcagaaaagagtttaagggatccatgcttttccccgacctgacagatatgcagtaccataaagactatcctaccatttaccatctgcggcacgccctcatgacacaggatgaaaagtttgacatccgcatggtgtatctggctattcaccatatcgtgaaatacagaggcaacttccttaattctacccccgtcgatagctttaaggcctccaaggtgaacttcgttgaccagtttaaaaagctgaatgagctctatacggctattaaccctgaggaatccttccaaatcaatctggccaactctgaggatattggccaccagtttcttgacccgtccatccggaaattcgacaagaaaaagcagatccccaaaattgtgcctgtcagcgtggatgacaaggcgaccgataagatcaatgggaaaattgcctctgaaatcattaacgctatcctgggatacaagtccaaactcgacgttgtggtccagtgcacacccgtggatagcaagtcttgggccctgaaattcgacgaggaggatatcgacgctaagctgcaaaagattctccctgaaatggatgagaatcagcagtccatcattgccatcctgcagaacctttacagccaagtgaccctgaatcagattgtccccaacggcatgtccctctctgaaagcatgatcgagaaatataacgaccaccatgatcacctgaagctctacaaaaagatcattgaccagctggcggacccgaaaaagaaggccgctctcaaaaaggcctattcccaatacgttggggatgacggaaaagtgatcgaacaggctgatttttggagctctgtgaagaaaaatctggacgattccgacctgagcaagcagattatggatctcatcgacgccgagaagttcatgcctaaacagcgcacatctcaaaacggcgtcattccccatcagctgcaccagagagagcttgatgaaatcattgagcaccagagcaagtattacccttggctggccgaaatcaatcccaacaaacatgacctccacctggctaagtataaaatcgaggaacttgtggcgtttcgggttccctactacgtggggcctatgattaccccggatgaccaagccaagtccgctgagacggtcttctcttggatggagagaaaaggaaaggaagccggccagatcacaccctggaattttgatgagaaggtggaccgcaacgccagcgctaatcggttcattaaaagaatgaccacaaaggacacctatctgatcggcgaagatgttctccctgacgagtccctgctgtacgaaaaatttaaggtgctcaacgagctgaatatggtccgcgtgaacgggaaacttctgaaggtcgccgataagcaggcgattttccaggacctctttgagaattataaacatatcagcgtgaagaaactgcaaaactacatcaagtctaaaaccggactgccctccgatcctgaaattagcggcctttctgaccccgagtatttcaataactccctcgggacatacaatgattttaagaagctgttcggaaacaaagttgacgaaccggatctgcaggacgattttgagaagatcgtggagtggagcacggtcttcgaagacaaacggattctcagagagaagctgaacgaaatcacctggctttccgatcagcagaaagacgtgctggagtctagccgctatcaaggctgggggcggctctccaagaagctgctgacaggaattgttaatgaccagggcgaaagaatcatcgatgagctttggaacaccaataaaaacttcatgcagattcaatctgacaatgattttgctaagcgcatccacgaggccaacgccgaccagatgaaagctgtggatgtcgaagacgtgctcgccgatgcttacacaagccctcagaataagaaagccattagacaggtggttaaggtcgtggacgatatccaaaaagcgatgggcggggtggcccccaagtacatttccatcgagttcacccggagcgaagaccgcaaccctcggagaacgatctctcggcagcgccagctggagaatacactgaaggataccgctaaatccctcgccaagagcattaaccccgaactgctttctgagctggacaatgctgccaaatccaagaaaggactcaccgacagactgtatctgtactttacacagcttggcaaggatatctataccgggaagcctattaacatcgacgagattagcacatacgatatcgaccatattctcccccaagcgttcgtcaaagatgactctctgaataaccgggtgctggttagcaaggccatcaataacggaaaatccgataacgtgccggtccagctctttggcgctaagatggggcacttctggaaacagctggccgaagctggccttatcagcaagagaaagctgaaaaatctccagacggaccctgataccatttctaagtatgccatgcacggatttatccgccggcaactggtggagacatcccaggttattaaactggtggccaacatccttggcgacaagtacagaaatgataacaccaaaattatcgaaatcacagctcgcatgaatcatcagatgagagacgagttcgggtttattaagaaccgggaaatcaatgattatcaccatgcgttcgacgcctacctcaccgcttttctgggacgctacctgtatcacagatacattaagctccggccctatttcgtctacggcgactttaaaaagttcaaagaggataaggtgacgatgcgcaacttcaattttctgcacgaccttaccgatgacacacaagagaaaatcgccgatgccgaaaccggggaggttatttgggacagagaaaacagcatccagcagctgaaggatgtgtatcattacaagttcatgctcatctcccacgaggtctatacactgcggggagctatgtttaatcagaccgtgtaccccgcctctgacgcgggcaaacgcaagctgattcctatcaaagctgatagaccgattaacgtgtacgggggctatagcggatccgccgacgcctacatggctatcgtccggattcataataagaaaggcgataagtatcgcgttgtgggggtgcccatgagagcccgggacagacttgatgcggctaaaaaggtctctgacgccgactgtgatcgcgccctgaaggacgtgctcacgcctcaactgacaaaaaccaagaaaagccggaagacaggagagatcacccaggttgtggaagatttcgagattgtcctcggcaaagtgatgtacagacagctgatgatcgacggggataagaagtttatgcttggatcctctacctatcagtacaacgctaaacaactggttctcagcgaccagtccgtgaagacactggccagcaaaggccgcctggatccccttcaggaatctatggactataataacgtctacacggagatcctggataaggtgaaccagtacttctccctctatgacatgaataaatttcggcacaagctgaacctcgggttcagcaagtttatttctttccctaatcataacgtttttgatggcaataccaaagctagcagcggaaagagagaaatcctggaggaggtgcttaacggcctgcacgccaatcccacattcgggaacctcaaagacattggaatcaccacacctttcggccaactgcagcagcccaatgggattctgctttctgacgaagcgaagatccgctaccagtccccgaccggactgtttgagcggacggtcagcctcaaagatctgtga

SEQ ID NO: 4304 - RNA, 4116 nt, synthetic construct
  misc_feature 1..4116: note = Cas9 variant
  source 1..4116: mol_type = other RNA
atggacaagaaatacagcatcggcctggatattgggaccaactccgtgggatgggccgtcatcacagacgattataaggttccctctaaaaagttcaaagtgctcggcaatacggacagacacagcattaagaagaacctgatcggggcccttctgtttgattccggagagaccgccgaagcgacacggctcaaacgcaccgctagacggcgctacacaagacggaagaatcgcattagatatctgcaggagatcttctctagcgaaatgtccaaagtggacgattcctttttccatcggcttgaggagagctttctggtcgaagaggacaagaaacacgaacgccatcctatcttcggcaacattgtggatgaggttgcctaccacgaaaagtatccgaccatctaccatctcagaaagaaactggccgactccacagataaggctgacctgcggctcatttatctggcccttgctcacatgatcaaatttcgcgggcacttcctgattgagggagatctcaatcccgacaacagcgacatggataagctgtttatccaacttgtgcagacctacaatcagctgttcgaggaaaaccctattaatgcctctagagtcgacgcgaaagccatcctctccgctcggctgagcaagtctcgcagactggagaacctcatcgcccagctgcccggcgaaaaacggaatggcctttttgggaacctgattgctctctccctgggacttacgcctaatttcaagagcaactttgatctggccgaggacgcgaagctccaactgtctaaagatacctacgacgatgacctggataatctcctggcccagatcggcgaccagtatgctgatcttttcctggccgctaagaacctctccgacgccattctgcttagcgacatcctgagagtgaactccgaaattacaaaagctcccctctctgctagcatgatcaagcgctacgatgagcatcaccaggacctgaccctgctcaaagcgctggttcggcaacagcttcctgagaagtataaggaaatcttctttgatcagtccaaaaatgggtacgccggatatattgacggcggggctagccaggaggagttctacaagtttatcaaaccgattctggaaaagatggatggaacagaggaactcctggccaaactgaacagagaggaccttctccgcaagcaacggaccttcgataatggctctatcccccatcagattcacctgggcgaactgcacgccatcctcagacgccaggaggacttttatcctttcctgaaggataaccgggaaaagatcgagaagattcttacgtttagaatcccctactacgtggggcctctggctcgcggaaattcccggttcgcctggatgacaagaaaaagcgaagagaccattacaccctggaactttgaggaagtcgtggacaagggcgcgtctgctcagagcttcatcgagcgcatgaccaattttgataaaaacctcccgaatgaaaaggtgctgcctaagcattccctgctttatgagtacttcaccgtctataacgagctcacaaaagttaagtacgtgacggaagggatgcggaaacccgagtttctgtctggaaagcaaaaagaagccattgtggacctcctgttcaagaccaatagaaaagtcacagtgaagcagctgaaggaggattatttcaaaaagatcgaatgctttgacagcgttgagatttccggcgtggaggaccggttcaacgccagccttgggacctaccacgatctgctcaaaatcatcaaggacaaagattttctggacaatgaagagaacgaagatattctggaggacatcgtccttacactcaccctgttcgaagataaggagatgattgaggaacgcctgaagaaatatgctaatctctttgacgataaggtgatgaaacagctgaagagacggcattacacgggatggggcagactttctcgcaaactgatcaacggcattcgggacaagcaatccgggaagacaatcctcgatttcctgaaaagcgacggatttgccaacagaaatttcatgcagctgatcaacgatgactctcttacctttaaggaggctattcagaaagcccaggtttccggccaagggcacagcctccatgaacagatcgcgaatctggccggatcccctgctattaagaaaggcatcctgcagtctgtgaaggtcgtggacgagctcgtcaaggtgatggggcacaaacccgaaaacattgttatcgagatggcccgcgagaatcagaccacacaaaagggccagaaaaacagcagagaacggatgaagcgcatcgaggaaggaattaaagagctgggctcccagatccttaaggagcaccccgtggaaaatacccagctgcaaaacgagaaactctacctgtattacctgcagaatgggagagatatgtatgtcgaccaggaacttgatattaaccggctgtctgactacgatgtggaccatatcgttcctcagagcttcattaaggatgactccatcgataataaggtgctcacacgcagcgacaaaaacagaggaaagtctgataatgtcccgtccgaggaagtggtgaaaaagatgaaaaactattggcggcaactgctcaatgctaagctgatcacgcagcgcaagtttgacaaccttaccaaagccgagagaggcgggctgagcgagctcgacaaggcgggattcattaaacggcagctggttgaaacacgccaaatcaccaagcacgtcgcccagattctggattctagaatgaacacaaaatacgacgagaatgataaacttatccgggaagtgaaggtgattaccctgaaatccaagctcgtcagcgactttagaaaagatttccagttctataaggtgcgcgagatcaacaattaccatcacgctcacgacgcctacctgaacgctgttgtgggcacggccctcattaaaaagtatcccaagctggaatctgagtttgtctacggggattataaagtgtacgacgttcggaagatgatcgccaaaagcgagcaggaaatcggcaaggctaccgcgaaaagattcttttattccaatattatgaacttctttaagacagagatcacccttgccaatggagaaattcgcaagcggcctctgatcgagacaaacgaagagaccggcgagattgtgtgggataaagggagagacttcgctacggtccgcaaggtgctcagcatgccccaagttaatatcgtgaaaaagacagaagtccagaccggagccctgacaaacgagtctatctacgcccggggctcctttgataaactgattagcagaaagcatcgcttcgaatcctctaaatatgggggatttggcagccctaccgtgacctactccgtgcttgtcgttgctaagtctaaggtgcaggacgggaaagtgaagaaaatcaagacaggcaaagagctgattggaatcacgctcctggataagctcgtcttcgagaagaatcccctgaaatttattgaagacaagggctacgggaacgtgcagatcgacaaatgcatcaaacttccgaaatatagcctgttcgagttcgaaaatggaacccggagaatgctggcctccgttatggcgaacaataactctcggggcgatctccaaaaggctaacgagatgtttctgcctgccaaacttgtgacactgctctaccacgcccataagattgaaagctccaaggagctggagcacgaggcttatatcctcgaccattacaatgatctgtatcagcttctgagctacattgaacgcttcgcctctctgtatgtcgacgtggaaaagaacatctccaaggttaaagagctctttagcaatattgaatcttactccatcagcgagatttgttcttccgtgatcaacctgcttaccctgacagcgagcggggctcccgccgatttcaagtttctcggaaccacgatccctagaaagcggtacggctctccccagagcattctgtctagcacactcatccaccaatccattaccgggctgtatgagacccgcatcgacctttctcagctgggcggagattga

SEQ ID NO: 4305 - RNA, 4116 nt, synthetic construct
  misc_feature 1..4116: note = Cas9 variant
  source 1..4116: mol_type = other RNA
atggacaagaaatacagcatcggcctggatattgggaccaactccgtgggatgggccgtcatcacagacgattataaggttccctctaaaaagttcaaagtgctcggcaatacggacagacacagcattaagaagaacctgatcggggcccttctgtttgattccggagagaccgccgaagcgacacggctcaaacgcaccgctagacggcgctacacaagacggaagaatcgcattagatatctgcaggagatcttctctagcgaaatgtccaaagtggacgatagctttttccatcggcttgaggaatcttttctggtcgaggaggacaagaaacacgaacgccatcctatcttcggcaacattgtggatgaggttgcctaccacgaaaagtatccgaccatctaccatctcagaaagaaactggccgactccacagataaggctgacctgcggctcatttatctggcccttgctcacatgatcaaatttcgcgggcacttcctgattgagggagatctcaatcccgacaacagcgacatggataagctgtttatccaacttgtgcagacctacaatcagctgttcgaggaaaaccctattaatgcctctagagtcgacgcgaaagccatcctctccgctcggctgagcaagtctcgcagactggagaacctcatcgcccagctgcccggcgaaaaacggaatggcctttttgggaacctgattgctctctccctgggacttacgcctaatttcaagagcaactttgatctggccgaggacgcgaagctccaactgtctaaagatacctacgacgatgacctggataatctcctggcccagatcggcgaccagtatgctgatcttttcctggccgctaagaacctctccgacgccattctgcttagcgacatcctgagagtgaactccgaaattacaaaagctcccctctctgctagcatgatcaagcgctacgatgagcatcaccaggacctgaccctgctcaaagcgctggttcggcaacagcttcctgagaagtataaggaaatcttctttgatcagtccaaaaatgggtacgccggatatattgacggcggggctagccaggaggagttctacaagtttatcaaaccgattctggaaaagatggatggaacagaggaactcctggccaaactgaacagagaggaccttctccgcaagcaacggaccttcgataatggctctatcccccatcagattcacctgggcgaactgcacgccatcctcagacgccaggaggacttttatcctttcctgaaggataaccgggaaaagatcgagaagattcttacgtttagaatcccctactacgtggggcctctggctcgcggaaattcccggttcgcctggatgacaagaaaaagcgaagagaccattacaccctggaactttgaggaagtcgtggacaagggcgcgtctgctcaatccttcatcgagcgcatgaccaattttgataaaaacctcccgaatgaaaaggtgctgcctaagcattccctgctttatgagtacttcaccgtctataacgagctcacaaaagttaagtacgtgacggaagggatgcggaaacccgagtttctgtctggaaagcagaaagaagccattgtggacctcctgttcaagaccaatagaaaagtcacagtgaagcagctgaaggaggattatttcaaaaagatcgaatgctttgacagcgttgagatttccggcgtggaggaccggttcaacgccagccttgggacctaccacgatctgctcaaaatcatcaaggacaaagattttctggacaatgaagagaacgaagatattctggaggacatcgtccttacactcaccctgttcgaagataaggagatgattgaggaacgcctgaagacgtatgctcatctctttgacgataaagtgatgaagcagctgaaaagacggcactacacaggatggggcagactttctcgcaagctgatcaatggcattcgggacaaacaatccgggaagaccatcctcgatttccttaagagcgacggatttgccaacagaaacttcatccagctgattcatgatgactctctgacctttaaagaggctatccagaaggcccaggtttccggccaagggcacagcctccacgaacagattgcgaatctggccggatcccctgctatcaaaaagggcattctgcagtctgtgaaagtcgtggacgagctcgtcaaggtgatggggcataagcccgaaaacatcgttatcgagatggcccgcgagaatcagacaacccaaaaaggccagaagaacagcagagaacggatgaaacgcattgaggaaggaatcaaggagctgggctcccagattcttaaagagcaccccgtggaaaatacacagctgcaaaacgagaagctctacctgtattacctgcagaatgggagagatatgtatgtcgaccaggaacttgatatcaaccggctgtctgactacgatgtggaccatattgttcctcagagcttcatcaaagatgactccatcgataataaggtgctcacgcgcagcgacaagaacagaggaaaatctgatgacgtcccgtccgaggaagtggtgaagaaaatgaagaattattggcggcaactgctcaacgctaaactgattacccagcgcaagtttgacaatcttacaaaggccgagagaggcgggctgagcgagctcgataaagcgggattcatcaagcggcagctggttgaaacccgccaaattacaaaacacgtcgcccagatcctggactctagaatgaacaccaagtacgatgagaatgacaaacttattcgggaagtgaaggtgatcacgctgaagtccaaactcgtcagcgattttagaaaggacttccagttctataaagtgcgcgagattaacaactaccaccatgctcacgatgcctacctgaatgctgttgtgggcaccgccctcatcaagaaatatcccaagctggaatctgagtttgtctacggggactataaggtgtacgatgttcggaaaatgatcgccaagagcgagcaggaaattggcaaagctacagcgaagagattcttttattccaacatcatgaatttctttaaaaccgagattacacttgccaacggagaaatccgcaagcggcctctgattgagaccaatgaagagacgggcgagatcgtgtggaacaaggggagagacttcgctacagtccgcaaagtgctcagcatgccccaagttaatatcgtgaagaaaaccgaagtccagacaggagccctgaccaacgagtctatttacgcccggggctcctttgataagctgatcagcagaaaacatcgcttcgaatcctctaagtatgggggatttggcagccctaccgtgacatactccgtgcttgtcgttgctaaatctaaggtgcaggacgggaaggtgaaaaagattaaaacgggcaaggagctgatcggaattaccctcctggataaactcgtcttcgagaagaatcccctgaagtttatcgaagacaaaggctacgggaacgtgcagatcgacaagtgcattaaacttccgaagtatagcctgttcgagttcgaaaatggaacacggagaatgctggcctccgttatggcgaacaataactctcggggcgatctccaaaaagctaatgagatgtttctgcctgccaaacttgtgaccctgctctaccacgcccataagatcgaaagctccaaagagctggagcacgaggcttatattctcgaccactacaacgatctgtatcagcttctgagctacatcgaacgcttcgcctctctgtatgtcgacgtggaaaagaacatttccaaagttaaggagctctttagcaatatcgaatcttactccattagcgagatctgttcttccgtgatcaacctgcttacactgaccgcgagcggggctcccgccgatttcaaatttctcggaacgacaattcctagaaagcggtacggcagcccccagagcatcctgtctagcaccctcattcatcaatccatcaccgggctgtatgagacacgcattgacctttctcagctgggcggagattga

SEQ ID NO: 4306 - RNA, 4116 nt, synthetic construct
  misc_feature 1..4116: note = Cas9 variant
  source 1..4116: mol_type = other RNA
atgaacaataacaattacagcatcggcctggacattgggaccaactccgtgggatgggccgtcatcacagatgactataaggttccctctaaaaagatgagagtgctcggcaatacggataaacggttcattaagaaaaacctgatcggggcccttctgtttgacgagggaaccacagctgaagatcgcagactcaagcggaccgcgcgcagacggtacacacgcagaaagaatcggctgcgctatcttcaggagattttcgctgaagagatgagcaaagtggactcctctttcttccacagactggatgacagctttctcgtccctgaagataagtccggctctaaatacccgatcttcgccaccctggccgaggagaaggaatatcataaaaagtttcccacaatctaccatctgcggaagcacctcgctgacagcaaagagaaggccgatctgcgccttatttatctggctctcgcccacatcaccaaatacagagggcatttcctgtacgaagaggcgtttgacattaagaacaatgatatccaaaagattttcaacgagtttatcaatatttatgacaacacgttcgaaggatccagcctttctggccagaatgcccaggtggaggctatctttaccggcaagatctccaaaagcgttaagcgggaacacgtgctgaaactcttccctgacgagaaatctacagggctgttctccgaatttctgaagctcattgtcggaaaccaggccgatttcaaaaagcactttgacctggaggagaaagctagccttcaattctctaaggatacctacgacgaagatctggagaatctcctgggccagatcggggacgattttgccgaccttttcctggtggcgaagaaactctatgatgccattctgctgtccggaatcctcacagttaccgaccccagcacgaaggctcctctgtccgcctctatgattgaacgctacgagaaccatcaggaagatcttgctgccctgaaacagtttatcaagaacaatctccccgagaaatatgccgaggtgttcagcgaccaatccaaggacggctacgctgggtatatcgatggaaagacaacccaggaagcgttttacaaatacattaagaacctgcttagcaaattcgagggcgccgactattttctggataagatcgaaagagaggacttcctccggaaacagagaacatttgataatggctctattcctcaccagatccatctgcaagaaatgaacgctattctgcgccggcagggggagcactacccgctcctgaaggagaataaggagaaaatcgaaaagatccttaccttccgcattccctattacgtcggacctctggccagaggcaaccgggacttcgcctggctcaccagaaattccgatcaggctatccgcccctggaactttgaagagattgtggacaaagccagctctgcggagagcttcatcaataagatgacaaactatgatctgtacctgcctgaagagaaagtgcttcccaagcactccctcctgtatgaaacgtttgctgtctacaatgagctgaccaaagttaagttcattgccgaagggctccgggactaccaatttttcgattctggacagaagaaacagatcgtgaaccagctgtttaaggagaaaagaaaggtgacagagaaagacattatccattatcttcacaatgtcgatggctacgacgggatcgaactgaagggaattgagaagcaattcaacgccagcctctccacctatcatgacctgctgaaaatcattaaggataaagaatttatggacaatcacaagaaccaggagatccttgaaaacattgtgcatacactcaccatcttcgaggatcgcgagatgatcaaacagcggctggctcagtacgacagcatttttgatgaaaaggttatcaaggccctgacgagacgccactatacaggctggggcaaactctctgctaagctgattaatgggatctgcgacaaaaagaccggaaaaaccattcttgattacctgatcgacgatggctataacaatcggaacttcatgcaactcatcaatgacgatgggctgtcctttaaggagattatccagaaggcccaggtggtcggaaaaacagacgatctgacccaggtggttagagaacttagcggctctccggcgattaagaaagggatcctccaatccattaagatcgtggacgagctggtcaaaatcatgggctacgcccctgaaagcattgtgatcgagatggctcgggagaaccagacaacggccaagggaaagaaaaattcccagcagcgctacaagagaattgaagacgctctgaaaaacctcgcccccggcctggattctaccatcagcaaggagaatcctacagacaacattcaacttcagaatgatcggctgttcctctattacctgcagaacgggaaagacatgtataccggagaagcgctggatatcaatcaactttcctcttacgacattgatcacatcatcccccaggccttcattaaggacgatagcctcgacaacagagtcctgacatccagcaaagataatcgcggcaagtctgacaacgtgccctccctggaggttgtgaagaaacggaaggctttttggcagcagctcctggacagcaaacttatctctgagagaaagttcaacaatctgaccaaagccgaacgcgggggactcgatgagagagacaaggtcggctttattaagcggcaactggtggaaacgcgccagatcaccaaacatgttgctcggattctggatgccagattcaacacagaggtgtccgaaaagaatcagaaaatccgcagcgtcaagatcattacccttaaatctaacctggtgagcaattttagaaaggagttcaagctctataaagtgcgggagatcaacgactaccaccatgcccacgatgcttatctgaatgcggttgtcgccaaggctattctcaaaaagtaccctaaactggaaccggagtttgtgtacggggactatcagaagtacgatcttaagcgctatatctccaaaagcaaggaccccaaagaagtggagaaggccacagaaaaatacttcttttattctaacctgctcaatttctttaaggaggaggtccactacgccgatggcaccattgtgaaaagagaaaacatcgagtattccaaggacacgggagaaatcgcttggaataaggagaaagatttcgttacaattaagaaagtgctgagctaccctcaagtcaacatcgtgaagaaacgggaagttcagaccggcgggttctccaaggagtctattctgcccaagggaaatagcgacaaacttatccctcgcaagacaaaagatattctgtgggacaccaccaagtacggcgggtttgactcccccgtgatcgcctattctattctcctgatcgcggatatcgagaaaggaaaggctaagaaactcaagacagtcaaaacgctggtgggcattaccatcatggaaaaggccgccttcgagaaaaacccgattacatttcttgaaaataaggggtaccataacgttagaaaggagaacatcctgtgtctccctaaatatagcctgttcgagctggaaaatggccggagacgccttctggcttccgccaaggagctccagaaaggaaacgaaattgtgctgcccgtctacctcaccacactgctttatcactctaagaatgtgcataaactggacgagcctgaacacctggagtacatccagaagcatcggtatgagtttaaagatctcctgaaccttgtgagcgaattttcccaaaagtacgtcctggcggaggctaatctcgaaaagatcaaaagcctgtacgttgacaacgagcaggccgatattgaaatcctcgccaattcttttattaacctgcttaccttcacggctctgggcgcccccgctgcctttaagttctttgggaaagacgtggatagaaagcgctatacaaccgtgtccgagatcctgaatgcgaccctcattcaccagagcatcacaggactgtacgagacccggatcgacctttctaaactgggcgaagattga

SEQ ID NO: 4307 - RNA, 4116 nt, synthetic construct
  misc_feature 1..4116: note = Cas9 variant
  source 1..4116: mol_type = other RNA
atgaccgagaagaactacagcatcggcctggacattgggacaaattccgtgggatgggccgtcatcacggatgactataaagttcccgctaagaaaatgaaggtgctcggcaacaccgataaaaagtacattaagaaaaatctgcttggggccctcctgttcgacaacggagaaacagcggaggctaccagactgaagcggacagcccgcagacggtatacccgcagaaagaatcggcttcgctacctgcaggaaatctttgccgaggaaatggctaaggtggatgagtctttcttttatagactcgacgagagcttcctgacaaccgatgacaaagattttgaacggcaccctattttcggcaacaaggccgacgagatcaagtaccatcaagaatttccgacgatctatcatctgcgcaaacacctcgctgattcccacgagaaggccgacctgagacttatttacctggcgctcgcccatatgatcaaattccgggggcactttctgattgagggagaacttaatgctgagaacaccgatgtccagaagctgttcgaagcctttgtggaggtttacgaccgcacattcgacgattctaatctcagcgaaatcaccgtggacgcttcctctattctgacagagaaatttagcaagtccagacggctggagaacctcatcaaacactatcccaccgaaaagaagaatacgctgttcggcaaccttgtcgccctggcgctcggcctgcagcctaatttcaaaaccagctttaaactttctgaggatgccaaactgcagttctccaaggacacatacgaagaggatctcgaggaactgattgggaaaatcggagacgagtatgctgatctgtttacaagcgccaagaacctctacgacgctatcctgctttctggcattctgaccgtggccgataataccacaaaggctcccctctccgccagcatgatcaaacgctataacgaacatcaagttgacctgaagaaacttaaggagttcattaaaaacaatgcgtctgataagtacgacgaaatctttaacgacaaggataaaaatgggtatgccggatacattgagaacggcgtgaagcaggacgagttctacaaatatctgaagacgaccctctccaaaatcgatgggagcgactactttctggataagatcgaaagagaggacttcctgcggaagcagagaacatttgataatggatccattcctcaccagatccatctccaagaaatgcacgctattctgcgccggcagggcgagcactatgccttccttaaagaaaaccaggccaagatcgagaaaattctgacctttagaatcccctactatgtcggccctctcgctcgcaaaaattctcggttcgcctgggcggagtaccatagcgacgaaaagatcacaccgtggaactttgatgagattatcgacaaggaaaaatccgctgagaagttcattaccagaatgacgctgaatgatctgtatcttcccgaagagaaggtgctccctaaacacagcctggtgtacgagacatacaccgtctataacgaactgaccaaggttaaatacgtgaatgagcaggggaagtctaacttctttgacgccaatatgaaacaagaaatcttcgagcatgtgtttaaggaaaaccgcaaggtcacaaaagataagttcctcaattatctgaacaaagagtttcccgagtaccggattcaggaccttatcggactggacaaggaaaacaaatccttcaatgccagcctcggcacctatcacgatctgaagaagattctggacaaatcttttcttgatgacaagacaaacgagacgatcatcgaagatattatccagaccctcacactgttcgaggacagagatatgattcgccaacggctgcagaaatacagcgacatctttacccctcagcagctcaagaaactggaaagacgccattatacagggtggggacggctttcctacaagctgattaatggcatcagaaacaaggagaatgggaaatctatcctcgattacctgattgacgatggatatgctaaccggaatttcatgcaactgatcagcgacgatacccttccctttaagcagattatcaaagacgcccagattatcggcgacatcgatgacgtgacgtccgttgtgcgcgagctcccgggcagccctgctattaagaaagggatcctgcagtctgtcaagattgtggatgaactggttaaagtgatgggacacaaccccgacaatatcgtcattgagatggccagagaaaaccaaaccacaaatcggggcagaaaccagtcccagcagcgcctcaagaagctgcaagatagccttaaagagctggggtctaatatcctcaacgaggaaaagccttcctacatcgagggaaaagtggaaaataaccatctgcaggacgatcggctgttcctttattacattcagaacggcaaggacatgtataccggggatgagctcgacatcgatcacctgagcgactacgacattgatcacatcattccccaggcgtttatcaaagacgattccattgacaatagagtcctgacatctagcgccaagaaccgcggcaagtccgatgacgtgccctctctcgatatcgttcatgacagaaaagctgattggatccggctgtataagagcggacttatttccaaacgcaagttcgacaatctgaccaaagccgaaagaggcgggctcacggagaacgataaggctggattcatcaagcggcaactggtggagacacgccagattaccaaacacgtcgcccagatcctggacagcagatttaatacagaacgggatgagaacgacaaggtgattcgcaatgttaaagtgatcacccttaagtctaacctggtctcccaattcagaaaagactttaagttctacaaggtgcgggaaatcaatgattaccaccatgcgcacgacgcctatctcaacgctgtggttggcaccgccctgctcaaaaagtaccctaaactggctccggagtttgtctatggggaatacaagaaatatgatattcgcaagttcatcacaagctctggagacaaggccacggccaaatactttttctattccaatcttatgaactttttcaagagagtgattcggtacagcaatggcaaagtggtcgtgagacccgttatcgagtgctctaaggataccggggagattgcttggaacaaacagacagactttgaaaaggtgcgccgggtcctgagctaccctcaggtgaatatcgttaaaaaggtggagacccagacaggcggattctccaaggaaagcatcctccccaaaggcaactctgataagctgattcctagaaaaaccaagaaattccgctgggacacgcccaagtatgggggatttgattccccgaacatcgcgtacagcgtcttcgtgattgccgacgttgagaagggcaaagctaagaaactgaagacagtgaaagaacttgtcgggatctccattatggagcggtctagctttgaggaaaatcctgtggtgttcctggagaagaagggatatcaaaacgtccaggaagataatctcatcaaactgcccaagtactccctctttgagttcgagggcgggagacgccggctgcttgcctctgccagcgaactgcagaaaggcaacgaggttgtgctctccagacatctggtggaactgctttatcacgctcatcgcgtcaattcttttaacaatagcgagcacctgaagtacgtgtccgaacacaaaaaggagttcggagaggttctcagctgtgtggaaaactttgccaagtcttatgtcgacgtggagaaaaatctgggcaagattcgggcggttgctgataaaatcgacaccttctccatcgaagacattagcatctcttttgtgaacctcctgacccttacagccctgggggcccctgctgatttcaattttctgggagagaagattcccagaaaacggtacacctccacaaaggaatgcctcaacgccacgctgatccatcagagcattaccggcctttacgagacacgcatcgacctgtctaaactcggggaggaatga

SEQ ID NO: 4308 - RNA, 4116 nt, synthetic construct
  misc_feature 1..4116: note = Cas9 variant
  source 1..4116: mol_type = other RNA
atgaacctgagaaatgtggagagctaccaggtcggcctcgacatcgggaccggatccgttggctgggccgtgctggatgacaacggggatctttgccggttcaagggaaaacccacatggggctctcgcgtgtttcctacggctgaaaccgccgcggaggctagagtccaccgggggcaacgcagacggtatgaccgcagacggcagcgcattgatctgctccagagattctttgccgacgaagtggccaaggttgatccggagttctttatccggctgaatcaggctcgccttcatcccgaaaacagagaccctgcccacgctgattaccggtggcccctgttcaatggaagcaactttacagagaaagactattaccgccaattccctaccatttatcatctcagagcccatctgctgaagtccgatgagcccgcggacatccggctcgtgtacctggcccttcacaatattgtcaaacacagaggcaactttctgcaccaggataatccttctctcagcgctcgcaacgccaatgtgggcgacgctgttgaagccctgtgtcttgcgctggacgagtggtgcggggcccatgatgtggaatgtgcttgcgacgaggccgctctcgccgaggccctgggagatgcttccctgcggccgggcgaaaagagagagcgcgcggaagccgctctcggggtcgagaaggcccacaaaaagctggccaaagctgtgtctagcgccgtggtcggatatgcggctgaatttggccatgttttcttcgccgagtccgaggggagcaagtttgccctttctaacgacgaaaaagtggaggcttacgtgtgtcccgatgaaggacgggacctgttcgatgccatgagagctgtccactccagctacgtgctcatgggcatcctgtctgaggcccagggcgaacttctgtccgtttgcaaggtgggggagtatgagcgctacaagcgggacctcgaaacactgaaaagcctggtcagagcgtatggacctgagcgctacgatgagttcttttgtggccccttctatgaagggacccgggactacgatcctggaaaggcccagggctatacaaaatacaatctcggggcttctaagctgtcccacgaagactttcttaaagaggtgcaaaagctgctcaaagacatcggagcccaggctgatgagagatacgccgacattgaacgcgcgatcgaggccggcgctttcctgcggagacttaagaccagcgataacggcacgattccctatcagctgcatctcgaagagatggacgccatcattgagcggcaggctgccttttacccgttcctggcccaagaaaaggataaactgaagtccctcgtttcttttcgcatcccttattacgtggggcccctgacccagaaaaatgctgcgagagacggaaagggcgaggcccggttcgcttggagctccagaaaacctgggatggaagatgcccgcgtctatccctggaactgggaggacgtgattgataaggaccagagcgccgaagattttatccggagaatgacaggaacctgcacataccttaagggcgagcccgtcctggctcgctgttctctcgactatgagctgttctgcgtgctgaacgaacttgccggggcgagatggacccaagatggcgacaaatcctaccggtttgacgctgccgatcgcctcggaatcgttgaggacctgttcaagaaaagaaagcgggtgacgtacgaagccgctgagaaatggctggcccgcacacacggccctgaaagcgggaagtctgcgggaggcgcttatcatgtcagcgggggacagggcgaggatgcctttgagtcccagctctctagccactacgacttctgtaagattctgggggtggatgaactttccgacgccgatgaggctatggccgaagacatcattctgtggaataccgttttcgaggatagaagcatcctcaaacggaagattaaactggcttatggcgaccgcctgggagatgcccaggtgagaaaactttgccaaaaacggtacacaggctgggggcgcctctctggagaactgctgagaggcctccggtccgcgaccgacaacgggccgaagaccatcatggatatcctgcttgagggagaccccaatcatgccagacgcatgggcgctgccatgaacctgatggagattctccacgacgatctgctggaatttcaggctaagatcgacgagcacaatcgggaaagagcccttgccgtcgggggcatgagcgtggatgaggtgacaggatctcctgctctccgccggggcattaaccaggcgctgagagttgtcgacgagatcgccgggattgctggaaaaccccctgcccatatctatgtggaagtgacgcgcgatgagggcgcccggaataaggggagacgcaccacatcccggtacagagctctggaagccgcgctcagctccatcaaagctcagtgcgccgacgtctatgccgagctgaaggaacgggatccccgcgctcttgacgatgagagactgaccctctacttcatgcaatgtggaaaatgcatgtactctggcgacgccctggatattaacaagctgcagacatatcaggtggaccacatccttccgcagagctacgttaaagacgattcctttgagaataaggtgctcgtccggcctgacaccaaccaacgcaagggggatacgctgctgctcgacgaaagactgattgcgcggatgagaggcttctggcgcacacttcgggatgctgagctgatcggagaaaagaagtttaataacctcaccagaacctctgtgagcgacgagcagatgaaaaagttcgtttcccgccagctggtggaaacaggccagatggtcaaacaagtgcagcagctgcttcaagcccggtatcccgagagcgaggttcagcctgtgaaggccggggtctctcatcagctgagagtgggatgtgctctcgccaagtcccgcgaaattaatgattttcaccacgctcatgacgcctacctggcgtgccaggtgggccggttcgtccaatatagacacagcgccgtttactctgagcccgtgaaaatggctgccgtggtcaagcagtttatcaaaaagcaggctgaagattatcgcagaacccgggagctccctgggtccgacggattcattgtgagctcttttatgacacccggcttcgatgttaaaacgggcgaagtgtttcgcgacgcctgggatgccggggctgagatcgacagaatccggcgctgtttcgactacaaggattgcttcattagcagaatgccggaggaaacccatggagcgttttgggacgccacaatctactcccctcgggctgccggcaagaccctgagccttcccctgaaaagagggctcgatccccgcaagtatggatcttactcccgggagcagttcgcctactttttcgtctatgaagctgtgaaacctaagaaaaagcaaagagttctggagtttgccccggtgcccgtccgcgtggcgagcgctctggccaacgaccctgatgcccttgaggactatgctcgggaactggccgaggcggaaggcctcgttttcgagcggattagacgcagaaaggtgtacaaatatcagcagatcattgtcggggattcccggctgtacgtgacaggacgcgaagaggtgagaaatgcccggcagctcgctttttctcaagacgagaccaagctgatctgtcgcatcgaacagggcgaggaatgcgaggaaggcgagcttctggatctcttcagaagcatgcagcggaaatacctggcctgtgctccccgcctggccagacttatgaaggtcgctgagatggaagaggggtttattgccgcgacggcctccggaaaacgggaagttctgctctctctgaccagcatcgctgccgctcacagaaactccattgacctcaagcctatcggccgcaaagggtctagcggacaaatgaagattacattctccaaggagctgagcaccaacggcatcctttttgtggattcttccgtgacagggatgttcgaacggagatgccgcctgggactgtga

SEQ ID NO: 4309 - RNA, 4116 nt, synthetic construct
  misc_feature 1..4116: note = Cas9 variant
  source 1..4116: mol_type = other RNA
atggagaacaagaattacagcatcggcctggacattgggaccaactccgtgggatggtctgtcatcacagatgactataaagttcccagcaagaaaatgaaggtgctcggcaatacggataaaagattcattaagaagaacctgatcggggcccttctgtttgacgaaggaaccacagctgaggcccggcgcctcaaaagaaccgcgcggcgcagatacacacggcgcaagaatagactgcggtatcttcaggaaattttcgctgaggaaatgtccaaagtggattctagctttttccaccgcctggacgattcctttctcatccctgaggacaagagaggctctaaatacccgatcttcgccaccctggccgaggaaaaggagtatcataagcaatttcccacaatttaccatctgcggaaacagctcgctgatagcaaggaaaagaccgacctgcgccttatctatctggccctcgctcacatgattaagtacagagggcacttcctgtacgaggatacgtttgacatcaaaaacaatgatattcagaagatcttctccgagtttattagcatctatgacaacaccttcgaaggatcttcccttagcggccagaatgcccaagtcgaggcgatctttacagacaaaatttctaagtccgccaagcgggaacgcgtgctgaaactcttccctgatgaaaagagcaccggcctgttctctgaatttctgaaactcatcgttgggaaccaggctgacttcaagaaacattttgatctgggagagaaggctccccttcagttctccaaggacacatacgatgaggacctggaaaatctcctgggccagattggggatgactttgccgatcttttcctggtggccaaaaagctctatgacgcgatcctgctgagcgggattctcaccgtcacggatccttccacaaaagctcccctgtctgccagcatgatcgagagatacgaaaaccaccaaaaggaccttgccgtgctgaaacagtttatcaagaataacctccctgagaagtatgacgaagttttctccgatcagagcaaagacggctacgctgggtatattgatggaaagaccacacaggaggccttttacaaatacatcaagaatctgctttctaaattcgagggcaccgactattttctggaaaagattgagcgggaagatttcctcagaaagcaacgcacctttgacaacggctccatcccgcaccagattcatctgcaggagatgaacgccatcctgcggagacaaggggaacactaccccttcctcaaagataataaggagaaaatcgagaagattctgacattccgcatcccttattacgtgggaccccttgctcggggcaacagagactttgcgtggctgacgcgcaatagcgatgaagccattcggccttggaacttcgaggaaatcgtcgacaaggcttctagcgccgaggattttattaataagatgaccaactatgacctctacctgcccgaggaaaaagtgctgccgaagcattcccttctctatgagacattcgccgtgtacaatgaactgaccaaggtcaaatttatcgctgaggggctgagagattaccagttcctcgactctggacagaagaaacagattgttacacaactgtttaaggaaaaacgcaaggtgaccgagaaggacatcatccagttccttcacaacgtggatggctatgacgggattgagctgaaaggaatcgaaaagcagtttaatgccagcctctccacgtaccacgatctgctgaaaattatcaaggacaaagagttcatggatgacagcaagaacgaagagattcttgaaaatatcgtccatacactcaccatctttgaggatcgggagatgattaagcagagactggcgcaatatgactctctgttcgatgaaaaagtgatcaaggctctcattcgccggcactacaccggctggggcaaactgtccgccaaacttatcgacgggatttgcgataaacagacaggaaacaccatcctggactatctcatcgatgacggcaagaataacagaaattttatgcagctgattaacgacgatgggctgagcttcaaggagatcacacagaaagcccaagttgtgggaaagacggacgatgtcaaacaggtggttcaggaacttcctggctctcccgctattaagaaagggatcctccagtccattaagatcgtggacgagctggtcaaagtgatgggccatacccctgaaagcatcgtcattgagatggcccgggagaaccaaacaaccgctcgcggaaagaaaaattcccagcagagatacaaacggatcgaagatgccctgaagaacctcgcgtctggcctggacagcaatattcttaaagagcaccccacaaacaatatccaactgcagaacgatagactcttcctgtattacctgcagaatgggcgcgacatgtacaccggaaagccccttgatattaaccagctctcctcttatgacatcgatcatattgtgcctcaagcctttatcaaagacgacagcctggataatcgggttctgacgtccctcaaggacaacagaggcaagagcgataatgtgccgtctatcgaagtcgtgcagaaacgcaaggctttctggcagcagctgcttgactccaaactgattagcgagagaaagtttaacaatctcaccaaagccgagcggggaggactggatgaacgcgacaaggttggcttcatcaagagacaactggtggagacacggcagattaccaaacacgtcgctcagatccttgatgcccgctttaacaaggaagtgaatgagaaagacaagaaaaacagaacagtgaagattatcaccctgaagtctaacctcgtttccaatttccggaaagaatttcgcctgtacaaggtcagagagatcaacgattatcaccatgcgcacgacgcctacctcaatgctgtggtggccaaagctattctgaagaaatatcccaaacttgagcctgagttcgtctacggggattatcagaagtacgacctgaaacggtacatcagccgctctagaaaccccaaggaggtggaaaaagccacggagaagtactttttctatagcaatctcctgaactttttcaaagaagaggttcattatgccgatggcacaattgtgaagcgggagaatatcgaatactccaaagacaccggagagattgcttggaacaaggaaaaggacttcgcgacaatcaaaaaggtcctgagctatcctcaagtgaatatcgttaaaaagagagaggtgcagaccggcgggttttctaaagaatccattcttcccaagggaaacagcgataagctgatcccgcgcaaaaccaaggacattctctgggagacaacgaaatacggcgggttcgattcccctgtcatcgcctattctattctgctcatcgctgacattgagaagggaaaagccaagaagctgaaaaccgtgaagacacttgttggcatcaccatcatggaaaaagccgcttttgaggaaaatcccattacattcctggagaacaaggggtaccacaatgtgcggaaagagaacatcctctgtctgcctaagtacagcctgtttgaacttgagaatggcagacgccggctgctcgcctccgcgaaggaactgcagaaaggaaacgagattgtcctccccgtgtatctgaccacgcttctgtaccactctaagaacgtgcataaactggatgaacctgagcacctcgagtatatccaaaagcatagaaatgagttcaaagacctgcttaacctggtcagcgaattttcccagaagtacgttctcgctgatgccaatctggaaaagattcagaacctctatgccgacaatgagcaggctgatatcgaaatcctggccaactctttcattaatcttctgacatttaccgcgctgggcgctcccgccgccttcaagtttttcgggaaggacatcgatcgcaaacggtacaccacagtgagcgagattctcaacgctaccctgatccaccaatccattacaggactttatgagacgagaatcgacctgagcaagctcggcgaagattga

SEQ ID NO: 4310 - RNA, 4116 nt, synthetic construct
  misc_feature 1..4116: note = Cas9 variant
  source 1..4116: mol_type = other RNA
atggacaagaaatacagcatcggcctggatattgggaccaactccgtgggatgggccgtcatcacagacgattataaggttccctctaaaaagttcaaagtgctcggcaatacggacagacacagcattaagaagaacctgatcggggcccttctgtttgattccggagagaccgccgaagcgacacggctcaaacgcaccgctagacggcgctacacaagacggaagaatcgcattagatatctgcaggagatcttctctagcgaaatgtccaaagtggacgatagctttttccatcggcttgaggaatcttttctggtcgaggaggacaagaaacacgaacgccatcctatcttcggcaacattgtggatgaggttgcctaccacgaaaagtatccgaccatctaccatctcagaaagaaactggccgactccacagataaggctgacctgcggctcatttatctggcccttgctcacatgatcaaatttcgcgggcacttcctgattgagggagatctcaatcccgacaacagcgacatggataagctgtttatccaacttgtgcagacctacaatcagctgttcgaggaaaaccctattaatgcctctagagtcgacgcgaaagccatcctctccgctcggctgagcaagtctcgcagactggagaacctcatcgcccagctgcccggcgaaaaacggaatggcctttttgggaacctgattgctctctccctgggacttacgcctaatttcaagagcaactttgatctggccgaggacgcgaagctccaactgtctaaagatacctacgacgatgacctggataatctcctggcccagatcggcgaccagtatgctgatcttttcctggccgctaagaacctctccgacgccattctgcttagcgacatcctgagagtgaactccgaaattacaaaagctcccctctctgctagcatgatcaagcgctacgatgagcatcaccaggacctgaccctgctcaaagcgctggttcggcaacagcttcctgagaagtataaggaaatcttctttgatcagtccaaaaatgggtacgccggatatattgacggcggggctagccaggaggagttctacaagtttatcaaaccgattctggaaaagatggatggaacagaggaactcctggccaaactgaacagagaggaccttctccgcaagcaacggaccttcgataatggctctatcccccatcagattcacctgggcgaactgcacgccatcctcagacgccaggaggacttttatcctttcctgaaggataaccgggaaaagatcgagaagattcttacgtttagaatcccctactacgtggggcctctggctcgcggaaattcccggttcgcctggatgacaagaaaaagcgaagagaccattacaccctggaactttgaggaagtcgtggacaagggcgcgtctgctcagagcttcatcgagcgcatgaccaattttgataaaaacctcccgaatgaaaaggtgctgcctaagcattccctgctttatgagtacttcaccgtctataacgagctcacaaaagttaagtacgtgacggaagggatgcggaaacccgagtttctgtctggaaagcaaaaagaagccattgtggacctcctgttcaagaccaatagaaaagtcacagtgaagcagctgaaggaggattatttcaaaaagatcgaatgctttgacagcgttgagatttccggcgtggaggaccggttcaacgccagccttgggacctaccacgatctgctcaaaatcatcaaggacaaagattttctggacaatgaagagaacgaagatattctggaggacatcgtccttacactcaccctgttcgaagataaggagatgattgaggaacgcctgaagaaatatgctaatctctttgacgataaggtgatgaaacagctgaagagacggcattacacgggatggggcagactttctcgcaaactgatcaacggcattcgggacaagcaatccgggaagacaatcctcgatttcctgaaaagcgacggatttgccaacagaaatttcatgcagctgatcaacgatgactctcttacctttaaggaggctattcagaaagcccaggtttccggccaagggcacagcctccatgaacagatcgcgaatctggccggatcccctgctattaagaaaggcatcctgcagtctgtgaaggtcgtggacgagctcgtcaaggtgatggggcacaaacccgaaaacattgttatcgagatggcccgcgagaatcagaccacacaaaagggccagaaaaacagcagagaacggatgaagcgcatcgaggaaggaattaaagagctgggctcccagatccttaaggagcaccccgtggaaaatacccagctgcaaaacgagaaactctacctgtattacctgcagaatgggagagatatgtatgtcgaccaggaacttgatattaaccggctgtctgactacgatgtggaccatatcgttcctcagagcttcattaaggatgactccatcgataataagatcctcacacgcagcgacaaaaacagaggaaagtctgataatgtgccgtccgaggaagtcgtgaaaaagatgaaaaactattggcggcaactgctcaatgctaagctgattacgcagcgcaagtttgacaaccttaccaaagccgagagaggcgggctgagcgagctcgacaaggcgggattcatcaaacggcagctggtggaaacacgccaaattaccaagcacgttgcccagatcctggattctagaatgaacacaaaatacgacgagaatgataaacttattcgggaagtcaaggtgatcaccctgaaatccaagctcgtgagcgactttagaaaagatttccagttctataaggtccgcgagattaacaattaccatcacgctcacgacgcctacctgaacgctgtggttggcacggccctcatcaaaaagtataccaagctggaatctgagtttgtgtacggggattataaagtctacgacgtgcggaagatgatcgccaaaagcgagcaggaaattggcaaggctacagcgaaaagattcttttattccaatatcatgaacttctttaagaccgagattacacttgccaatggagaaatccgcaagcggcccctgattgagaccaacgaagagacgggcgagatcgtttgggataaagggagagacttcgctacagtgcgcaaggtcctcagcatgcctcaagtgaatatcgttaaaaagaccgaagtgcagacaggagccctgaccaacgagtctatttacgcccggggctcctttgataaactgatcagcagaaagcatcgcttcgaatcctctaaatatgggggatttggcagccccaccgtcacatactccgtgcttgtggtcgctaagtctaaggttcaggacgggaaagtgaagaaaattaagacgggcaaagagctgatcggaatgaccctcctggataagctcgtgttcgagaagaatcctctgaaatttattgaagacaagggctacgggaacgtccagatcgacaaatgcatcaaacttcccaaatatagcctgttcgagttcgaaaatggaacacggagaatgctggcctccgtgatggcgaacaataactctcggggcgatctccaaaaggctaacgagatgtttctgccggccaaacttgttaccctgctctaccacgcccataagattgaaagctccaaggagctggagcacgaggcttatatcctcgaccattacaatgatctgtatcagcttctgagctacattgaacgcttcgcctctctgtatgtggacgtcgaaaagaacatctccaaggtgaaagagctctttagcaatattgaatcttactccatcagcgagatttgttcttccgttatcaacctgcttacactgaccgcgagcggggctcctgccgatttcaagtttctcggaacgacaatccccagaaagcggtacggctcccctcagagcattctgtctagcaccctcatccaccaatccattaccgggctgtatgagacacgcatcgacctttctcagctgggcggagattga

SEQ ID NO: 4311 - RNA, 4116 nt, synthetic construct
  misc_feature 1..4116: note = Cas9 variant
  source 1..4116: mol_type = other RNA
atggacaagaaatacagcatcggcctggatattgggaccaactccgtgggatgggccgtcatcacagacgattataaggttccctctaaaaagttcaaagtgctcggcaatacggacagacacagcattaagaagaacctgatcggggcccttctgtttgattccggagagaccgccgaagcgacacggctcaaacgcaccgctagacggcgctacacaagacggaagaatcgcattagatatctgcaggagatcttctctagcgaaatgtccaaagtggacgatagctttttccatcggcttgaggaatcttttctggtcgaggaggacaagaaacacgaacgccatcctatcttcggcaacattgtggatgaggttgcctaccacgaaaagtatccgaccatctaccatctcagaaagaaactggccgactccacagataaggctgacctgcggctcatttatctggcccttgctcacatgatcaaatttcgcgggcacttcctgattgagggagatctcaatcccgacaacagcgacgtggataagctgtttatccaacttgtccagacctacaatcagctgttcgaggaaaaccctattaatgcctctagagtggacgcgaaagccatcctctccgctcggctgagcaagtctcgcagactggagaacctcatcgcccagctgcccggcgaaaaacggaatggcctttttgggaacctgattgctctctccctgggacttacgcctaatttcaagagcaactttgatctggccgaggacgcgaagctccaactgtctaaagatacctacgacgatgacctggataatctcctggcccagatcggcgaccagtatgctgatcttttcctggccgctaagaacctctccgacgccattctgcttagcgacatcctgagagttaactccgaaattacaaaagctcccctctctgctagcatgatcaagcgctacgatgagcatcaccaggacctgaccctgctcaaagcgctggtgcggcaacagcttcctgagaagtataaggaaatcttctttgatcagtccaaaaatgggtacgccggatatattgacggcggggctagccaggaggagttctacaagtttatcaaaccgattctggaaaagatggatggaacagaggaactcctggccaaactgaacagagaggaccttctccgcaagcaacggaccttcgataatggctctatcccccatcagattcacctgggcgaactgcacgccatcctcagacgccaggaggacttttatcctttcctgaaggataaccgggaaaagatcgagaagattcttacgtttagaatcccctactacgtcgggcctctggctcgcggaaattcccggttcgcctggatgacaagaaaaagcgaagagaccattacaccctggaactttgaggaagtggtggacaagggcgcgtctgctcaatccttcatcgagcgcatgaccaattttgataaaaacctcccgaatgaaaaggtcctgcctaagcattccctgctttatgagtacttcaccgtttataacgagctcacaaaagtgaagtacgtgacggaagggatgcggaaacccgcctttctgtctggagagcagaagaaagccattgtcgacctcctgttcaagaccaatagaaaagtgacagttaagcagctgaaggaagattatttcaaaaagatcgagtgctttgacagcgtggaaatttccggcgtcgaggaccggttcaacgctagccttgggacctaccacgatctgctcaaaatcatcaaggacaaagattttctggacaatgaggaaaacgaggatattctggaagacatcgtgcttacactcaccctgttcgaggataaggaaatgattgaggagcgcctgaagacgtatgcccatctctttgacgataaagttatgaagcagctgaaaagacggcactacacaggatggggcagactttctcgcaagctgatcaatggcattcgggacaaacaatccgggaagaccatcctcgatttccttaagagcgacggatttgctaacagaaacttcatccagctgattcatgatgactctctgacctttaaagaagccatccagaaggcccaggtgtccggccaagggcacagcctccacgagcagattgcgaatctggctggatcccctgccatcaaaaagggcattctgcagtctgtcaaagtggtcgacgaactcgtgaaggttatggggcataagcccgagaacatcgtgatcgaaatggctcgcgagaatcagacaacccaaaaaggccagaagaacagcagagagcggatgaaacgcattgaagagggaatcaaggaactgggctcccagattcttaaagagcaccccgtcgagaatacacagctgcaaaacgaaaagctctacctgtattacctgcagaatgggagagatatgtatgtggaccaggagcttgatatcaaccggctgtctgactacgatgttgaccatattgtgcctcagagcttcatcaaagatgactccatcgataataaggtcctcacgcgcagcgacaagaacagaggaaaatctgataatgtgccgtccgaagaggtggttaagaaaatgaagaactattggcggcaactgctcaatgccaaactgattacccagcgcaagtttgacaaccttacaaaggcggaaagaggcgggctgagcgagctcgacaaagccggattcatcaagcggcagctggtcgagacccgccaaattacaaaacacgtggctcagatcctggattctagaatgaataccaagtacgacgaaaacgataaacttattcgggaggtgaaggtcatcacgctgaagtccaaactcgtgagcgactttagaaaggatttccagttctataaagttcgcgaaattaacaattaccaccatgcccacgacgcttacctgaacgccgtggtcggcaccgccctcatcaagaaatatcccaagctggagtctgaatttgtgtacggggattataaggtttacgacgtgcggaaaatgatcgctaagagcgagcaggagattggcaaagcgacagccaagagattcttttattccaatatcatgaacttctttaaaaccgaaattacacttgctaatggagagatccgcaagcggcctctgattgaaaccaacgaggaaacgggcgagatcgtctgggataaggggagagacttcgccacagtgcgcaaagttctcagcatgccccaagtgaatatcgtcaagaaaaccgaggtgcagacaggagccctgaccaacgaatctatttacgctcggggctcctttgataagctgatcagcagaaaacatcgcttcgagtcctctaagtatgggggatttggcagccctaccgtgacatactccgtccttgttgtggccaaatctaaggtgcaggacgggaaggtcaaaaagattaaaacgggcaaggaactgatcggaattaccctcctggataaactcgtgttcgagaagaatcccctgaagtttatcgaggacaaaggctacgggaacgttcagatcgacaagtgcattaaacttccgaagtatagcctgttcgagttcgaaaatggaacacggagaatgctggcgtccgtgatggctaacaataactctcggggcgatctccaaaaagccaatgaaatgtttctgcctgccaaacttgtcaccctgctctaccacgctcataagatcgagagctccaaagaactggagcacgaggcctatattctcgaccactacaacgatctgtatcagcttctgagctacatcgaacgcttcgcgtctctgtatgtggacgttgagaagaacatttccaaagtgaaggaactctttagcaatatcgagtcttactccattagcgaaatctgttcttccgtcatcaacctgcttacactgaccgctagcggggcccccgccgatttcaaatttctcggaacgacaattcctagaaagcggtacggcagcccccagagcatcctgtctagcaccctcattcatcaatccatcaccgggctgtatgagacacgcattgacctttctcagctgggcggagattga

SEQ ID NO: 4312 - RNA, 4116 nt, synthetic construct
  misc_feature 1..4116: note = Cas9 variant
  source 1..4116: mol_type = other RNA
atggagaacaagaattacagcatcggcctggacattgggaccaactccgtgggatggtctgtcatcacagatgactataaagttcccagcaagaaaatgaaggtgctcggcaatacggataaacacttcattaagaagaacctgatcggggcccttctgtttgacgaaggaaccacagctgaggccagacggctcaaacgcaccgcgagacggcgctacacaagacggaagaatcgcctgagatatcttcaggaaattttctccgaggaaatcggcaaagtggattctagctttttccatcggctggacgattcctttctcatccctgaggacaagcgcgggtctaaatacccgattttcgctaccctggccgaggaaaagaagtatcacaaacaatttcccacaatctaccatctgagaaagcagctcgccgatagcaaagagaagaccgacctgcggcttatttatctggctctcgcccacatgatcaaataccgcggacatttcctgtacgaagaggcttttgatattaagaacaatgacatccagaaaattttcaacgagtttatctccatctataataacacgttcgaaggcaatagcctttctggccagaacgtccaagtggaggccatttttaccgataagatctccaagagcgcgaaaagagaacgggttctgaagctctttcctgacgagaaatctacagggctgttctccgaatttctgaagctcattgtgggaaatcaggccgacttcaaaaagcactttgatctggaggagaaggctccccttcagttcagccgcgacacctacgatgaagacctggagaacctcctgggccagatcggggatgactttgccgatcttttcctggtcgctaaaaagctctatgacgccattctgctgtctggaatcctcacagtgaccaatccttccacgaaagcgcccctgagcgcctccatgatcgaaagatacgagaaccaccaaaaggatcttgcttctctgaaacagtttattaagaacaatctccctgaaaagtatgacgaggttttcagcgatcagtccgaggacggctacgccgggtatatcgacggaaaaacaacccaggaaacattttacaagtacattaaaaacctgcttagcaagttcgagggcgctgattattttctggacaaaatcgaacgggaggatttcctcagaaagcaacgcacctttgacaatggctctattccgcatcagatccatctgcaggaaatgaacgccatcctgcggagacaaggggagcactaccccttcctcaaggagaataaagaaaagattgagaaaatcctgaccttccgcattccttattacgtgggaccccttgcccggggcaacagagattttgcttggctgacacgcaattccgaccaggcgatccggccttggaacttcgaagagattgtcgataaggccagctctgctgaggactttatcaataaaatgacgaactatgatctctacctgcccgaagagaaggtgctgccgaaacacagccttctctatgaaaccttcgccgtgtacaatgagctgacaaaggtcaagtttattgccgaagggctgagagactaccagttcctcgattccggacagaaaaagcaaatcgttacccagctgtttaaagagaagcgcaaagtgacagagaaggacatcattcagttccttcacaacgtggatggctatgacgggatcgaactgaagggaattgagaaacagtttaatgcttctctcagcacctaccatgacctgctgaagatcattaaagataaggccttcatggacgatgcgaaaaacgaagctatccttgagaatatcgtccacacgctcacaatttttgaagaccgggagatgatcaagcaaagactggcccagtatgattccctgttcgacgagaaggtgattaaagccctcacccgccggcattacaccggctggggcaagctgagcgctaaacttatcaacgggatttctgataagcagacaggaaacaccatcctggactatctcatcgatgacggcgaaattaatagaaactttatgcagctgatcaatgatgacgggctgtccttcaaagagattatccaaaaggcccaggttgtgggaaagacaaacgatgtcaaacaggtggttcaggaacttcctggcagccccgctattaagaaagggatcctccaatctatcaagattgtggacgagctggtcaaagtgatgggccacgcccctgaatccatcgtcattgagatggcgcgggagaatcagacgaccgcccgcggaaagaaaaacagccagcaaagatacaagcggatcgaagactccctgaagattctcgcttctggcctgaatagcaaaatccttaaggagcatcccacagataacattcagctgcagaatgacagactcttcctgtattacctgcagaacgggaaagatatgtacaccggagaagcccttgacatcaatcaactctcctcttgcgatatcgaccacattatcccccaggcttttattaaggatgacagcctggataaccgcgtgctgacatccagcaaagacaatcggggcaagtctgataacgttccttccctcgaggtggtcgacaagatgaaagtgttctggcagcagctgcttgacagcaagctgatctcttatagaaaatttaataacctcaccaaggccgagcgcgggggactgaacgaactggataaagttggcttcattaagagacaacttgtggagacgcggcagatcaccaagcacgtcgcgcagatcctggacgcccgctttaataaagaagtgacagagaaggataaaaagaacagaaccgtgaaaattatcacactcaagtccaatctggttagcaacttccggaaggaatttgagctctacaaagtccgcgagattaatgactatcatcacgctcatgatgcctacctgaacgctgtggtggccaaggccatccttaaaaagtatccgaaactggaacccgagttcgtctacggggactatcagaagtacgatctcaagagatacatttctcggagcaaagaccctaaggaaatcgagaaagctaccgaaaagtatttcttctactccaatctgctgaactttttcaaagaggaggtgcactatgcggatggcacgatcgttaagcgcgaaaatattgagtacagcaaagacacaggagaaatcgcctggaacaaggagaaggatttcgctaccattaaaaaggtgctttctctgccccaagtcaatatcgtgaaaaagagagaagttcagacaggcgggttttccaaagagagcattctccctaagggaaactccgacaagctgatcccccggaaaaccaaggatattctctgggacaccacaaaatatggcgggttcgactctccggtgatcgcctacagcatcctgcttattgccgatatcgagaagggaaaagctaagaagctgaaaacggtcaagaccctcgtgggcattacaatcatggaaaaagacgcctttgagaagaatcctattgcgttcctggaaaacaaagggtatcacaatgtttgtaaggagaacatcctgtgccttcccaagtactccctgtttgagctcgaaaacggccgcagacggctgctcgcttctgccaaagagctgcagaagtgtaatgaaatcgtgcttcctgtctacctgaccacactgctctatcatagcaaaaacgtgcacaagctggatgagcccggacatcttgaatacattcaaaaacacagaaatgagttcaaggacctgctcaacctggtgtccgagttttctcagaaatatgtcctcgccgatgctaatctggaaaagatcaagaacctttacgccgacaatgagcaggcggatattgaaatcctggctaacagcttcattaatctgctcacctttacggccctgggcgcccctgctgccttcaaatttttcgggaaggacgttgatcgcaaacggtatacaaccgtgtccgagatccttaacgctaccctgatccatcagagcattacaggactctacgaaaccagaatcgacctgtctaagctcggcgaggattga

SEQ ID NO: 4313 - RNA, 4116 nt, synthetic construct
  misc_feature 1..4116: note = Cas9 variant
  source 1..4116: mol_type = other RNA
atgaaggtgaacaattaccacatcggcctggacattgggaccagctccatcggatgggtcgccattggcgaggatgggaaacccctcagaatcaagggaaaaacagctattggcgcccggctgttccaggaagggaaccctgcggctgaccgcagaatgtttcggacgacccgcagacggctttctcgcagaaagtggcggctgaaactcctggaggaaatcttcgatccgtatatcacacccgttgacagcacctttttcgcccgccttaagcaatccaatctgtctcctaaggatagcagaaaagagtttaagggatccatgcttttccccgacctgacagatatgcagtaccataaagactatcctaccatttaccatctgcggcacgccctcatgacacaggatgaaaagtttgacatccgcatggtgtatctggctattcaccatatcgtgaaatacagaggcaacttccttaattctacccccgtcgatagctttaaggcctccaaggtgaacttcgttgaccagtttaaaaagctgaatgagctctatacggctattaaccctgaggaatccttccaaatcaatctggccaactctgaggatattggccaccagtttcttgacccgtccatccggaaattcgacaagaaaaagcagatccccaaaattgtgcctgtcagcgtggatgacaaggcgaccgataagatcaatgggaaaattgcctctgaaatcattaacgctatcctgggatacaagtccaaactcgacgttgtggtccagtgcacacccgtggatagcaagtcttgggccctgaaattcgacgaggaggatatcgacgctaagctgcaaaagattctccctgaaatggatgagaatcagcagtccatcattgccatcctgcagaacctttacagccaagtgaccctgaatcagattgtccccaacggcatgtccctctctgaaagcatgatcgagaaatataacgaccaccatgatcacctgaagctctacaaaaagatcattgaccagctggcggacccgaaaaagaaggccgctctcaaaaaggcctattcccaatacgttggggatgacggaaaagtgatcgaacaggctgatttttggagctctgtgaagaaaaatctggacgattccgacctgagcaagcagattatggatctcatcgacgccgagaagttcatgcctaaacagcgcacatctcaaaacggcgtcattccccatcagctgcaccagagagagcttgatgaaatcattgagcaccagagcaagtattacccttggctggccgaaatcaatcccaacaaacatgacctccacctggctaagtataaaatcgaggaacttgtggcgtttcgggttccctactacgtggggcctatgattaccccggatgaccaagccaagtccgctgagacggtcttctcttggatggagagaaaaggaaaggaagccggccagatcacaccctggaattttgatgagaaggtggaccgcaacgccagcgctaatcggttcattaaaagaatgaccacaaaggacacctatctgatcggcgaagatgttctccctgacgagtccctgctgtacgaaaaatttaaggtgctcaacgagctgaatatggtccgcgtgaacgggaaacttctgaaggtcgccgataagcaggcgattttccaggacctctttgagaattataaacatatcagcgtgaagaaactgcaaaactacatcaagtctaaaaccggactgccctccgatcctgaaattagcggcctttctgaccccgagtatttcaataactccctcgggacatacaatgattttaagaagctgttcggaaacaaagttgacgaaccggatctgcaggacgattttgagaagatcgtggagtggagcacggtcttcgaagacaaacggattctcagagagaagctgaacgaaatcacctggctttccgatcagcagaaagacgtgctggagtctagccgctatcaaggctgggggcggctctccaagaagctgctgacaggaattgttaatgaccagggcgaaagaatcatcgatgagctttggaacaccaataaaaacttcatgcagattcaatctgacaatgattttgctaagcgcatccacgaggccaacgccgaccagatgaaagctgtggatgtcgaagacgtgctcgccgatgcttacacaagccctcagaataagaaagccattagacaggtggttaaggtcgtggacgatatccaaaaagcgatgggcggggtggcccccaagtacatttccatcgagttcacccggagcgaagaccgcaaccctcggagaacgatctctcggcagcgccagctggagaatacactgaaggataccgctaaatccctcgccaagagcattaaccccgaactgctttctgagctggacaatgctgccaaatccaagaaaggactcatcgacagactgtatctgtactttacccagcttggcaaggatatttatacagggaagcctatcaacattgacgagatcagcacctacgatattgaccatatcctcccccaagcgttcgtcaaagatgactctctgaataaccgggtgctggttagcaaggccatcaataacggaaaatccgataacgtgccggtccagctctttggcgctaagatggggcacttctggaaacagctggccgaagctggccttattagcaagagaaagctgaaaaatctccagacagaccctgatacgatctctaagtatgccatgcacggatttattcgccggcaactggtggagacctcccaggttatcaaactggtggccaacattcttggcgacaagtacagaaatgatgacacaaaaatcatcgaaattaccgctcgcatgaaccatcagatgagagatgagttcgggtttatcaagaatcgggaaattaacgactatcaccatgcgttcgacgcctacctcacagcttttctgggacgctacctgtatcacagatacatcaagctccggccctatttcgtctacggcgattttaaaaagttcaaagaggacaaggtgaccatgcgcaatttcaactttctgcacgatcttacggacgatacccaagagaaaattgccgacgccgaaacaggggaggttatctgggatagagaaaatagcatccagcagctgaaggacgtgtatcattacaagttcatgctcatttcccacgaggtctataccctgcggggagctatgtttaaccagacagtgtaccccgcctctgatgcgggcaaacgcaagctgatccctattaaagctgacagaccgatcaatgtgtacgggggctatagcggatccgccgatgcctacatggctattgtccggatccataacaagaaaggcgacaagtatcgcgttgtgggggtgcccatgagagcccgggatagacttgacgcggctaaaaaggtctctgacgccgattacgaccgcgccctgaaggatgtgctcacccctcaactgacgaaaacaaagaaaagccggaagaccggagagattacacaggttgtggaagacttcgagatcgtcctcggcaaagtgatgtatagacagctgatgatcgatggggacaagaagtttatgcttggatcctctacctaccagtataatgctaaacaactggttctcagcgatcagtccgtgaagaccctggccagcaaaggccgcctggacccccttcaggaatctatggattacaacaatgtctacacagagattctggacaaggtgaaccagtatttctccctctacgatatgaacaaatttcggcacaagctgaatctcgggttcagcaagtttatctctttccctaaccataatgtttttgacggcaacacgaaagctagcagcggaaagagagaaattctggaggaggtgcttaatggcctgcacgccaaccccaccttcgggaatctcaaagacatcggaattacaacccctttcggccaactgcagcagcccaacgggatcctgctttctgatgaagcgaagatccgctatcagtccccgacaggactgtttgagcggaccgtcagcctcaaagacctgtga

SEQ ID NO: 4314 - RNA, 4116 nt, synthetic construct
  misc_feature 1..4116: note = Cas9 variant
  source 1..4116: mol_type = other RNA
atgaaggtgaacaattaccacatcggcctggacattgggaccagctccatcggatgggtcgccattggcaaagatgggaagcccctcagagttaaaggaaagacagctatcggcgcccggctgttccaggaggggaaccctgcggctgaccgcagaatgtttcggacgacccgcagacggctttctcgcagaaaatggcggctgaagctcctggaagagattttcgatccgtatatcacacccgtggacagcacctttttcgcccgccttaagcaatccaatctgtctcctaaagatagcagaaaggaatttaaaggatccatgctgttccccgacctgacagatatgcagtaccataagaactatcctaccatctaccacctccggcatgccctcatgacacaggacaaaaagtttgatattcgcatggtgtatctggctatccaccatattgtcaagtacagaggcaatttccttaactctacccccgtggacagctttaaagcctccaaggttgatttcgtggaccagtttaaaaagctgaatgagctctatgctgccatcaaccctgaagagagcttcaaaattaatctggcgaactctgaggatatcggccaccaatttcttgacccgtccattcggaagttcgacaaaaagaagcagatccccaaaatcgtccctgtgatgatgaatgataaggttacggaccgcctgaacgggaaaattgccagcgaaatcattcacgctatcctcggatacaaggccaaactggatgtggtcctgcagtgcacccccgtggactctaagccttgggctctcaagttcgatgacgaggatattgacgccaaactggaaaagatccttcccgagatggatgagaatcagcaatccatcgtggcgattctgcagaacctctacagccaggtcacactgaatcagatcgttccgaacggcatgtctctttccgaaagcatgattgagaaatataacgaccatcacgatcatctgaagctctacaaaaagctgatcgaccaactggccgaccctaagaaaaaggctgtgctcaaaaaggcctattcccagtacgtgggggatgacggaaaagtcattgaacaggctgagttttggtctagcgtgaagaagaatctggatgactccgaacttagcaaacaaatcatggatctgatcgacgccgagaagttcatgcccaaacagagaacctctcagaacggcgttattcctcaccagctccaccaacgggagctggatgaaatcattgagcatcagtccaagtattacccctggcttgtggaaatcaatcccaacaaacacgacctgcatctcgccaagtataaaattgagcagctggtcgcttttagagtgccttactacgttgggccgatgatcacacccaaggatcaggcggaaagcgccgagaccgtgttctcttggatggagcgcaagggaacggaaacaggccaaattaccccttggaattttgacgagaaagtcgatcggaaggctagcgccaacagattcatcaaacgcatgacaaccaaggacacctatctgatcggcgaagatgtgctccccgacgagtccctgctttacgaaaaatttaaggtcctgaatgagctcaacatggtgcgggttaatgggaagctgctgaaagtggccgacaagcaggctattttccaggatctttttgagaactataaacacgtctctgtgaagaaactccagaattacatcaaggccaagacaggactgcctagcgaccccgaaatttccggcctgagcgatccggagcatttcaacaattctctcgggacgtataacgactttaaaaagctgttcggatccaaagttgatgaacctgaccttcaagatgactttgagaagatcgtggagtggagcaccgtcttcgaagataaaaagattctgagagagaagctcaatgaaatcacatggctgtctgaccagcagaaagatgtgctggagtccagccgctaccagggctgggggcggctttccaagaaactcctgaccggaatcgtgaacgaccaaggcgaaagaattatcgataagctgtggaacacaaataaaaacttcatgcagattcagtctgacgacgattttgcgaagcgcatccacgaggctaatgccgaccaaatgcaggccgttgatgtcgaggacgtgctcgctgatgcctataccagcccccagaacaaaaaggctattagacaggtggtcaaggtggttgacgatatccaaaaagccatgggcggggtggcgcctaagtacatctccattgagttcacgcggtctgaagaccgcaatccccggagaacaatcagccggcagcgccagctggaaaacacccttaaagataccgccaagtccctggctaaaagcattaatcctgagctcctgtctgaactggacaacgccgctaagtccaagaaaggacttacagatagactctacctgtattttacccagctgggcaaggacatctacacaggggagcccattaatatcgacgagctcaacaaatatgatatcgaccacattctgccgcaagccttcatcaaggataatagccttgacaaccgggtcctggtgctcacggcggttaataacggaaaatctgataatgtgcctctgagaatgtttggcgccaagatggggcatttctggaagcagctggctgaagccggccttatttccaaacgcaagctcaaaaacctgcagaccgaccccgatacaatcagcaagtacgctatgcacggatttattcggagacagctggtcgagacctctcaagtgatcaaactcgttgccaacattctgggcgacaagtatcgcaatgatgacacaaagatcatcgaaattaccgccagaatgaaccatcagatgcgggatgagttcgggtttatcaaaaatcgcgaaattaacgactaccaccacgctttcgatgcgtatcttacggcctttctgggaagatacctctaccatcggtatatcaagctgcgcccctacttcgtgtatggcgactttaaaaagttcagagaggacaaagtcaccatgcggaatttcaactttctgcacgatcttacagacgatacccaggagaagattgctgacgccgaaacaggggaggtgatctgggatcgcgaaaatagcatccaacagctgaaggacgtgtaccattataaattcatgctcatttcccacgaggtctacaccctgagaggagccatgtttaaccagacggtttatcctgctagcgatgccggcaagcggaaactcatcccggtgaaggcggaccgccccgtgaatgtctacgggggctactctggatccgctgatgcctatatggccattgtgagaatccataacaaaaagggcgacaaataccgggttgtgggggtccctatgagagctctggatcgccttgacgccgcgaagaatgtgagcgatgctgacttcgaccgggccctgaaggatgttctcgctccccagctgacaaaaaccaagaaatccagaaagacaggagagattacccaagtgatcgaagactttgagatcgtcctgggcaaagtgatgtatcgccagcttatgattgatggggacaagaagttcatgctgggatctagcacctaccagtataacgccaaacagctcgttctgtccgatcaatctgtgaagacactcgccagcaaaggccggctggaccctcttcaggaatccatggattacaataacgtctatacggagatcctggacaaggtgaatcagtacttttctctctacgatatgaacaaattcagacacaagctgaacctggggtttagcaagttcatttcctttcccaatcacaacgtgcttgacggcaataccaaagtcagctctggaaagcgcgaaatcctgcaggagattctcaacggcctgcatgctaatcctacattcgggaacctcaaagatgttggaatcaccacacccttcggccaactgcagcagccgaatgggattcttctgtccgacgagaccaagatccggtatcagagccctacgggactgtttgaaagaacagtgtctctcaaagacctgtga

SEQ ID NO: 4315 - RNA, 4116 nt, synthetic construct
  misc_feature 1..4116: note = Cas9 variant
  source 1..4116: mol_type = other RNA
atggacaagaaatacagcatcggcctggatattgggaccaactccgtgggatgggccgtcatcacagacgattataaggttccctctaaaaagttcaaagtgctcggcaatacggacagacacagcattaagaagaacctgatcggggcgcttctgtttgattccggagagaccgccgaagcgacacggctcaaacgcaccgctagacggcgctacacaagacggaagaatcgcatttgctatctgcaggagatcttctctaacgaaatggccaaagtggacgatagctttttccatagacttgaggaatcctttctggtcgaggaggacaagaaacacgaacggcatcctatcttcggcaatattgtggatgaggttgcctaccacgaaaagtatccgaccatctaccatctccgcaagaaactggctgactctacagataaggccgacctgagactcatttatctggctcttgcccacatgatcaaatttcgggggcacttcctgattgagggagatctcaaccccgacaatagcgacgtggataagctgtttatccaacttgtccagacctacaaccagctgttcgaggaaaatcctattaacgcgtcccgcgtggacgccaaagctatcctcagcgccagactgtctaagtcccggcgcctggagaatctcatcgctcagctgcccggcgaaaagaagaacggcctttttgggaatctgattgccctcagcctgggacttacgcctaacttcaagtctaattttgatctggcggaggacgccaaactccaactgtccaaggatacctacgacgatgacctggataacctcctggctcagatcggcgaccagtatgccgatcttttcctggctgccaaaaacctcagcgacgccacactgctttctgacattctgagagttaattccgaaatcaccaaggctcccctcagcgcgtccatgattaaacggtacgatgagcatcaccaggacctgacactgctcaaggccctggtgagacaacagcttcctgagaagtataaagaaatcttctttgatcagtctaagaacgggtacgctggatatatcgacggcggggccagccaggaggaattttacaaattcattaagccgatcctggagaaaatggatggaaccgaggaactcctggccaagctgaatcgcgaggaccttctccggaagcaaagaacgttcgataacggctccattccccatcagatccacctgggcgaactgcacgctattctccgccggcaggaggacttttatcctttcctgaaagataatagagaaaagatcgagaaaatccttacatttcgcattccctactacgtcgggcctctggcccggggaaacagcagattcgcgtggatgacccgcaagtctgaagagacaatcaccccctggaattttgaggaagtggtggacaaaggcgcttccgcccaatccttcattgagcggatgaccaactttgataagaatctcccgaacgaaaaggtcctgcctaaacattctctgctttatgagtacttcacagtttataatgagctcacgaaggtgaaatacgtgaccgaagggatgagaaagcccgcctttctgagcggagagcagaaaaaggctatcgtcgaccttctcttcaaaacaaaccgcaaggtgaccgttaagcagctgaaagaagattatttcaagaaaattgagtgttttgactccgtggaaatctctggcgtcgaggaccggttcaatgccagccttgggacataccacgatctgctcaagattatcaaagacaaggattttctggacaacgaggaaaatgaggatatcctggaagacattgtgcttaccctcacgctgttcgaggataaggaaatgatcgaggagagactgaaaacatatgctcatctctttgacgataaggttatgaaacagctgaagcggcgccactacaccggatggggcagactttcccggaaactgattaacggcatcagagacaagcaaagcgggaagaccattctcgatttcctgaaatctgacggatttgccaaccgcaatttcatccagctgatccatgatgactcccttacatttaaggaagcgattcagaaagcccaggtgagcggccaagggcactctctccacgagcagatcgctaacctggccggatcccctgctattaagaaaggcatcctgcagagcgtcaaggtggtcgacgaactcgtgaaggttatggggcataaacccgagaatattgtgatcgaaatggcccgggagaaccagaccacacaaaagggccagaaaaattccagagagcgcatgaagagaatcgaagagggaattaaagaactgggctctcagatccttaaggagcaccccgtcgagaacacgcagctgcaaaatgaaaaactctacctgtattacctgcagaacgggcgggatatgtatgtggaccaggagcttgatattaatcgcctgagcgactacgatgttgaccatatcgtgcctcaatccttcattaaggatgactctatcgataacaaggtcctcaccagaagcgacaaaaatcggggaaagtccgatgacgtgccgagcgaagaggtggttaaaaagatgaaaaactattggcgccagctgctcaatgcgaagctgatcacacagagaaagtttgacaaccttaccaaagccgaacggggcgggctgtctgagctcgataaggctggattcattaaacgccagctggtcgagacaagacaaatcaccaagcacgtggcccagattctggactcccggatgaatacgaaatacgatgaaaacgacaagctgatccgcgaggtgaaggtcattaccctgaaaagcaagctcgtgtctgattttagaaaagacttccagttctataaggttcgggaaatcaacaattaccaccatgctcacgatgcctacctgaacgccgtggtcggcacagctctcattaaaaagtatcccaagctggagtccgaatttgtgtacggggactataaagtttacgatgtgagaaagatgatcgcgaaaagcgagcaggagatcggcaaggccaccgctaaacgcttcttttattctaatattatgaacttctttaagacagaaatcacccttgccaatggagagattcggaagagacctctgatcgaaacgaacgaggaaacaggcgagattgtctgggacaaagggcgcgatttcgccaccgtgcggaaggttctcagcatgccccaagtgaatatcgtcaaaaagacagaggtgcagaccggagctctgaccaacgaatccatctacgccagaggcagctttgacaaactgatttctcgcaagcatcggttcgagtccagcaaatatgggggatttggctcccctacagtgacgtactctgtccttgttgtggctaagagcaaggtgcaggatgggaaagtcaagaaaatcaagaccggcaaagaactgattggaatcacactcctggacaagctcgtgttcgagaagaatcccctgaaatttattgaggacaagggctacgggaacgttcagatcgataaatgcatcaaacttccgaaatattccctgttcgagttcgaaaatggaaccagacgcatgctggcttctgtgatggccaacaataacagccggggcgacctccaaaaggccaatgaaatgtttctgcctgctaaacttgtcacactgctctaccacgcccataagattgagtcctctaaggaactggagcacgaggcgtatatcctcgatcactacaacgacctgtatcagcttctgagctacattgaaagattcgcttccctgtatgtggatgttgagaaaaacatcagcaaggtgaaagaactcttttctaatattgagtcctacagcatctctgaaatttgttccagcgtcatcaacctgcttaccctgacggcctctggggcccccgctgacttcaagtttctcggaacaaccatccctcggaagcgctacggcagcccccagagcattctgtccagcaccctcatccatcaatctattacagggctgtatgagaccagaatcgatcttagccagctgggctccgactga

SEQ ID NO: 4316 - RNA, 4119 nt, synthetic construct
  misc_feature 1..4119: note = Cas9 variant
  source 1..4119: mol_type = other RNA
atgaacaatgagtacttcgtgggctttgacatcgggaccaacagcgtcggagccgctgttacagatgaaaagtatcacgtgctgaaattcaagggcaatgccatgtggacgtccgcggtgtttgagtctgctcagcaaagcgccgacagacggctcaaccgcaccgccagacggcgcctggatagatcccagcagcggcgcgaccttctgcaggaactcattgctcccgccatcacacctgtcgatccgagattctttgaccggattcgcgagtctgctctgtgggccgaagataaaaccacagggagcagattcacctacttttccgacgagggatatacagataagcaataccataaagagtatcccaccatccaccatcttatttgctctctgatgaatgaccctgcgccccacgatcctcggctcgtgtacatcgcctgtagctatatgctgacgcatcgcggccacttcctgaacgaagctgacaaggagaagatcgatgacgttctcgacattagacgggtgtttaatgaactgtgctcctggttcaccagctacgggatcgaggtccccttttcttgtttccctgaggaatttggaaacgtgcttacagccaatcgcggcgttcaggatagaacccgggctttctacgacctcctgttcgccggcaaaaagccgaaaccctccgaggatgaccaggtggatattgacgtcctgatcaaacttattagcgggggaaaaatcgaactgtctaagctctttctgaacgaggaatattccgagctggagaataacaagattcagctcagcgatgcgggcttcgacgaaaaagagcctgaactgagatctgagcttggggatgactttggactggtggccgctgccaagaatatctacgattggtccctcctgacaggcgtgcttggggaatgcaaaagcatctccgaggctaaggtcaaaacctatgagaagcactctgaagacctggccgccctccgccgggttgtgagaaaataccatcccgacaagtataaggagattttcaaaaagtacgtggtcggaaactatacgagctactccggcaatgtgaaaagcgctggcaagatctctgaaacaaaactgaagcgctgtaaccaagcggagttttgcgattacctgaagtccaaactcaaggacgttaaacctgcccccggggatgacgaatgtgagcgggtgctgaaggagattagcaaacacaccttctgcccgagacaggtcacaaccgataaccgcgtgatcccttatcagctttactataccgaactgaagaaggttctcgagaatgctaaacggtacattccccagctgaacgtgacagacgaatatggatctgccgccgataagatccttagcctgatgacgtttagaatcccttactatgtcggccccctcgtgaaaaagaatgactcctctaacgcttggattgtccgcagaggggagggaagaatcctgccctggaatttcgatgagctggtggacaaagataagtgtgaagacgagtttattcgccggatgacctgcaagtgtacatacatcgccggcaaaaacgttctccctaagaatagcctgctttactgcaaattcatggtgctgaacgaaattaataacatcaagatcaatggggagagaatttccgtcggagataaacaaaagatctataccgaactctttgagaaaaagcggaaggtgacagttcgcgacattagaaacctgctgaccagcgagggccggcttaaagcgggcgacacgttcgggggaatcgatattacagtgaagtcttccctcaaaccgcagcatgacctgaagagactgatggctgccggcgtcatcaccgaagccgatgctgaggaaattatcgagcgcattacctgcacaaccgacgtgagccggctcagaacatggctggggaaatttggactttctgccgctgatgccaagtacgtgtccggcctgaagtatagcgacttcgggcgcctctccagagagttcctgacggaagttaatgatgtcgaccccgcgaccggcgaggtgatcaaccctaatatcattacaatgatgtgggaaaacaacatcaatctgatggagcttctctctcagaaatacagctatcggtcccaaattgaatctatgaaccgcgagtactatgccgctaatcccctgaccctggatgaaagaatgagcgagatgtacatcccttccgccgtgcggcgccccgtcaagagaacaatcgagatgatgaaagaatacatgcacattatgcggaagccgcctaaacgcatctttattgagatggctagagaactcaccgacctggataacaagggaaagcggacgagctctcgcagaaatacccttctggagttctttaaaaagtgtccccaggacacaaccgagctccgggcccagctggaaaagaagtccgatgacgagctgagaagcgaaaaactttatctctacttcgcgcagctgggcaagtgcatgtattctggggagtccatcgacattgaacgcctgggaagcaagctctacgatgtggaccacatctttcctcaagcccgggttaaagatgactctatcgagaacaaggtgctggtccttagcgatctgaatggcgctaaatccgacagatatcccattaacgccgatatccgcaataagatgcatagcttctgggacaaactccactctattgggctgatcggagagaagaaatacgaacggctgacaagatccaccggctttacggatgacgagcttgctgggttcattagccgccagctcgtggaaacacggcagtccaccaaggccgttgccgctctgctggcggaggaatttcctgagtctgagatcgtgtatgtcaaggccggcctcgctagccagttcagacatgaatttggactgcttaaatgtcgcgagatcaacgatctgcaccatgccaaggacgcctacctcaatattgtgatgggcaacatctaccacgttaaattcacaaaggaccccatgaattttgtgaaagaatatcggagaaaggagcaagtcttcgatctgaagattcagtccatgctgacccacgacgctatccggaacggggaaaccgcctggattggagatggcacatggcttgagacggtgaaaaagcagatggagaaaaataacatccgctacgtgagatattctttccggcgcaagggggcgctgtttaacctcatgccggaacggaaaaatcctagcctgctcccccggaagaacggaaagaatatggtcctgcccgctgagaaatacggcgggtataacaataccgccgcctccttcttttctcttgttaagtaccatagcgctaaaggctccggagtggtgattatccctgtcgaactgatccacgcccatagatatgagcacgacagctctttcgcggaggaatacgctctccgcgtgctggccgatattgtttccctgaagaaaggcgacgtgcttcagagcgtcgagtttccgctggggtctcggatcctcaaggtgaacacactgctcgatattgacggattcagagccaatatcaccggcaaggattccgggggaaaatacctgggcattagctctgcttccagccttatcatctcccaagttgacacaacctatattaagcgcgtgatcagcattaacgaacggatctctgcctgcgagaaaaataagcagagctacacgattagacccgaatttgatgtcatcacatccgagcgcaacatcgagatttataatatgctgtgtgagaaaatctctagccggcctttctgcattaagtttgctaacacctccgacaccttcgtgtctgggagagaaaagtttatcgccctcagcctgaatgaacaggttaaaacactgaccaacatgctttccgtgttcaagacaggccgcgcgtctggatgtgatctgacgaatattggcgggagcaaaaacaccgccatcgtcaagctcaacgctgtgctgtccaatctcaaagacttcaagagcgtgagaattatcgaccagtctcccacaggactgtacgagaaagtctcccctaaccttctgagcctgtga

SEQ ID NO: 4317 - RNA, 4119 nt, synthetic construct
  misc_feature 1..4119: note = Cas9 variant
  source 1..4119: mol_type = other RNA
atgaccaagaaaaactacagcatcggcctggacattgggacaaattccgtgggatgggccgtcatcacggatgactataagattcccgctaaaaagatgaaagttctcggcaacaccgataaggagtacatcaagaaaaatctgcttggggccctcctgttcgactctggagaaacagcggaggctaccagactgaagcggacagcccgcagacggtatacccgcagaaagaaccggcttcgctacctgcaggaaatttttgccgaggaaatcgctaaggccgataatagcttctttcaaagactcgacgagtccttcctgacagatgacgataaagactttgattctcaccctatcttcggcaacaaggctgaggaagacgcctatcatcagaagtttagcaccatttaccatctgcggaaatatctcgcggattccccggagaagtctgacctgcgccttgtgtacctggccctcgctcacatgatcaaatacagagggcacttcctgattgaaggagagcttaaggccgagaatacggacgtgcagaaactgtttaccgatttcgtcgaagtgtatgaccggacatttgatgacagccatctctccgaggttaccgtggatgctagctctatcctgacagaaaagatttccaaaagccgcagactggagaacctcatcgaatcttaccccaaggagaagaaaaataccctgttcggcaaccttattgccctgtccctcggcctgcagcctaattttaagacgaacttcaaacttagcgaggacgcgaagctgcaattctctaaagatacatatgaagaggacctcgaagaggtcctggaaaagatcggggatgactacgccgatctgtttacctccgctaagaatctctatgacgccatcctgcttagcggcattctgacagtggacgattcctctaccaaagctcccctcagcgcctccatgatcaagcggtacgccgagcaccacgaggacctggaaaaacttaaggctttcattaaaaccaacaagcctaatctgtatcatgatatctttaaggacgagacacagaacggatacgcggggtacattgaaaacggagttaaacaggatgagttctataagtacctcaaaacgatcctgagcaagaccgacggctctgaatattttctggataaaatcgagcgcgaggacttcctcagaaagcagcggacatttgataatgggtccattccccaccaaatccatctgcaggaaatgcacgccattcttagacgccagggagactactatcctttcctgaaggagaaccaggatcggatcgaaaagattctcacctttagaatcccgtactatgtgggccccctggctcgcaagaatagccggttcgcctgggccgagtaccactctgacgagaaaatcacaccttggaactttaataaggtcattgataaagaaaagagcgctgagaaattcatcaccagaatgacgctgaacgacctttacctccccgaagagaaggtgctgcctaagcattcccacgtgtatgaaacatttgccgtctacaatgagctgaccaaaattaagtatgttaacgagcaaggcaaagaagcgttcttcgactctaatatgaagcaggagatctttgatcatgtgttcaaagaaaaccgcaaggtgaccaaggagaaactcctgaattaccttgacaaggaatttcccgagtatcggattcaggatctgatcgggctcgacaaagagaacaagagcttcaatgcttccctgggaacataccacgatctgaaaaagattcttgacaagagctttctcgatgacaaagtcaacgaagaggtgatcgaagatatcattaagaccctgacactgttcgaggacagagaaatgatccaacagcgcctccataaatattctgatatcttttccacgcagcagctgaagaaacttgagcggagacactacaccggctgggggcgcctgagctacaagctcattaatggcattcggaacaaggagaacaataaaacaatcctggaatatctgatcgacgatggatacgccaacagaaatttcatgcaacttattaacgacgacaccctcccgtttaagcagatcattaaagatgcccagatcattgggaatatcgacgatatcgctgccgttgtgcacgagctgcctggatctcccgctattaagaaaggcatcctgcagtccattaagatcgtcgacgaactcgtgaaagttatgggccataaccctgataatattgtgatcgagatggcccgggagaaccaaacaaccaatcgcgggagaagccagtcccagcagcggctgaagaaacttcaagactctctgaaagaactcggaagcaacatcctgaataagaaaaagccctcctatgtcgaggataaagtggaaaacgtccatctgcaggacgatagacttttcctctactatattcagaatggcaaggacatctacacgggggaggaactggatattgaccgcctgtctgactatgatatcgaccacattatcccccaggcgtttattaaggatgacagcatcgataaccgggtgctcacctccagcgccaaaaatagaggaaagtctgacgatgttcctaacctggacatcgtgcgcgctagaaaagccgattgggtccggctttacaagtccggcctgattagcaaacgcaagttcgacaacctcacaaagtctgagagagggggcctgaccgaggctgataaagccggatttatcaagcggcaactggtggaaacacgccagattaccaaacacgttgcgcagatccttgacgccagattcaatacggagcacgatgaagacgacaaggtgattcggaacgtcaaagtgatcacactgaagtccaatctcatcagccaattccgcaaggattttaaattctacaaggtgagagagattaacgactatcatcacgctcatgatgcctacctgaatgctgttgtcggcaccgccctcctgcggaaatatccgaaacttgcccccgaatttgtgtacggggagtataaaaagtacgacgtgcgcaagctgatcacatctagctccgataaagctaccgcgaagtatttcttttacagcaacctcatgaatttctttaaaagagtcgtgcggtactctaacggaagagttattgtgcgccctgtcatcgagtattccaaggacaccggcgaaattgtgtggaataaagagacagatttccggacgatctgcaaggttctgagctacccccaggtgaacatcgtcaaaaaggtggaatcccagaccgggggattttctaaggagagcattctgcctaaaggcgactccgataaacttatccccagaaaaacaaagaaagtttattgggacaccaagaagtacgggggcttcgattctccgattatcgcctatagcgtgtttgtcgtggctgacgtggaaaaaggaaaggccaaaaagctgaaaaaggtcaaggagctcgttggcatttccatcatggagcgcccttctttcgaaaagaatcccattgtgttcctggagaagaaagggtaccggaacgtgcaggaagatacactcatcaagctgcctaaatatagcctttttgagttcgagggaggcagacgccggctgctcgcctccgctagcgaactgcaaaaggggaatgaggtcgtgctgtctgacagacttgttgaactgctctaccacgcccatcgcgtgaactcctttaatagcaccgagcacctgaagtacgtctctgaacacaaaaaggagttcggagaggtgctctcctgtgttgaaaactttgcgaacagctatgtggacgtcgagaaaaatctggataagatccgggctgtgattaacaaaatcgacacgttctctattgaagagatctccaccagctttgttaatcttctgacactgaccgccctcggcgcccccgctgatttcaactttctggggaagaaaattcctagaaagcggtacacatccaccaaggaatgccttaatgccacactgatccatcagagcatcacgggcctctatgagacccgcattgacctgtctaaactcggagaggataagtga

SEQ ID NO: 4318 - RNA, 4119 nt, synthetic construct
  misc_feature 1..4119: note = Cas9 variant
  source 1..4119: mol_type = other RNA
atgaccaagaaaaactacagcatcggcctggacattgggacaaattccgtgggatgggccgtcatcacggatgactataaggttcccgctaaaaagatgaaagtgctcggcaacaccgataagaagtacattaaaaagaatctgcttggggcccttctcttcgactctggagagacagcggaagctaccagactgaaacggacagcccgcagacggtatacccgcagaaagaaccggcttcgctacctgcaggagatctttgccaatgaaattgctaaagtggatgagagcttctttcaaagactcgacgaatccttcctgacagatgacgataagacctttgactctcaccctatcttcggcaacaaggccgaggaggatgcttatcatcagaaatttccgacgatctaccatctgcggaagcacctcgccgacagctccgaaaaagcggatctgcgccttgtctatctggccctcgctcacatgattaagttcagagggcattttctgatcgagggagaacttaatgccgagaacaccgacgtgcagaaaattttcgctgactttgttggcgtgtacaatcggacattcgatgactctcacctgagcgagatcaccgtcgatgtggcctccattctcacagaaaagatcagcaaatctcgcagactggagaacctgattaagtactatcccaccgaaaagaaaaatacgctctttggcaacctgatcgcgcttgccctggggctccagcctaatttcaagacaaacttcaaactgtccgaggacgctaaacttcaatttagcaaagatacctacgaagaggacctggaggaactcctgggaaagatcggcgatgactatgccgatctgttcacatctgctaagaatctctacgacgccattctgctttccgggatcctgaccgttgatgacaacagcaccaaagctcccctctctgcttccatgattaagcggtatgtggagcaccatgaagacctggagaaacttaaggaatttatcaaagcgaacaagagcgagctgtaccacgatattttcaaggacaaaaataagaacggatatgccggctacatcgagaatggggtcaaacaggatgaattttacaagtatctcaaaaacatcctgtccaagattaagatcgacggatctgattacttcctggacaaaattgagcgcgaagattttctcagaaagcagcggacattcgacaatggcagcatccctcatcagattcatctgcaagagatgcacgctatccttagacgccagggcgattattacccctttctgaaagaaaagcaggaccggatcgagaaaattctcacgttcagaatcccttattacgtggggccgctggtgcgcaaggattcccggtttgcctgggccgagtatagaagcgacgaaaagattaccccctggaacttcgataaggtcatcgacaaggagaaatctgctgaaaagtttattacacgcatgaccctgaatgacctttacctccctgaggagaaagttctgcccaagcactcccacgtgtacgaaacatatgccgtgtacaacgagctgaccaaaatcaagtatgtcaatgaacagggaaaggagagcttcttcgattctaacatgaaacaagaaatttttgaccatgtgttcaaggagaatcggaaagttacgaaggagaaactcctgaactaccttaataaggaatttcctgagtatagaatcaaggatctgatcggcctcgacaaagaaaacaagagcttcaatgcgtccctggggacataccacgatctgaaaaagattcttgacaaagcctttctcgatgacaaggtgaacgaggaagtcatcgaggatattatcaagaccctgaccctgttcgaggacaaagatatgattcatgaacgcctccagaagtattctgacatctttacagccaaccagctgaaaaagctggagcggagacactacaccggatggggccgcctgagctacaaactcatcaatgggattcggaacaaggaaaataacaaaacaatcctggattatctgattgacgacggatccgccaatagaaacttcatgcaacttatcaatgatgacacgctcccctttaagcagattatccaaaagagccaggtggttggcgatgtggacgatatcgaggctgtcgtgcacgacctgccgggctctcctgccattaaaaaggggatcctgcagtccgtcaaaattgtggatgaactcgttaaggtgatgggaggcaaccccgacaatatcgtcattgagatggctcgggagaaccagaccacaaatcgcgggagaagccagtctcagcaacggctgaaaaagctgcagaactcccttaaggaactcggaagcaatatcctgaacgaggaaaaaccttcctacatcgaggataaggtggaaaattctcatctgcagaacgaccagcttttcctctattacattcaaaacggcaaagatatgtataccggggacgaactggacatcgatcacctgagcgactacgatattgaccatatcattccccaggcctttatcaaggatgactccattgataatagagttctcacatctagcgcgaaaaaccgcggcaagtccgacgatgtgcccagcctggacatcgtccgggccagaaaggctgagtgggtgcgcctttataaatctggactgatctccaagagaaaattcgataatctcaccaaggccgaacggggcgggctgacggaggctgacaaagccggatttattaagcgccagctggtggaaaccagacagatcacaaagcacgttgcgcaaattcttgatgcccggttcaacaccgagcacgacgagaatgacaaagtcatccgcgatgtgaaggtgattacactgaaaagcaacctcgtctctcagttcagaaaggactttgagttctacaaagtgcgggagatcaatgattaccatcacgctcatgacgcctatctgaacgctgttgtgggcaccgccctcctgaagaagtaccctaaacttgcctccgaatttgtctatggggagtacaagaaatatgatatccgcaagttcattacgaatagctctgacaaagctacagcgaagtactttttctatagcaacctgatgaactttttcaaaaccaaggtgaagtacgccgatggaacagtttttgaaagaccgatcattgagaccaatgctgacggcgagatcgcctggaataaacagattgatttcgaaaaggtgcggaaagtcctctcctacccccaagtgaacatcgttaagaaagtggagacccagacagggggctttagcaaggaatctatcctgcctaagggagactccgataaactgattccccgcaagacgaaaaaggtctattgggacaccaaaaagtacggcgggttcgatagccctacagtggcctattccgtgttcgtcgttgctgacgtggagaagggaaaagccaagaaacttaagaccgtgaaagaactggtcggcatctctattatggagcggagctttttcgaggaaaatcccgtggagtttctcgaaaacaaggggtaccacaacatcagagaggacaagctgattaaactcccgaagtattccctgttcgagtttgaaggaggcagacgccggcttctggcgtctgctagcgagctccagaaagggaatgaaatggttctgcctggctacctggtggagcttctgtatcatgcccacagagccgataacttcaattccacagaatacctcaactacgtctctgagcacaagaaagagtttgaaaaggtgctgagctgcgttgaggacttcgctaatctctatgtggatgtcgagaaaaacctgtccaagatccgcgccgtggcggacagcatggataatttttctattgaagaaatctccaacagcttcatcaatcttctgaccctgacggctctcggagcccccgccgactttaacttcctgggcgagaagattcctcggaaaagatacacatctaccaaggagtgtcttaatgctaccctgatccatcagtccattacagggctctatgaaacccgcatcgatctgagcaaactcggagaggaatga

SEQ ID NO: 4319 - RNA, 4119 nt, synthetic construct
  misc_feature 1..4119: note = Cas9 variant
  source 1..4119: mol_type = other RNA
atgaacagcgacaagagagaggattactatgtgggcctggacatggggaccggatccctcggcggggccgtcacagatacgcagtaccatctgcttaaagttaagggaaaagacttctggtttgtgcgggaatatgagaccgctaagtctcaactggatcgcagaacacaccggatcgccaaacgcagactccagcggcacaaggcgcgcattggcctgatcagaagctacttcgctgaagacattcttaagcatgatcccctgttttatatccggcaggacaattccaaatactatcacgaggataaggacgtgcgcctcaccacaaaagattctattttcgccgaccctgggtacggagataaggaatacctggacgacaaagagtatccgaccatctttcatctgagacaggccctcctgcgggatcaaatcaaggacgaggaacgctacagcagattcctttatctggctattatcaacatgtttgagcaccggggccacttcctcctgaatacagaatcctctgatcttaacgccgacatgattaaggatgtcggcgagctggtgatgaatgctatctgcggggttagcgagtacggatccgtgacctataaagaaattatcgagattctcgaagacaagaacatcagccgcacggccaaaaaggatcagatcgcgtctaaaattgacatcaagaaatccgagaaggcccagatggaaagaattaagtgtctgtgcggcatggaggctgatgcccgggtcatgtttgagatcgaagctgacgagaaaattaagatcgccttccagcaagcggcctttgaagatgagaaagaagagatcgaggctgtgattggggaagacagatacctgatcattgagaatatgaagcagctctatgactacagccagctgcagtctgttcttaacggattcgattacctgtccgacgcccgcgtgcaaatgtatgaaaaacataaggaggatctccatctgcttaagaaagtctaccggaagaatctggacagagaaatctatgatcgcatgtttcggagcggcgaggaggggtcttactgtgcttattccaacagcaccaattccgtggactctctcgccgaagccaaaaagtacagacgcaacatgaaaaagcggagccagaaggatctgtatgacagaattaaaaaggatctgaaagaggtgcacgacgctgatgcggacgccatccgcaaggaaatggagctcgagcggttcctgcccaaacagatcacaggagctaatggcattatccctaaccaagtccacagaaaggaacttaagaaaattctggagaatgccgaacaccatctcgatttcctgaaggagaaagacgaatccggctacaccgttagcgagcgcatccttatgctgttttcttccaacattccctactatgtggggcctgtgggaagcggctctaagacagggtgggccaaaatccaggagagcggacaggtcctcccctggaacatggaacagaagattgacatcgagcaaacctccgaacggttcatcacgaatctgattagagagtgcacatacctgtctggcgaaaaagtgctccctaagcagagcctgctttatgagtcctactgtgttctgaacgagatcaataacctccggattcacgggaagcgcatcgtgccggaactgaaacaggatatttataaggaggtctttcagggattcagactgggcaaaaaggtgaccaaaaagaatatctgcacataccttatcaaccggggcctcattaccgaagagagcgaagtttctgggatcgacaaggagattaatgcttatctgccctcctacggaaaaatgtacggcgtgtttggggagagactgcgcgaagaggccgtccaagaaatcgcggagaagattatctattacggaaccatctatggcgatgctaaaagcatgttccggaagaaactcaaccagtacgtgtctgacgggtggatgacagagtatcaggccaagagaatttccggctacaagtttaaagattgggcccgcctgagcagatccatgctttgtctgtctggatgcgacaagagcacgggcgagaaaatctccctcattcgggctatgtgggaatataatctgaacttcatggaactgatctaccgcgaggattttaccttccagaaggaacttgaggagagacggaaagccctcgggaagacactgcaagaatttcagttcgaggacctggatgaatactattactctgctcctgtcaagcgcatgatttggcaggccgtgcaggcgctcaaagagatcacccaaatcatgggacataatcccaagagaatttttatcgaaatgacacggaccgaggaggaaaaaggcgagcaggggcgcaagaacagcagagaaaaacggctgcttaagatgtatgagtccattcgcgacgaaagaaattgggccgctgagatcaaaaacgccaatgctagcggaaagctgaactctaagaaactctacctgtattacctgcagatgggccgggatgtttatacgggggagcctattgacatcgaagatcttttcgacgactccagatacgatattgaccacatctacccccgcagcctcacaaacgataataacatcgagaataacctggtgctggtctctaagaccattaatcaaaacgaaaagaaaaatgactatccggtgcctgagaaaatccggagaaacaagaaggttcgcaatctctggcataccctgcacaaaatgggcttcatgaacgatgagaagtacaatcggcttacatccaccgaaagactgagcgaggaccagctcgccggatttattgcgcgccagctggtggaaacagcccagggcgctaaagggatcgccgagctgatgaaggctatgcttcccggaacggatattgtctatgccaaagcccggaacgtgtctgacttcagaaaggaatacaagatgctcaaaagccgcctggtgaatgattatcaccatgctcaagacgcgtacctgaacatcgttgtcggcaatgtgtattttatgaagttcacccggaaccctatgaactttgtgaaaacagaggccagacgggatgggcgcaattacgactacaacctctataagatgtactccaaagacatcattagaaatggagagaaggcttggatcgccaccagcgaacagggccccgggacaattcggctggtcaaggagaccatgggccgcaacacgcccatcattaccagacaggccttcgaacagcggggagagctttttaatctgcaacctgtgggcaaatattctgctaagaaagataactacgttccgctcaagatcaatgacgagaaaatgcaggatgtgtccaagtatgggggatacacaagcctgaacccctcctatttcatctttattgaacacggccctgagaagaaaagaaagaaatgtttcgaagtcatccattcttactacgccgcgcagattaagaccgagaaagacctgatcgattttcttctgcagaaggggtataaaaatccccgcgtgattaacgctcggatcaagaagaatgccctcattaaatacaacggatatttcctgtacatcatcggcatggacgccagaaagaatattgaatttagcaacgctacagccatgtgcctcaaaaataagtatatccaatacgtttgtaaactggagaagatgaacaaggcgattcttctgtccgaaaaacagaagaccaacctccactgggatgagaaaatcacgtgcgagtctaatctggaactgtatcgcgagcttacagaaaagcatctgcacagcatttaccagcggcaccctagatccatcgggaaatgcctcgctgacggcgagggagccttcaagctgctcgatatcgaggaacaagtgaagattatctgtgacattgtccagtacacctctttccagcgcggcgtgtttagcctgaaagttcttgggggacccaaggaggtgggccggatcagaatttccgggaacatgacagaagccaaagagtgcaagctggtcaattatagcatcaccggaatgtacaaaaccgaaatggatctcctgaagaagtga

SEQ ID NO: 4320 - RNA, 4122 nt, synthetic construct
  misc_feature 1..4122: note = Cas9 variant
  source 1..4122: mol_type = other RNA
atggagaagacctacagcatcggcctggacattgggacaaactccgtgggatggtctgtcatcacggatgactataaagttcccgccaagaaaatgaaggtgctcggcaataccgataaaaagtacattaagaaaaacctgcttggggctctgcttttcgacagcggagaaacagccgaggtgaccagactgaagcggacagcgcgcagacggtatacccgcagaaagaatcggcttcgctacctgcaggaaatctttgctaaggagatggccaaagtcgatgaatccttctttcaaagactcgaggagtctttcctgacagacgatgacaagacctttgatagccaccctattttcggcaacaaggccgaagaggacgcttatcatcaggaatttccgacgatctaccatctgcggaaacacctcgccgattcctctgagaaggctgacctgcgccttgtgtatctggccctcgcgcacatgatcaaattcagagggcattttctgattgagggagaacttaatgccgagaacaccgatatccagaagctgttcaatgactttgttgaaacatacgacaaaattgctgatgagagccacctctccgaagtggacgccagctctatcctgaccaacaagatttccaaaagccggcgcctggagaatctcatcaagcagtaccccacagagaagaaaaacaccctgttcggcaatcttgtcgctctggtgctcggcctgcaacctaactttaagacgaatttcaaactttctgaagatgccaagctgcagttctccaaagacacatatgatgaggacctcgaggaactgctggggaagattggagatgactacgcggatctctttaccgccgctaagaacctgtatgacgccatccttctgagcggcatcctcacagttgatgacaattctaccaaagctcccctgtccgccagcatgattaagagatacgaggaacaccatgaggaccttgaaaaactgaagaaattcatcaaggtgaacaactttgataagtatcacgagattttcaaagacaagtccaaaaatgggtacgccggatatatcgaaaacggcgtcaagcaggatattttctacaaacatctcaagtctatcatcagcgagaagaatgggggacagtacttcctggacaaaattgaacgggaggattttctgcgcaagcaaagaaccttcgacaacggctccatccctcaccagattcacctccaggagatgcgggctatcctgagacgccagggcgaatattacccctttcttaaagagaatcaagcgaagattgaaaagatcctgacattccggatcccttattacgtggggccgctcgccagaaaggatagccgctttgcttgggccaactatcattctgacgagcccattacgccttggaatttcgatgaggtggtcgacaaagaaaagtccgccgagaagtttatcacccggatgacactgaacgatctgtaccttcccgaagagaaagttctccctaagcacagccatgtgtatgaaaccttcacagtgtacaatgagctgaccaaaattaagtacgtcaacgagcagggagaatctttctttttcgacgctaatatgaaacaggagatctttgatcacgtgttcaaggaaaacagaaaggttacgaaagccaagctgctcagctatctgaataacgagtttgaagagttccgcattaatgaccttatcggcctggacaaagattccaagtcttttaacgcgagcctcgggacataccatgacctgaaaaagattctggataagtccttccttgacgataaaaccaacgagcaaatcatcgaagacattgtgctcaccctgacactgtttgaggatcgggacatgatccacgaaagactccagaagtatagcgatttctttacctctcagcagctgaaaaagctcgagcgccggcactacacaggatggggcagactgtcctataaactcattaatgggatccgcaacaaggaaaataacaagacgattctggacttcctgatcgatgacggacatgctaatcggaactttatgcaacttatcaatgatgagagcctctctttcaaaaccattatccaggaggcccaggtcgtgggcgacgttgacgatattgaagccgtggtccacgacctgcccggctccccggctatcaagaaagggattctgcagagcgtgaagatcgtcgatgagctcgtgaaagttatgggagacaaccctgataatatcgtgattgaaatggccagagagaaccaaacaaccaatcgggagcgctcccagtctcagcagagactgaagaaacttcaaaacagcctgaaggaactcggctccaatatcctgaacgaggaaaagccctcttacattgaggacaaagtcgaaaatagccatctgcagaacgatcagcttttcctctattacatccagaacgggaaggacatgtacacaggagatgagctggacattgatcacctgtccgactatgacatcgatcacatcattcctcaggcttttatcaaagacaatagcattgataaccgggtgctcacctcttccgccaagaatagaggcaaaagcgacgatgttccctctctggacatcgtgcgcgcgcggaaggccgagtgggtcagactttacaagtccgggctgattagcaaacgcaagttcgataacctcacgaaagctgaaagaggcggactgaccgaggccgacaaggctggctttatcaaacggcaactggtggaaacacgccagattaccaagcatgtggcccaaatccttgatgcgagattcaatacaaagcgggacgagaacgataaagttatccgcgacgtcaaggtgattaccctgaaatctaatctcgtgagccagtttagaaaggaatttaaattttataaggtccgggagatcaacgattaccaccatgcccacgacgcttatctgaatgccgtggttgggacggctctcctgaagaaataccccaaacttacacctgagttcgtgtatggagaatacaaaaagtacgacgtccgcaaactgattgccaagtccagcgatgactattctgagatgggcaaggccaccgctaaatactttttctattccaacctcatgaactttttcaagacagaagtgaaatacgcggatgggagagttttcgagcggccggacatcgaaaccaatgccgatggagaggtggtctggaataagcagaaagactttgatattgtgcgcaaggttctgagctatccccaggtgaacatcgtcaaaaaggtggaggaacaaaccgtgggccagaatgggggcctgttcgacaacaacatccttgctaagcctgagaaagatgacaagaaaaagctgtttcccattaaaaagtccctctctacaacgagctacggaggctatgccagagccaccatcgcttactccattctgatcgtctctgagttcgggaagaataaagaactcaagctgcttggactgcctctcctggataaagttaagtacgagaaaaaccccattgcctatctgaatagcatcggcatcattaacgtgaagtccatctttaaacttccgaaatactgcctgttcgaatttcaggagaagaatacaaactatcggagatacatggtgtctaatcaggaactcaaacgcgcgaaccaactgttcctcacctgtaaggagacagaactggtctataaatacattaagagcgacaatgataacacccatcttgtggggaatgagaagacgatcctgtccatttggaacaaactggttatctttatggagcggacaaagctcattgacaaaaagctgttcgctagccttaaacagctgaaggacgaagtggatctcatcaatatcctggacatgaccgccaaatctctcgattttaccaagatttccgccggacagaagaaaatcacaattagcgactctctgtcccttcctatcaagagatggcagttcagctctgatgagaaaatgctgaagcaactgaaaaccgctacactcattcaccagtccgtcacgggcctgtatgaaacccgcatcgaccttagcaagctgggggaggaatga

SEQ ID NO: 4321 - RNA, 4122 nt, synthetic construct
  misc_feature 1..4122: note = Cas9 variant
  source 1..4122: mol_type = other RNA
atggagaagacctacagcatcggcctggacattgggacaaactccgtgggatggtctgtcatcacggatgactataaagttcccgccaagaaaatgaaggtgctcggcaataccgataaaaagtacattaagaaaaacctgcttggggctctcctgttcgacagcggagaaacagccgaggtgaccagactgaagcggacagcgcgcagacggtatacccgccggaaaaatagacttcgctacctgcaggaaatctttgctaaggagatggccaaagtcgatgaatccttctttcaaagactcgaggagtctttcctgacagacgatgacaagacctttgatagccaccctattttcggcaacaaggccgaagaggacgcttatcatcaggaatttccgacgatctaccatctgcggaaacacctcgccgattcctctgagaaggctgacctgcgccttgtgtatctggccctcgcgcacatgatcaaattcagagggcattttctgattgagggagaacttaatgccgagaacaccgatatccagaagctgttcaatgactttgttgaaacatacgacaaaattgctgatgagagccacctctccgaagtggacgccagctctatcctgaccaacaagatttccaaaagccggcgcctggagaatctcatcaagcagtaccccacagagaagaaaaacaccctgttcggcaatcttgtcgctctggtgctcggcctgcaacctaactttaagacgaatttcaaactttctgaagatgccaagctgcagttctccaaagacacatatgatgaggacctcgaagaactgctggggaagattggagatgactacgcggatctctttaccgccgctaagaacctgtatgacgccatccttctgagcggcatcctcacagttgatgacaattctaccaaagctcccctgtccgccagcatgattaagagatacgaagaacaccatgaggaccttgaaaaactgaagaaattcatcaaggtgaacaactttgataagtatcacgagattttcaaagacaagtccaaaaatgggtacgccggatatatcgaaaacggcgtcaagcaggatattttctacaaacatctcaagtctatcatcagcgagaagaatgggggacagtacttcctggacaaaattgaacgggaggattttctgcgcaagcaaagaaccttcgacaacggctccatccctcaccagattcacctccaggagatgcgggctatcctgagacgccagggcgaatattacccctttcttaaagagaatcaaagcaagattgagaaaatcctgacattccggatcccttattacgtggggccgctcgcgagaaagaactctcgctttgcctgggctaaatatcattccgatgagcccattacgccttggaatttcgacgaggtggtcgataaggaaaagagcgccgagaaatttatcacccggatgacactgaacgacctgtaccttcccgaagagaaggttctccctaaacactctcatgtgtatgaaacctacgccgtgtacaatgagctgacaaagattaaatatgtcaacgagcagggaaaggagagcttcttcgattccaatatgaagcaggagatctttgaccacgtgttcaaagaaaacagaaaggttaccaaagagaagctgctcaattacctgaacaaagaatttcccgagtatcgcattaaggatcttatcggcctggacaaggagaataaatctttcaacgctagcctcgggacgtaccatgacctgaagaaaattctggataagtcctttcttgacgataaagtgaacgaagaggtcatcgaagacatcattaagacactcaccctgttcgaggataaggacatgatccacgaacggctgcaaaaatatagcgatatttttaccgccaatcagctcaagaaactggagagacgccactacacaggatggggccggctttcttataagctgatcaacgggattagaaataaagagaacaataagaccatcctcgactacctgatcgatgacggatccgcgaaccgcaatttcatgcagctgattaacgatgacacacttccgtttaaacagatcattcaaaagagccaggtggttggcgatgtggacgacatcgaagctgtcgtgcatgatctccctggctctcccgccattaagaaagggatcctgcagtccgtcaagatcgtggacgagctggttaaagtgatgggaggcaatcctgataacattgtcatcgaaatggcccgggagaatcagacgaccaacagagggcggagccaatcccagcagcgcctcaagaaactgcagtctagccttaaggagctgggatccaatattatcaacgaagagaagccctcttacattgaagacaaagtggagaatagccacctccaaaacgatcagctgttcctgtattacatccagaacggcaaggacatgtatacaggggatgaacttgacatcgatcatctctccgactacgatattgaccacatcattccccaggcttttatcaaagacgatagcattgacaatagagttctgacctcttccgccaagaaccggggcaaaagcgatgacgtgccttctctggatatcgtcagagctcgcaaggccgagtgggtgcggctctataagtccggactgattagcaaaagaaagttcgacaatcttacaaaagcggagcgcggcgggctgaccgaagccgataaggctggatttatcaaaagacaactcgtggagacgcggcagatcaccaagcacgttgcccagattctggacgctcgcttcaacacagaacatgatgagaatgacaaggtcatcagagatgtgaaagtgattaccctgaagtctaaccttgtcagccaattccggaaagactttgaattttacaaggtgcgcgagatcaatgattatcaccatgcccacgacgcgtacctgaacgccgttgtgggcacagctctcctgaaaaagtacccgaagctcgcccccgagtttgtctatggggaatacaaaaagtatgacgtgagaaaactgattgctaagtccagcgatgaccattctgagatgggaaaagccaccgccaagtacttcttttattccaatcttatgaacttctttaaaacgaaggttaagtacgctgatggcagcgtgtatgaacggcctatcatcgagacaaatgcggacggggaagtcgtgtggaacaaacagaaggatttcgagattatccgcaaagttctgtcctacccccaggtgaatattgtcaagaaagtggaggaacagaccgtgggccaaaacggaggcctctttgacaataacatcctggccaagcctgagaaggatgacaaaaagaaactgttccccattaagaaatctcttagcacaacctcctacgggggatatgctagagccaccatcgcctactctatcctgattgtcagcgaatttggcaagaacaaggagctcaaactgctcgggctgccgcttctggataaggttaaatatgagaagaatcctatcgcttacctcaactccattggaatcattaatgtgaaatctatcttcaagctgcccaagtattgcctgttcgaatttcaggagaaaaacacaaattaccggcgctatatggtgagcaaccaggaacttaagagagccaatcagctgttcctcacgtgtaaagagaccgaactggtctacaagtacattaaatccgacaacgataatacacacctcgtgggcaacgagaagaccatcctgagcatctggaataaacttgttatttttatggagcggacaaagctgatcgacaagaaactgttcgcgtctctcaagcaactgaaagatgaagtgaaccttattaatatcctggacattgcttccaagagcatcgactttaccaaaatctctgccgggcagaagaagattgtcctcaacgattccctgagcctccctatcaaaagatggcagttcaagtctgacgagaaaatgctgaagcagcttaatgatgccacgctgattcaccaatccatcacaggcctgtatgaaacccgcattgacctcagcaaactgggagaggaatga

SEQ ID NO: 4322 - RNA, 4122 nt, synthetic construct
  misc_feature 1..4122: note = Cas9 variant
  source 1..4122: mol_type = other RNA
atgaacctgagacgggcccgcgactacagcatcggcctcgatctggggaccggatccgtgggctgggctgtcacagacgccgaggggaatctttattctttcaagggaagacccgcgatgggcagccggacgtttcctaacgctgaaccggcctccgttgcccgcattcccagagggcagcggcgcagatacgagcggcgcagacaacggatcaaactgctccagcagttctttatgtctgatatggaacgcgtggaccctgatttctttaccagactgaatcagagcacacttctggctgaggacaaggatgaacggattgcctcctgcgcttggcccatcttcaactctagcgactttaccgagaaagattattacaagaaattccctacaatttatcacctccgcgcctttctgtgtgagtccgacgaaaagggagatctgagactcgtgtacctggcgcttcataatatcgtcaagcaccggggcaacttcctgtatcaagacaatcccgccctcagcgcttctgatgcctccgtggacgaggctgttagacagctggtggacgcccttgcggaatggtgccagaacaaagagatcgagctgagctgtgatgccggccgcattatcgaagtctttggggacgcttctctccggagaaccgataagcgcgaccagctgaaaggactgctcggcctgcctgccgatcttgctaagacaatggggaaagagctggcctccgccgtgctcggatacgctgcgaatttcagcaagatttttctgatctctgacgccgaacataagttctcccttggcaacgatgagaaagttgaagagttcgagaccatttgcccgaatgaatgtacgagcctgttttccgctctccggaccgcctactctgcctatctgctgagcgggatcctcagagacgctaacggaaagacactgtccttctgcaaaaagaaagagtacgatcgctatcacgacgatcttgccctgctcaaggcgctggtgcgggaatacgctcccgagagctatcaatctttcttcggcggcgaaagacttgtcgtgaatgggcgcatgaccaaacggtacgaccctacaaaggccaagggatataccaaatacgacctggtgcattccgccggcagctacgatgagctcgctaaggacgtcaaaaagctgctggggtctctcgccgctgatgacagcagatatcagcgcatgatgcaggcctttgatgaggaacggttcctgagacggcttaaaacgtccgacaacggatctattccctaccagctgcacctcgaggaactgcgcgcgatcatcgccagacaaggcgagttttatcctttcctgaaggaagagagcaagaaaattgagtcccttgttagctttcggatcccctactatgtggggccgctcacaaccaagaatgctgccgtggatgtccacggaaacaaaagattcgcttggtctgaacgcaagcctggcatggagtccgccaaagtgcggccctggaactgggacgatgttattgacagaggcaagagcgcggaaaattttatcgtgcgcatgacagggacctgtacctacctgcagaacgagaaggtcctgcctaaatgctctctcctgtatgaggaattttgtgtgcttaatgagctgaacggagcccattggtccgctgatggcgaccacgaatgcccctttgatacaagcgacagacgggggattgttcaggacctcttctgtggaaagcgcagagtgtcctacaaacaagtcgaggattggctgcggcagcatggctctcgcagagcccgggtgagcgggggccagggagcttccggcttcgaatctaagatgagctcctacatctttttcagcaaagacgtcctgcacgtggatcgcatcgaccccgccgattttcctatgattgaggagatcattctttggaatacgcttttcgaagacagagatatcctgaaggagcggattgaagaggcctatggggaccgcctgaacgctgaacagatcaagaccatctgcaaaaagagatttacaggatggggccggctctctagacgcctgcttaccgggattaaagcgcaaacagatcagggagacctgtccatcatggatattctccgggagggcgacccgaataacgatcacagagggaaggccatggttttcatgggcatcctgcatagcgaggacctgggatttcagaaaaagattgaccagatcaatcaagaaaaagtgtctgctggcaaggtctcccttgaggatctccccgggagccctgccctgcgccggtctattaaccaggccatgagagtggttgacgaaatcgtgagcatcgctaagtgtcccccttcccacatttacctggaggtcacccgcgatgaagacggagcccggaaaggcagacgcagcacgcggagatatgatgcgatcaaggctgccctcgagaaattcaaggaggaatctcccacatggtttgaccaggatgtgttcggggagtttcggcgctccagagccgaagacctggatgagcggcttagcctgtacttcatgcagggaggcaaatccctctattctgctaccccgctgaagctggagcttctccataccaatcaataccaggtggaccacattatccctcagagctatattaaggatgactcctttgaaaacaaagccctggttctggcgggggagaatcagcgcaagtctgacgctctcctgatcgatagctccatcagaacagccatggccccctactggcgggctctccatcaagccggcctgatgggagacaaaaagttcaactctctcatgtgcagctccattagcgataaaagagtccgcggcttcatcgctcggcagctggtggaaacctctcagattgtgaagctggccgggatgatgcttcaatccaattaccctgaggcggacgtccagcccgtgaaggccagcctgggacacgatctcagagttcaggctggctttatcaaatgccgcgaagtgaacgacttccaccatgcccacgatgctctgattgcctgtgaggtcgggcggtatatcaaccagtgccatcctggaatctacgacaatcccattggctatgccagagctgtgcgcgagctcgttcggaagcaaaacgaagagatgagaaaatacgggcgcctgccgggctctgcgggatttatcgtgggcgggttcatgagaacacacgtcgatgtggacacgggagaagttgtgtgggatgccgaggaggaactttcccggattcgcgcttatctggactacagcaatgtctttgtgaccagaatgtctgaggaaacatccggcgccctctggaacgccaccatctatagccctcactacgggaagacagctcccaccctgcatattaaacagggactggatgtgcagcggtacggcggctattccagcgccacgttcgcgtactttaccctttatgtcgctgagaaggggaagaaacgcaaggccgaactgctcggaatccccatctctgttgccagaaaaattgagggcgaacctagcaagctggacgctttcgtggcccaggacgcggaggctaaaaagctcaaacacccgctgatcattcgggccagaatccttaagtacgcccgctttgagatggaagggaatcaattctattttgctgcccaggatgctgtgtactccgcccggcagctggtcctcaagggagacctgtattctgtggcggccaaggcttgtgataaacatctgaacgacagctgcatttccaatgaggatcttatcagactgtacgacgaactcgttcacaaaggcgatctgctctgtaacaagttcgggaatgtgacagacgtcctgcgcgccggacgggagagatacgctggcctttctattagcgagaaacggcagctggtgtgcaacgttctggcctattaccgctccgccaccgctagagtggatatctctctcgtcggcgggcccaagcatgcgggaaatctgggcatcgccttcgtgcttaacaatcctgaagctattgtttttgtggaccaaagcgtcacagggatgttcgagaagcggacccgcgtggaactgtga

SEQ ID NO: 4323 - RNA, 4122 nt, synthetic construct
  misc_feature 1..4122: note = Cas9 variant
  source 1..4122: mol_type = other RNA
atgaagaaaatcctgggcctcgacctggggaccaacagcattggatgggcccttgtgaatgaggctgataacgaaagagagaagtcctctatcattaaaatcggcgtccgggttaatcccctgacagtggacgaacagcaaaacttcgagaaggggaaaagcattacgaccaatgccgatcgcacactcaagagatccatgcggcgcaacctgcagagatttaaacttcggaaagaaaatctgatcgagatcctcaagaaacagaagttcattaacgacgagaccatcctgtctgaaaatggaaacaaaagcacatttgagacctacaatctgcgcgcgaagtccgctacagaagagattaccctcgagcagttcgccagagtgctgcttatgatcaacaagaaacggggctataagtctagccgcaaagccaagtcccaagatgaagggcagctgattgacggaatggagatcgctaaaaagctctacaatgataacctgacgcctggccagtttgtcttccagattcttaaagaaggcaagaagtatatcccggacttttacagaagcgatctgcaagccgagttcgacaaaatctggtcttttcagaagcagttcaatcccgatattctcaccgaagagtttaacaaacagatcattgggaagggaaaagtgaacacaaccaagatcttcctggctaagtatggcatttacacaatcgacaataaaggggccgataagaaatcccaagcgtataactggcgggttgaggccctgaccaatcagctcacgaaggaggaactggcttttgtgatcagcgaccttaacggaattatctctaattccagcggctacctggggtctatttccgaccgcagcaaagaactctacttcaacaagcagacagtcggacaatatctgatcgcccagcttaaggagaatcctcacacccagctgaaaaaccaggtgttctacagacaagattatctcgacgaatttaatacaatttgggagacccaggctaagttccataaagagctgaccaacgaactgaaggaggaaatccgggatatcattatcttttaccagcgcaaactcaagtcccagaagggcctgatttctttctgcgagtttgaaagcaaacaaatcgagattaatatcgacggcaagaaaaagctgaaaacagttgggtccaaggtgtgtcccaaaagctctcctcttttccaggtctttaagatttggcagatcctcaacaatatccaggtgattgagaagtccacgggaaaaagcaagttcctggaacaagatgagaaagaaatcctttttaaggagctgaacttcaaagacaagatttctaagaccgatgccctcaaaatcctgtataagaattacaaagagctggactttaacttcaaggaaaacattgagggcaatagaacacaggcgacctttctcaaagccttccagagcatcatcgaactgtccgggcacgaggtgtctgatttcagcaagattaagacagacgaaatccttgagattgtcacccccatctttgagggattcggctttaacacgaatctgctccagttcaactccaatctgaaagggaaggattttgaaaaacaagctgtttatcagctgtggcatcttctctacagcttcgagggagacaactctaatacaggcaacgaaaagctgattcagaaaatctccgagctgtacggctttgaacgggagtatgccatcattatcgctaatattagcttccaacctgactacgggtctctctccaccaaggccatcagaaagattctgccgcaccttaaagagggaatcgaatttagcctggcctgcgagtatgctggctaccgccattccaagaactctctcaccaaagaagagaagaataaaaagatcctgaaagataagattgacatcctgcccaagaacagccttcggaatcctgtggtggaaaagattctcaaccagatgatcaatgtcgtgaacgcgacaattgagacctatgggaagcccgatgagatcagaattgaactggcccgcgagctgaaaaagtccgctaaagaacgggaggacctcacaaacgccatcaataagtctacgctggatcacgagaagtacaaagcccttctgcagaaggagttcggactcagcaacgtttccagaaatgacatcattcgctataaactgtacctggaacttgaacacaacggctttcataccctctacagcaatacatatatcgagcctaacaagctgttctctaaagaatttgatattgagcacatcattccccagtcccggctgttcgacgatagcttctctaataagaccatcgagtccagaagcgctaacatcgaaaaggggaatgagacagcctttgactacgtgtctaacaaaaatggcgaagtcggactcaaggattatctgaaaaacattgaggaccttttcaataacggcaagatcagcaaaaccaagtacaataagctgaaaatgaagggggatgaaattccgtccgactttatcgcgcgcgacctccgggatacgcaatatattagcaaaaaggctaaatctatcctggaggacctggtgaaggatgttgtgtccaccggaggcagcatcacagacagacttcgcgaggattggcagctcattgacatcatgaaggaactgaactgggataaatacgacaagctggggctcaccgaggtcattgaaaacaatgatggacataaaatcaaccggattaaggactggacaaaaagaaatgatcaccggcaccatgccatggacgccctgaccatcgctttcacgaagcgctcctatattcagtaccttaacaatctgaacgccagatctgataaaagcggctccatctacgggatcgagcagaaggaactctatcgggacaagaataacaaactgagatttaagcctcccattcctctggacgatttccgcgctgaggccaaaaagcaacttgagaatacactggtgtctatcaaagcgaagaacaaggtcgccaccattaatatcaacaataccaaaaagcagggcggagaaaacaaaaagaaacagctcacaccccggggccagctgcacctcgagaccatttacgggagcatccaacagtatgtgacaaaggaagagaaggttggagctaattttaacaaagagctgatcgaaaaggtggccaataaaaagtgtagagaggcccttctgaaacgcctcattgagttcgacaacgatcccaagaaggcttttacgcggaaaaactccctgaataagaaccctctgtacatcgacaccattaaaacatataaggtcccggaaaaagtgaagaccgttacaaccgaaacgatctacacaattagaaaagatatcaatcccgaccttaagatcgataaggtggtcgacaaaaagattaaaaacatcctggagctccgcctgaaggagttcaatggcgatgcgaaaaaggccttttctaacctcgacgaaaagcctatttggctgaataaagagaaggggatcagcattaaaagagtgaccatcaccggaatttccaacgctatcgcccttcatgataagaaagacaaggaaggcaatttcatcctggacaaccaggggaagaaacaagctgtggatttcgttaatacaggcaacaatcaccatgtcgccatttataaggacgagaaaggaaacctccaggaaaatgtgatcaccttttacgaggccgtggagcgggtcaaccagggcattcccatcattgataagacatacaaacagaacgaagggtggcaattcctgtttagcatgaagcagaatgagtatttcgtgtttcctaacgaaaagacgggattcaattctaacgagatcgacctgcttaatcccgaaaactaccacctgatctccccgaatctctttcgcgttcagaaaattgctaccaaggattatttctttagacaccatctggagacaaacgtggagaatatcaccacaaccaaagacctcacgtggaagcggctgggcattaacgggatcattaatatccttaaagtccgcatcaaccacattggacagatcgtgagcgttggcgaatactga

SEQ ID NO: 4324 - RNA, 4122 nt, synthetic construct
  misc_feature 1..4122: note = Cas9 variant
  source 1..4122: mol_type = other RNA
atgaccaagaaaaactacagcatcggcctggacattgggacaaattccgtgggatgggccgtcatcacggatgactataaggttcccgctaaaaagatgaaagtgctcggcaacaccgataagaagtacattaaaaagaatctgcttggggccctcctgttcgactctggagagacagcggaagctaccagactgaaacggacagcccgcagacggtatacccgcagaaagaaccggcttcgctacctgcaggagatctttgccgaagagatgacaaaagtggatgaatctttctttcaaagactcgacgagtccttcctgcggtgggatgacgataataagaagctgggccgctatcctatttttgggaacaaagctgacgtcgtgaagtaccaccaggagttcccgaccatctatcatctcagaaaacacctggccgattctagcgaaaaggctgaccttcggctggtttacctcgccctggcgcatatgatcaaatttcgcggacacttccttattgagggcgaactgaatgccgagaacacggatgtgcagaagatctttgctgacttcgtcggcgtgtacgacagaacctttgatgactcccatctctctgagattacagttgatgccgctagcatcctgaccgaaaagatttccaagagccggcgcctggagaatctcatcaagtattaccccacagaaaagaagaacaccctgttcgggaatcttattgccctggcgctcggactgcagcctaactttaaaatgaatttcaaactttctgaggacgccaaactgcaattctccaaggatagctatgaagaggacctcggcgagctgctggggaagatcggagatgactacgctgatctctttacgtctgccaaaaacctgtatgacgctatccttctgtccggcattctcatcgtggatgacaatagcacaaaggctcccctgtctgcctccatgattaaaagatacgtcgaacaccaggaggaccttgaaaagctgaaagagttcatcaaggccaacaagagcgaactctatcacgatatttttaaagacaagaacaaaaatgggtacgcgggatacatcgagaacggcgtgaagcaggatgagttctataaatacctgaagaataccctgtccaagatcgccggctctgactattttctcgataaaattgaacgggaggacttcctgagaaagcagcgcacatttgataacgggagcatccctcatcaaattcaccttcaggaaatgcatgctatcctgcggagacagggagactactatcccttcctcaaagagaatcaggatcgcattgaaaagatcctgacctttcggatcccttactatgtgggcccgctggccagaaaagactcccgcttcagctgggccgagtaccactctgatgagaagattaccccctggaactttgacaaagtcatcgataaggaaaagtccgctgagaaattcattacacggatgacgcttaatgacctctacctgcctgaagagaaggttctgcccaaacacagccatgtgtatgagacctacgccgtgtataacgaactcacaaagatcaaatacgtcaatgagcaagggaaggacagctttttcgatagcaacatgaagcaggaaattttcgaccacgtgtttaaagagaatagaaaggttaccaaagaaaagctgcttaactatctgaataaagagttccctgagtaccgcatcaaggatctcattggactggacaaggaaaacaaatcctttaatgcgtctctgggcacatatcatgatcttaagaaaatcctcgacaaggctttcctggatgacaaagtgaacgaggaagtcatcgaggatattatcaagaccctgacgctctttgaagacaaggatatgattcacgagcggctgcagaaatacagcgacatcttcacagccgatcaacttaagaaactggagagacgccattacaccgggtggggacggctctcctataagctgattaacggcatcagaaataaagaaaacaataagaccatcctggactaccttattgacgatggcagcgccaaccggaattttatgcagctcatcaacgacgatacactgcccttcaaacagattatccagaagtctcaagtggttggggacgtggatgacattgaggctgtcgtgcacgatctgccgggatcccctgccatcaagaaaggcatcctccagagcgtcaagattgtggacgaactggttaaagtgatgggggataatcccgacaacatcgtcattgagatggctcgcgaaaatcagaccacaaacagaggacggtctcagtcccaacagagacttaagaaactgcagaatagcctcaaggagctgggctccaacatcctgaatgaggaaaagccttcttatattgaggataaagtggaaaacagccaccttcagaatgaccaactctttctgtactatatccagaacgggaaggacatgtacacgggcgatgagctggacatcgatcatctctccgactatgatattgaccacatcattccccaggccttcatcaaagatgactctattgataaccgcgttctgaccagctccgcgaagaatcggggaaaaagcgacgatgtgccctctcttgacatcgtcagagcccgcaaggctgagtgggtgagactgtacaagtccggcctcattagcaaacggaagtttgataacctgacaaaagccgaacgcgggggactgaccgaggctgacaaggccggcttcatcaaaagacagcttgtggaaacacggcaaatcaccaagcatgttgcgcagattctggacgcccgctttaatacggagtctgatgaaaacgacaaggtcatcagagatgtgaaagtgattaccctcaagtccaatctggtcagccagttccggaaagacttcgagttttacaaggtgcgcgagatcaacgattatcaccacgctcatgacgcctacctcaatgctgttgtggggacagccctgcttaaaaagtatcctaagctggcctctgagttcgtctacggagaatataaaaagtacgatattagaaaatttatcaccaacagctccgacaaggctacagcgaaatatttcttttacagcaatctcatgaacttctttaagcgggtgatccgctactctaatggcaaagttattgtgagaccggtcgtggaatattccaaggataccgaggacatcgcctgggataagaaaagcaacttccggacgatttgcaaggttctgtcctacccccaagtgaatatcgtcaaaaaggtggaaacacagaccgggggcttttctaaagagagcattctgcctaagggagactccgataaacttatccccagaaaaacaaagaaggcttattgggacaccaagaaatacggcgggttcgactctcctaccgtggcctatagcgtctttgttgtggccgatgtggagaagggaaaggctaaaaagctgaaaacagtcaaggaactcgtgggcatctccattatggagcgctctttcttcgaagagaaccccgttgaatttctggagaataaagggtaccacaacatccgggaggacaagctcattaagctgccgaaatatagccttttcgaatttgagggaggcaagagacgcctgctcgcctccgcgagcgaactgcagaaagggaacgagatggtgatccctggccatctggtcaaacttctgtaccacgctcagcggattaattctttcaactccacgaaatacctcgattatgtgagcgcccataagaaagagtttgaaaaggttctgtcttgtgtggaggacttcgccaatctctacgtcgatgtggaaaagaacctgtccaaaatcagagctgttgccgacagcatggataatttttctattgaggaaatctccaacagcttcatcaatcttctgaccctgacagcgctcggagctcccgccgactttaacttcctgggcgagaagattcctcgcaaacggtatacctccacaaaggagtgccttaatgccaccctgatccaccaaagcattacggggctctacgaaacaagaatcgatctgtctaaaattggagaggaatga

SEQ ID NO: 4325 - RNA, 4122 nt, synthetic construct
  misc_feature 1..4122: note = Cas9 variant
  source 1..4122: mol_type = other RNA
atggagaacaagaattacagcatcggcctggacattgggaccaactccgtgggatgggccgtcatcacagatgactataaagttccctctaagaaaatgaaggtgctcggcaatacggataaaagattcattaagaagaacctgatcggggcccttctgtttgacgaaggaaccacagccgaggcgcggcgcctcaaaagaaccgctcggcgcagatacacacggcgcaagaatagactgcggtatcttcaggaaattttcgccgaggaaatgagcaaagtggattcctctttcttccaccgcctggacgatagctttctcatccctgaggacaagaaaggctccaagtacccgatcttcgccaccctgattgaggaaaaggagtatcataaacaatttcccacaatctaccacctgagaaagcagctcgctgattctaaagaaaagaccgacctgcggcttatttatctggccctcgctcatatgatcaaataccgcgggcacttcctgtacgaggatacgtttgacattaagaacaatgatatccagaaaattttcaacgagtttatcagcatctataataacaccttcgaaggaaattcccttagcggccagaacgtccaagtggaggccatttttacagacaagatctctaagtccgcgaaaagagaacgggttctgaaactcttccctgacgagaaaagcaccggcctgttctctgaatttctgaagctcattgtggggaatcaggccgatttcaaaaagcattttgacctggaggagaaggctccccttcagttctcccgcgatacatacgacgaagatctggagaacctcctgggacagatcggcgacgattttgccgaccttttcgtcgctgccaaaaagctgtatgatgcgattctcctgagcgggatcctgaccgtgacggacccttctacaaaagctcccctctccgctagcatgatcgaaagatacgagaatcaccaaaaggatctggccacccttaaacagtttattaagacaaacctgcctgaaaagtatgacgaggttttctccgaccagtctaaagatggatacgctggctatatcgacgggaagaccacccaggagagcttttacaaatacattaagaacctcctgtccaaattcgaaggagccgattattttcttgagaagatcgaacgggaggacttcctgagaaagcaacgcacatttgataatggcagcattccgcaccagatccatctccaggaaatgaacgccatcctgcggagacaaggcgagcactaccccttcctgaaagagaataaggagaaaattgaaaagatcctcacgttccgcattccttattacgtggggcccctggctcggggaaacagagactttgcgtggcttacccgcaattctgatcaggccatccggccttggaacttcgaagagattgtcgacaaggcttccagcgccgagtcttttatcaataagatgacaaactatgatctgtacctccccgaagagaaagtgctgccgaagcatagcctgctttatgaaaccttcgccgtgtacaatgagctcacaaaggtcaaatttattgctgaaggcctgagagactaccagttcctggattcccgccagaagaaagacatcttttataccctcttcaaggccgaggataaacggaaggttacggagaaggacatcattcaatacctgcacacagtggacgggtatgatggaatcgaacttaaaggcattgagaagcagtttaacgcgtctctgagcacctaccacgacctcctgaaaatcattaaggataaagaatttatggacgatcctaataacgaggaaatcctggagaatatcgtgcatacccttacaatttttgaggacagagaaatgatcaagcagcgcctcgctcagtatgattccctgttcgacgagaaggtcattaaagccctgacccggagacactacacagggtggggaaagctcagctctaaactgatcaacggcattcgggataagcaaacgggcaaaaccatccttgactatctgatggatgacgggtacaataaccgcaactttatgcagctcatcaatgatgacgaactgtccttcaaggagattatcaagaaagcccaggtggttggaaagacagacgatgtgaaacaggtcgtgcaagaactgcccggcagccctgctattaagaaagggatccttcagtctattaagctcgttgacgagctggtgaaagtcatgggacatgagcccgaatccatcgtgatcgagatggccagagaaaaccagaccacagctcggggcaagaagaatagccagcaaagatacaaacgcattgaggattccctgaagatcctcgcctctgggctgaacgcgaaaattcttaaggagcaccccaccgacaatatccagctgcagaacgatagactcttcctgtattacctgcaaaatggccgggacatgtatacgggaaaacctcttgatattaaccagctcagctcctacgacatcgatcatattgtcccgcaggcctttatcaaggacgattctctggacaatcgcgtgctgaccagcctcaaggacaacagaggcaaatccgataatgttcccagcctggaagtggtcgagaagatgaaaacattctggcagcaacttctggactctaagctcatctcctatcggaaatttaacaatctgaccaaggctgaacgcgggggactggatgagagagacaaggtgggcttcattaaacggcagcttgttgaaacacgccagatcaccaagcacgtggcccagattctggatgctagatacaacacggaggtcaatgagaaagacaagaaaaaccggacagtgaagatcattaccctcaagagcaacctggtgtctaattttcgcaaagagttcagactctataagatccgggaaatcaacgattaccaccatgcccacgacgcgtacctgaatgccgttgtcgctaaagccattcttaagaaatatcctaagctggaacccgagtttgtgtacggggattatcaaaagtacgacctcaaacgctatatctccagaagcaaggatcctaaagaaattgagaaggctacagagaaatacttcttttattctaacctgctgaatttctttaaggaagaggtgcattacgccgacggaaccatcgtcaaacgggaaaacattgagtacagcaaggataccggcgaaatcgcctggaataaggagaaagacttcgctacaatcaagaaagtgctttccctgccccaggttaacattgtgaagaaaagagaggtccagaccgggggcttcagcaaggaatctatcctcccgaagggaaattccgacaaactgattcctcgcaagacgaaagatatcctctgggacacaaccaagtatggcgggtttgatagccccgtgattgcgtactccatcctgcttattgccgacatcgagaaaggaaaggctaagcggctgaaaacagttaagaccctcgtgggcatcacgattatggaaaaagccacattcgagaagtctcctatcgcctttctggagaacaaagggtatcacaatgtcagaaaggaaaacattctgtgccttcccaagtacagcctgttcgagctcaaaaatggacgccggagaatgctggcttccgccaaggaactccagaaaggcaacgagatcgtgctgcctgttcaccttaccaccctgctgtatcatgcgaagaatattcaccgcctcgatgaacccgagcatctggagtacatccaaaaacaccggaacgaatttaaggggcttctgaacctcgtgtctgagttcagccagaaatatgtcctggctgacgccaatctcgaaaagatcaagaacctgtacgccgataatgagcaggctgacattgaaatccttgccaactcctttattaatctgctgacattcaccgcgctcggcgctccggccgcctttaaattctttggaaaggatgtggacagaaaacgctacacaacggtgtctgagatcctgaacgctacccttattcatcaaagcatcacaggcctgtatgagacccggatcgatctctccaagctgggggaagactga

SEQ ID NO: 4326 - RNA, 4125 nt, synthetic construct
  misc_feature 1..4125: note = Cas9 variant
  source 1..4125: mol_type = other RNA
atggagaccaagttcacatactatctgggcctcgacatggggacggatagcctgggatgggccgtgaccgactcctcttaccacatccttagagctaaaggcaaggatctgtggggagtccggctctttcccagcgccgaaacatccgttgagcgcagaacctatcgggtgaaccgcagacggcgccagagagaagtggcgcggattggggctctgaaagagcttttcgccgacgaaatcgagaaggtcgatcctggctttttcgtgcgcctggacgagtctaaatttcatatggaagatagaagcgagaataacaagcaaaagtacgggctctttgccgacaaactgttttccgatgctggatattacaagaaatatccgacaattttccatctgcggaaggaactcctggagtctgaggaaccccacgacgttcgccttgtgtacctggccctcctgaatatgtttaaacacagaggccatttccttaacagctccctgcagatcgagggcgaaaatagcaacattgctgagtcttaccagatgtttgtcgataccctcacagacgaagatctggacttccctgaacaggtgtccggggagcggctgcaagagatctttcgcagctctgactccagaaagaagaaagttgagaatctcctggccgaaatgaaccttagcaagaaacagaagcgggagatccagttcgtgaatctgatttgcggactcaaaggcaagctgtctgaacttttccccgataaagagtatgacgaggaacagaagaagatcgcgttttccttccaagatagcgactacgaggataaagaaaacaccattcaggagctgctcgacgaatccgagatgaatatgatctatgccgtcaaggctgtgcacgattctggggtgctgagcggaattatgaacggcgagagatacctgtccgtcgcccgcgttgctagctatgaaaaacacaagaaagacctccagatcctgaaggatattcttaagaaatacgacacgaaggagtattttgaaatgttccggaatgagtctgccaaatccgagagctactctgcgtacgtggggagcgtgaagtatcatggaacctttagacgcggcctgtccggcgggaaacaggaagatctctacaagcacatcaagaaagtcctgggaaagttccctcaagacgacgagggcgtgacatatatccttgaagagattgaaaccgagtcttttctgcccaaacagctcacagccagcaacggggttatccctaatcaggtgcatgctcgggagatgctggccattctgaagcacgctgaactctacctgccgttccttcaagagaaagatgacaccggactgtccgtcagcgaaaagatcctcaagctgtttatgttccagattccctattacgtgggccctctggggcaggagtataaagataagaaaggatacaacgtttgggccgaaagaaaggcctctggcaaaatctacccctggaactttgaggacaagatcgatgtgaaaaagtccgctgagaagttcattggccgcatggtccggagatgtacgtatcttagcggggaacaggcgctccctaaacaatctctgctgtacgagaagtttcaggtgctcaatgaactgaacaatcttcgcatccggggagagaaaattcccgtctccctgaagcaggaaatctatcacgacctcttcggcgatgggaaaaaggtgagcatgacaagactgaccaactacctgcttcagaatggagttatttccggcgaggagaaggactcttgcatcagcgggatcgatggcggattccataactccctctctagcgtgggcaaatttaagggggtcttcggagacacagtgcacaccgatgaacatcgcaaaatgattgaggacatcattttctggggcaccgttttcggggatggaaagaaactgctgaaggaaaaggtggaggaggtctatggcaatcaactcacagaagcccagaaaaagcggatctttgggttcaaattttccagctggggcagactgtctaaggctttccttacgatggagggagcctccaaagacgacggcgaaattaaggggctgatccaggccatgtgggataccaactgtaatctcatggagctgctgagcgaccggtttacatacaaggataaacttaacgaaatggtgaccacagctgagaagccgctctgcgagtggaaaattgaagacctggatgagatgtatctgtctgcccctgtgaagcgcatggtttggcagaccatcagagtcgtggacgaagtgcaacagatcattggatgtccccctaaacggatcttcgtcgagatgacgagatccgatggcgaaaaggggaaacgcacagtgagccggcagaagaagctcgttgacctgtacaaagcgcttggaaaggagggcaaaacctggtctgaggaactgagcgatacccccgagtcccagtttagaattaagaaactctacctgtattacctgcaaatggggaagtgcatgtatacaggcgaagctatcgagcttgaacagctcatgaatgacaacctgtacgatattgaccacatctatccccgccatttcatcaaggatgacaatattagcaacaatctggtgctcgtcaaaaaggagaaaaacgcccacaagtctgactcctttcctatcgagccggaaattagaaacaaaatgatgcccttctggaagtccctgcggaagaaaggattccttaccgaggaaaagtacaatcgcctgacaagaatgtccgcctttacggatgaggagaaagctgccttcatcggccggcagctcgtggaaacctctcaagggacaaaggctattacccagatctttgagcaggccttcgcgaacagcgaaatcgtttttagcaaagcctctgtggtcagcgctttccgccagaagtttgactgttataaggtgagatgcgttaataactaccaccatgcccacgatgcttacctgaatattgtggccggaaacacatatcgggtcaaattcacctccaatcctctgaactttatcaaggaggcgaaaaagaatcccaactctcgcgaaaatagatacaacatggacaaaattttcgagtgggatgtgacgcggaatggcgagaccgcctgggtggctcaaacaaaggaacatcctgggaccatccagcttgtcaagaaatatctgaacaagaatagccccctcattacaaaaatggtttacgagaagcacggaggcatcacccagaaagccacgatctggtccgctaagaaagccgaaagcgggaacacagacgcctatattccggtgaagatgaacgatcctcgcctggctgacgtgaccaagtacggcggagtcacaaccatcgcggtggccggctataccctcctggagtacaaagctgggggaaagacagttagatctcttgaagccctgcccatttacctcggcgggtccaaaaagctgacggaggagcagatggtggaatattttagcaatgtcctgcaacaggagaacaaagaaaaggtggtttctgatgtgatcattcggaagaaaatgatcccttccggaagccttattaagtacaatggcttctattactatctggccggcaaaaccggggacagaatcatcctcatttctgctgtccagctgtgtctccccatggatacaatgctgtacatcaagaaaattgagaaggcctgctccaccggaaacttcgaagagaaggacaaaaatggcaaacaggtgcttagcaagcaacagaacgagtttgtttatgaactgatcattcagaagtaccaacagtccatcttcaaaaagaaggtgggggcgatcggagacacaattatcgagaaacgcgaaaagtttgctgagattagcctcgaggaacagtgtaaagtcctgatgcagatcttcctgaattttcaatctggcattggggtggagcttaagatcatcgaaggaggcaaaaagagcggcgtgacctacctgaacaaaaaggtcatgaatgttcaggagctcaagctgattgatcagtccgtgacgggggtgttctctcgggaaatcgacctcctgacaatttga

SEQ ID NO: 4327 - RNA, 4125 nt, synthetic construct
  misc_feature 1..4125: note = Cas9 variant
  source 1..4125: mol_type = other RNA
atgaagaaaagatacagctattccatcggcctggacattgggaccaactctgtgggatgggccgtcatcaatgaggattacaaggttcccgctaaaaagatgacagtgttcggcaacacggaccggaaaaccattaagaagaatctcctggggacagtgctttttgatagcggagaaaccgcccaggcgcgcagactgaaacggacaaaccgcagacggtatacccgcagacggtaccgcctctgccaactgcagaatatcttcgctacagagatggtcaaggtggacgatacctttttccagagactttccgaatctttcttttattaccaggacaaagcctttgataagcaccctattttcggcaacagcaaagaggaacgggcctatcataagacgtacccgaccatctaccatctgcgcaaggacctcgctgatagagaccaaaaagccgatctgcggctgatctatctcgctctgtcccacattatcaagtttcgcgggcacttccttattgagggaaaacttaattctgagaacacagacgttcagaagctctttatcgccctggtgaccgtctacaatcttctgttcgaagaggaacccattgcgggcgagacatgtgatgccaaagctctcctgaccgccaagacgagcaaatccaagagactggagagcctcatctctgaatttcctggccagaagaaaaacgggctgttcggaaatcttctggctctcgccctgggccttcggcccaacttcaagtccaattttgggctgagcgaggacgcgaaactccagattacaaaggacacctatgaagaggaactggataacctgctcgccgagatcggagaccattacgctgatctgttccttgccgctaaaaatctgtctgacgccatcctcctgtccgatattcttacactgagcgacgagaacaccagagcccctctctctgcttccatgatcaagcgctatgaagaacaccaagaagatctggcgctgctcaagaaactggtgaaggagcagatgcccgaaaaatactgggagatttttagcaacgccaagaaaaatggctatgctgggtacatcgagggaaaggtttcccaggaagacttctaccggtatattaagcctatcctttctagactgaaaggcggcgatgagtttctcgccaagatcgaccgcgatgacttcctgcggaaacagagaacctttgacaacgggagcattccgcaccaaatccatctgaaggaacttcacgccattctccgccggcaggagaaatactatcccttcctggctgaacagaaggagaagatcgagcaactgctctgctttcgcattccttactatgtgggacccctggccaaaggcggaaattccagcttcgcgtggcttaagagacggtctgatgaacctatcacaccctggaactttaaagacgtcgtggatgaggaggcttccgcccaggccttcatcgagggaatgacgaattacgacacctatctgccggaggaaaaggtgctccctaaacatagccccctgtacgagatgtttacagtctacaacgaactgaccaaggttaaatatattgctgagaatatgacaaagcctctttacctctctgccgaacagaaggaggctatcattgatcacctgttcaaacagaccagaaaggtgacggtgaaagacctgaaggagaaatatttcagccaaatcgaaggcctcgagaacgtcgatgtgacaggggttgaaggagcctttaatgcgtccctgggcacctacaacgaccttctgaagattatcaaggataaagccttcctcgacgatgaggctaatgccgaaattctggaggagatcgtgctgatccttaccctctttcaggacgaaaagctgattgagaaacgcctggctaagtatgccaacctcttcgaaaaatctgtcctgaagaagctgcggaaaagacactaccggggctgggggcgcctgagcagacagctcatcgatggaatgaaggacaaagcgtccggcaagacaattctggactttctgaaagccgatgacttcgctaatcggaactttatccagcttattaatgatagctctctcgacttcgagaagctgatcgatgacgcccaaaagaaagctatcaagagagaatccctgaccgaggccgtggccaacctcgctgggagccccgcgattaaaaagggaatcctgcagtctcttaaagttgtggatgagattgtcaaggtgatgggccataaccccgacaatatcgtcattgaaatgtcccgcgagaaccagacaacggcccaggggctgaaaaatgctcggcaaagactcaagaagatcaaagaagtgcacaagaaaaccggcagccgcatcctggaggataactccgagagaattacaaatctgacccttcaggacaaccggctgtatctctacctgctccaggatggaaaggacatgtacacaggccaggatctggacatcaataacctttctcaatatgacattgatcatatcattcctcagagctttatcaaagacaattccatcgataacctggttctcaccacgcagaaggccaatcgcgggaagtctgacaacgtgccgagcattgaagtcgtgagagatatgaaagaccgggtttggcgcagacaactggccaatggagctatctcccggcagaagttcgatcacctgaccaaagccgagcgcggcgggcttgcggacagcgataaggctagatttctgcggcgccagctcgtggaaacaagacagattaccaaacatgtcgcccaactgctcgactctcggttcaactccaagagcaatcagaacaagaaactggccagaaacgtgaagatcattacacttaaatctaagatcgtgtccgattttcgcaaagacttcggactgtacaagctccgggaggttaataactatcaccacgctcatgacgcctacctgaatgcggtcgtgggcaccgctctgcttaagaaatatcccaagctggaagccgagttcgtgtacggggattataaacactttgacctcgtcaagctgattagcaaatctgatcctagcctcggcaaggccacggctaaggtgttcttttactccaacatcatgaatttctttaaagaggaactgagccttgccgacggaacactgatgaagagacccgttatcgagaccaacacagaaaccggcgaggtggtctgggataaagtgaaggacttcaaaaccattcgcaaggttctgtcttaccctcaggtgaatatcgtcaaaaagacagaaattcagtccggggcttttagcaaggagtccgtgctctctaaaggaaacagcgataagctgatcgagcggaaaaagggctgggaccccaaaaagtatgggggattcgattccccgaatacggcctactctatttttgttgtggcgaaggtcgccaaaagaaaggctcaaaaacttaagaccgtgaaagaaatcgtgggcatcacaattatggagcaggccgaatatgagaaggacaacatcgctttcctggaaaagaaagggtaccaggatattcaggagaagctcctgatcaaactccctaagtatagcctgtttgagcttgaaaatggccgccggagactgctggcctccgccaacgagttccaaaaaggaaatgaactcgctctgtctggcaagtacatgaagttcctttatctggcgagccgctacgacaaactctccagcaagattgagtctgagcagcagaaaaagctgtttgtcgaacaacatctccactacttcgatgagatcctggacatcgttgtgaaacacgccacctgttatattaaggctgaaaacaatcttaaaaagatcatttccctgtacaagaaaaaggaggcctatagcatcaacgaacaggccctgaacatgctcaatctgtttattttcacatctcttggggctccctccacctttgtgttctttgacgagacgatcgatcggaaaagatacacaaccagctctgacgtcctgaacgggattctcatccagcagtccatcaccggcctgtatgagacacggattgatctcagccgcttcgggggagactga

SEQ ID NO: 4328 - RNA, 4125 nt, synthetic construct
  misc_feature 1..4125: note = Cas9 variant
  source 1..4125: mol_type = other RNA
atgaagaaacagaagttcagcgactactatctgggctttgatatcgggaccaactccgtgggatggtgcgtcacagacctcgattacaatgttctgagattcaacaaaaaggacatgtggggctctcggctttttgatgaggccaaaacggctgccgaacgcagagtgcaacggaatagccgcagacggctgaagcgcagaaagtggcggctcaacctgcttgaggaaattttctccgacgagatcatgaaaattgattctaactttttccgcagactgaaggaaagctccctctggctggaggacaaaaattctaaggagaaatttaccctgttcaatgatgacaactataaggattacgacttttataagcagtaccccacaatcttccacctccgggatgaactgattaaaaatcctgagaagaaagacatccgccttatctatctggcgctccatagcatttttaagtccagagggcacttcctgtttgaaggacagaaccttaaagagatcaagaatttcgagaccctgtacaacaatctcattagcttcctggaagacaacggcatcaataaatctattgataaggacaacatcgagaagctggaaaagattatctgtgattccgggaagggactcaaagacaaggagaaagaatttaagggcatcttcaacagcgataagcagctggtggctatttttaaactttctgtcggctccagcgtgtctctgaatgacctcttcgatacagacgagtacaagaaagaggaagttgagaaggaaaagatctcctttcgggagcaaatttatgaagatgacaagccgatctactatagcattctgggggagaagatcgagcttctggatatcgccaaatccttctacgactttatggtgctcaacaatattctgtctgacagcaactatatctccgaagccaaggtcaaactgtacgaggaacataagaaagatctcaagaatctgaagtatattatccgcaaatacaacaaggagaattacgacaaacttttcaaggataaaaacgaaaataactatcccgcttacattggactgaataaggagaaagacaagaaggaggtggttgaaaagagcagactcaagatcgatgacctgatcaaagtgattaagggctatcttcctaaacccgagcggatcgaagagaaggataagaccatttttaacgagatcctgaataaaattgaactcaagacaatcctgcctaaacagagaatttctgacaacgggaccctgccctaccagatccacgaggtcgaactcgagaagatcctggaaaatcagtccaaatattacgatttccttaactatgaggagaacggagtgagcacgaaggacaagctgctcaaaacctttaagttccgcattccttactacgtgggcccgcttaattcttatcataaagataaagggggaaacagctggatcgtccggaaagaagagggcaagattctgccctggaattttgaacaaaaggttgacatcgagaaatccgccgaagagttcattaagagaatgacaaacaaatgcacctacctgaatggcgaggatgtgatccctaaggactctttcctctatagcgaatacatcattctgaacgagctgaataaagtgcaggtcaacgacgaatttctcaatgaggaaaacaagcgcaaaatcattgatgagctgttcaaggagaataagaaagtgtccgaaaagaaatttaaggagtatcttctggttaaccagatcgctaatcggacagtggaactcaaagggattaaggacagcttcaactctaattacgtctcctatatcaagtttaaagatatcttcggagagaagctgaacctggacatttacaaagagatcagcgaaaagtctattctttggaaatgtctctacggcgatgacaagaagatctttgagaaaaagattaaaaacgaatatggggatatcctgaataaggacgagatcaaaaagattaactccttcaagtttaatacctggggaagactgagcgaaaaactcctgacgggcatcgagttcattaaccttgagacaggggaatgctactcctctgtgatggaggccctgcgccggaccaattataacctcatggaactgctgagctccaagtttacacttcaggagtctatcgataatgaaaacaaagagatgaatgaggttagctacagagacctcattgaagagtcctatgtgagcccctctctgaagcgcgcgatcctgcaaaccctcaaaatttacgaagagatcaagaagatcaccggacgggtccctaaaaaggtgttcattgaaatggccagaggcggcgatgagtccatgaaaaacaagaaaatccccgctcgccaggagcagctgaagaaactttatgacagctgtgggaatgatattgccaacttttctatcgacattaaggaaatgaaaaattccctgagctcttacgacaacaatagcctccggcagaaaaagctgtacctgtattaccttcaattcggaaaatgcatgtatacaggcagagagatcgatctcgaccggctgctgcagaacaacgatacgtacgacatcgatcacatttatccgcgctccaaggtcatcaaagacgatagcttcgacaatctcgtgctggttcttaagaacgaaaatgctgagaagtctaacgagtaccctgtgaaaaaggaaattcaggagaaaatgaagtccttttggagattcctgaaagaaaagaattttatcagcgatgagaagtataaacggctcaccgggaaggacgatttcgaactgagaggatttatggcccgccaactggtcaacgtgcggcagacaaccaaagaggttggcaagattcttcagcagatcgagcccgaaatcaaaattgtgtactccaaggcggagatcgcctctagcttcagagaaatgtttgacttcattaaggtccgcgagctgaatgacacacaccatgctaaagatgcctacctcaacatcgtggctgggaatgtgtataacaccaagtttacggaaaaaccttacagatatctgcaagagattaaggagaattacgacgttaaaaagatctataactacgatattaaaaatgcctgggacaaggaaaactccctcgagatcgtcaagaaaaatatggaaaagaacacagtgaatatcacccggttcattaaagaggaaaagggcgagctgtttaaccttaaccccatcaaaaagggagagacctctaatgaaattatcagcattaagcccaaactgtatgatggcaaggacaacaaactcaatgagaagtacgggtactatacatccctgaaagccgcttacttcatctatgtggaacacgagaagaagaacaaaaaggtcaaaaccttcgagcgcatcacaagaattgattctacgctgatcaagaatgagaaaaaccttattaagtacctggtgagccagaagaaactcctgaatcctaagatcattaaaaagatctataaagaacagaccctcatcattgactcctacccgtatacatttaccggagttgatagcaacaagaaagtggaactgaagaataagaaacagctttacctggagaagaaatacgaacaaatcctcaagaacgcgctgaaattcgtcgaggacaatcagggcgagacagaagagaactataagtttatttacctgaagaaacggaataacaatgaaaagaacgagaccatcgatgccgtgaaagaacgctataacattgagttcaatgagatgtacgacaagtttcttgaaaaactgtcttccaaggattataagaactacatcaataacaaactctatacgaatttcctgaacagcaaggagaaatttaagaaactcaagctgtgggaaaagtctcttattctgagagagttcctgaaaatctttaataagaacacctacgggaaatacgaaatcaaggactcccagacaaaagagaaactcttcagctttcccgaggacaccggacggattcgcctgggccagtcttcccttgggaataacaaggaactgctcgaggaaagcgttacaggcctgttcgtgaaaaagatcaaactctga

SEQ ID NO: 4329 - RNA, 4128 nt, synthetic construct
  misc_feature 1..4128: note = Cas9 variant
  source 1..4128: mol_type = other RNA
atgagcaacaagccctactccatcggcctggacattgggaccaattctgtgggatgggccgtcatcacagatgactataaagttcctagcaagaaaatgaaggtgctcggcaacacggataaacacttcattaagaagaatctgatcggggcccttctgtttgacgagggaaccacagctgaagatagacggctcaaacgcaccgcgagacggcgctacacaagacggaagaaccgcctgagatatcttcaggagattttctttgaagagatgtccaaactggactctggcttctttcatcggctcgatgacttctttctgatcccggaagataagcgcgggagcaaataccccatcttcgctaccctggccgaggagaaggaatatcacaagcaatttcctacaatttaccatctcagaaaacagctggccgactccaaggagaaagctgatcttcggctgatctatctcaccctggcccacatgattaagtaccgcggacatttcctttacgaagagtcttttgacatcaaaaataacgatattcagaagatcttcaatgagtttattagcatctatgacaacacgttcgaaggctccagcctgtctggccagaatgctcaaatcgaggccattttcaccgacaaaatctccaagagcgcgaagagagaacgggtgctcaaactgtttcccgatgagaagtctacagggctgttctccgaatttctcaaactgattgtcggaaaccaggccgacttcaagaaacactttgagcttgaggaaaaggctcctctgcagttccccaaggatacctacgacgaggatctcgaaaatgtgctgggccagatcggggacgattttgccgaccttttcgttgctgccaaaaagctgtatgatgcgattctcctgagcggaatcctgacagtgaccgacccttctacgaaagccccgctctccgctagcatgatcgagcgctacgaaaaccaccaaaaggatctggccgctcttaaacagtttattaagacaaatctgcccgagaagtatgtcgaggtgttctccgaccagtctaaagacggctacgccgggtatatcgatggaaagaccacacaggaagccttttacaaatacattaagaacctcctgagcaaattcgagggcaccgactattttcttgataagatcgaaagagaggacttcctgcggaagcaaagaaccttcgataatggctccattcctcatcagatccacctccaggaaatgaacgctatcctgcgccggcaaggggagcattacccctttctgaaagagaacaaggagaaaattgaaaagatcctcacattccgcattccttattacgttggacccctggcgagaggcaatcgggactttgcctggcttacgagaaacagcgatcaggctatccgcccgtggaatttcgagaaaattgtggacaaggcctcttccgccgaagattttatcaacaaaatgaccaattatgacctgtacctccctgaggaaaaggtcctgcccaagcacagcctgctttatgagacattcgctgtgtacaacgaactcaccaaagtgaagtttattgccgaggggctgcgggattaccagttcctggactctggacagaaaaagcaaatcgtcaatcagctctttaaagaaaagagaaaggttaccaaaaaggatatcattcactatctgcatacagtggacggctacgacgggatcgagcttaaaggaattgagaagcagttcaacgcgagcctgtccacgtatcacgatctcctgaaaatcattaaggacaagaaatttatggatgactctaagaatgaagctatcctggagaacatcgtgcatacacttaccattttcgaagatcgcgagatgatcaaacagcggctcgcccaatacgacagcctgtttgatgaaaaggtcattaaagccctgaccagacgccactatacaggctggggcaagctctccgctaagctgatcaatgggatttgcgacaaacagaccggaaacacaatccttgattacctgatcgacgatggcgagattaatcggaacttcatgcagctcatcaatgacgatgggctgagcttcaagaaaattatccagaagtctcaagtggttggagagacggacgacgtgaaacaggtcgtgagagaactgcctggctcccccgccattaagaaagggatccttcagagcatcaagattgttgatgagctcgtgaaggtcatggaccatgctcccgaatctatcgtgattgagatggcccgggaaaaccagaccacagcgcgcggcaaaaagaactcccaacagagatataaacggatcgaggatagcctgaagaatctggcctccggactcgactctaacattctgaaagagaatcctaccgataacatccagcttaagaatgacagactgtttctctactacctgcaaaacggcaaggatatgtatacaggggaagctctggacattaatcagcttagctcctacgatatcgaccacatcattccgcaggccttcatcaaagatgactctctcgacaaccgcgtcctgaccagctccaaggataatcggggaaaaagcgacaacgtgccctctctggaggttgtgcagaagagaaaggctttttggcaacagctcctggattccaaacttattagcgaacgcaagttcaataacctgacgaaagccgagagaggcgggctcaatgagcgggacaaggtcggatttatcaaacgccagctggtggaaaccagacagattacaaagcacgttgcgcaaatcctggatgcccggtataacaccgaggtgaatgaaaaagacaagaagaaccgcacagtcaaaatcattacccttaagtctaacctggtgtccaatttcagaaaagagtttcggctctacaaggtgcgcgaaatcaacgattatcatcacgctcatgacgcctacctgaatgctgttgtcgccaaagccattctcaagaagtatcctaaactggagcccgagttcgtgtacggcgaataccagaagtatgatcttaaaagatacatcagccggtctcgcaaccctaaggaggtggaaaaagctacggagaagtactttttctatagcaatctgctcaactttttcaaagaagaggtccactatgcggacgggacaattgtgaagagagagaatatcgaatactccaaggataccggcgagatcgcctggaacacagaaaaagacttcgctaccattaagaaaatcctgagctatccccaggttaatattgtgaagaaaaccgaggaacagacagtcggacaaaacggcgggctgtttgataataacatcgtgtctaaggagaaggttgtggacgcctccaaacttattccgatcaagagcggactgtcccctaaaaagtacggcgggtacgcccggcccacgattgcttattctgtcctcgtgacctacaaacagaataacaagatcaagaatacaatggttggaatccctgtgctgaccaaactcgagttcgaaagagaccccaacctgtatcttcgcaacctgggcattaataacgtcagccacgtgatcaagctcgtgaaatacacagtcctggagtttaagcataaatatgggacctaccggagattcattgtttccaatcaggaactgaagcgcgccaaccaaatctttgtgacgacaaagcagatgaaacttatttctcagtataccaccctggataagaatgagcacgacagcctcctgaaaaacaatcagcaactcatccagtccatctggaaccagttcctggagtttatgcttgcgacagatctggtgaataagaaacagtacgacgaactgattctcaccaacaatcaaacaatcgaggaatgtcggaacattatgaatagagtcatcacgaccctgtctttcacaaacattaatgctggccagaagaaaatcatctttgatgacacccttagcctgcctattaagcgctggcagttcacagattccgacaagatggtgaaaaagatcattgagagcaccctcatccatcagtctattacgggactgtacgaaacccggatcgatctctccaaactgggcgaggactga

SEQ ID NO: 4330 - RNA, 4128 nt, synthetic construct
  misc_feature 1..4128: note = Cas9 variant
  source 1..4128: mol_type = other RNA
atgaaggagtaccacatcggcctggacattgggaccagctccatcggatgggccgtgacagattctcagttcaaactcatgagaattaagggcaaaacggctatcggggtccggctgtttgaagagggaaagaccgccgcggaacgcagaacattccggaccacacgcagacggcttaaacgcagaaagtggcggctgcattatctcgacgagatttttgctccccatctgcaagaagttgatgagaacttccttcgcagactgaagcagagcaatatccaccctgaggacccggccaaaaaccaggcctttatcggcaagctcctgttccccgatctgctcaaaaagaatgaacgggggtaccctaccctgattaaaatgcgcgacgagcttcccgtggaacagagagctcactatcctgtgacaaacatctacaagctgcgggaggccatgattaatgaggatcgccaatttgacctcagagaagtctatctggctgtgcatcacatcgttaagtaccggggacacttccttaacaatgcctccgtggataaatttaaggtcggcagaattgacttcgataaatcttttaacgtgctgaatgaggcgtatgaagaactccagaacggcgaagggagcttcaccatcgagccctccaaggttgagaaaattggacagctgctgctcgacacgaagatgcgcaaactggatcggcagaaggccgtggctaaacttctggaagtcaaggtggccgacaaggaggaaaccaaaagaaataagcaaatcgctacagccatgtctaaactcgtgctgggctacaaggcggactttgccaccgtcgctatggttaacgggaatgagtggaagatcgatcttagctccgaaacaagcgaggacgagattgaaaaattccgcgaggaactgtctgatgcccagaacgacatcctcaccgagattacgtccctgttcagccagatcatgctgaatgaaattgtgcctaacggaatgtctatctccgagagcatgatggatcggtactggacacatgagagacagctcgctgaagtgaaggagtatctggccacccaaccggcctctgctcgcaaagaatttgaccaggtctacaacaagtatatcggccaggcgcccaaagagaaggggttcgatcttgagaagggactgaaaaagattctctccaaaaaggaaaattggaaagagatcgacgaactgcttaaggccggcgattttctgcctaagcaacggattagcgctaacggcgtgatcccccaccagatgcatcagcaggagctcgacagaattatcgaaaaacaagccaagtactatccttggctggccacagagaatcccgctaccggggagcgcgatcggcaccaggccaaatacgaactggaccagctcgtttccttcagaatcccgtattacgtgggacctctggtcacccccgaggtgcagaaggcgacatctggcgctaaatttgcctgggccaagcgcaaagaagacggggagattacgccttggaacctttgggataagatcgaccgggctgaaagcgccgaggctttcattaagagaatgaccgttaaagatacatacctgctcaatgaggacgtgctgcccgccaactccctgctttatcaaaagtacaatgtcctcaacgaactgaataacgtgcgggtcaatggacgcagactgagcgtgggcatcaaacaggatatttataccgagctctttaagaaaaagaagacagttaaagcgtctgacgtggcctccctggtcatggctaagaccagaggggtgaacaaacccagcgttgaaggactttctgatcctaagaaattcaatagcaacctggccacgtacctcgacctgaagtccatcgtgggcgataaggtcgacgataatagatatcagatggacctggagaacattatcgaatggcgctctgtgtttgaggatggcgagatcttcgctgacaaacttacagaagtggagtggctcaccgacgaacagcggagcgccctggttaagaaaagatacaaggggtggggacgcctgtccaaaaagctcctgaccggcattgtcgatgagaacgggcaaagaatcattgaccttatgtggaatacagatcagaactttatgcagatcgtgaatcagccggtgttcaaggagcaaattgaccagctgaaccagaaagcgatcaccaatgatggaatgacactccgggaacgcgtcgagagcgtgctggacgatgcctatacgtctccccaaaacaagaaagctatctggcaggttgtgagagtcgtggaagacattgttaaggccgtgggcaatgctcctaaatccatcagcattgagtttgcccggaacgaagggaataagggcgagatcacccgctctagacggacacagctgcagaaacttttcgaggatcaagcccacgaactcgtcaaggacacctccctgacagaggaactggagaaggtgcccgatctcagcgaccgctactacttctattttacccagggaggcaaagatatgtacacgggggaccctattaacttcgacgaaatctccaccaagtatgatatcgaccatattctgccccagtcttttgttaaagatgacagccttgataatagagtgctgacatcccggaaggagaacaataaaaagtctgaccaggtcccggctaagctctacgcggccaaaatgaagccttattggaaccaactgctgaaacagggacttatcacccagcgcaagttcgagaatctcacaatggatgtggaccagaccattaaatacagaagcctgggctttgtgaagcggcaactggtcgaaacgagacaggttatcaagctcacagctaacattctggggtccatgtatcaggaggccggaaccgatatcatcgaaacacgcgccggccttaccaaacaactgcgggaggagttcgacctccccaaggtgagagaggtgaacgattaccaccatgctgtcgacgcctacctgaccacatttgcggggcagtatctgaatcgccggtaccctaaacttcggagcttctttgtgtatggcgagtacatgaagttcaaacacggatctgacctgaagctccgcaactttaatttctttcatgaactgatggagggcgataagtcccaggggaaagttgtggaccagcaaacgggagaactcattaccacacgggatgaggtcgctgactatttcgattgggtgcaggacctgaaacttatgctggttaccaaggagctcaagagaagcaacggcaaactgttcgatgccacaatccagaatgccaactacaccaagctgaatgaacgcaagaaagtgtttgtcccccttaagaaagagctggacaagacgctctatgggtcttactccggcattcagagctcttacatgacaatcgtgaaaaagttcgataaaaagggaagcacctatgctgttcaacggattcctgtgatgtactccaagctgctcgaactggagaaagaacagagcaaacttaacagactggtccagtctatcgtgacctccgacccccaggccccgaataactttgaggtgctcatgccttgcgtcctgagcgggcaactggttattgataatggccggaagttcacacttacctcctatcgctaccagtgttctacagcgcagctgtttctccccaagaaagacctgaagtatatccagaacaatttcaaggagctcaaaaagacgcccgataaacaagacaagatctttgaaaccatttacgacgatatcctgaaacaggtggacaagtatttcagcctttacgatattaacaagtttagatccaaactgcacgacggaaaggataaattcctggctctcgagaattttggcgaaaaggagtctaaagacaaggtgatcacaaagattctgcgggggcttcacgccaacgccgaacgcaccagcctgaaagagatcggactctccacacctctgggccagttccaatctggggagggaggcatcaccctcagcgataacacgaagattatctaccagtccccgaccgggctgttcgaaagacatgtctatcttaaagacctgtga

SEQ ID NO: 4331 - RNA, 4128 nt, synthetic construct
  misc_feature 1..4128: note = Cas9 variant
  source 1..4128: mol_type = other RNA
atgagaaagaaccaggagccctacaatatcggcctggacattgggaccagctccatcggatggtctattatgaacgataatttcgacctcatgcgggtgaaaggcaagaaagggatcggagtccgcctgtataacgaaggccaaagcgccgctgagagacggatgcaccgcacagccagacggcgctacgggagacggaagtggcgccttagactgctcgaagatttcttcgacgagcatatggcggaagttgatgacacgtttttcgctcggctgaaagattccaatatttctcctaaggacgataagaaatatcgcaagagccttctgtttccgaaatccaagggagtgacctaccaggacgatggcgagttctataaaaagtaccccacaatgtatcacctcagatacgccctgatgaccgagcatcggaagtttgacctgcgcgaaatctacctcgccttccaccatatggtgaaatatagaggcaactttctgtacgatacatctgtcgacagcttcgaggctaagaatcttgacatcaaagggaagtttgatgaaattaacgacctgctctccagctataccgatttctacgtggacaattctaacgccgctctggttgagtccatccttctggagaaaaatacaacccggaaggataaaagcaagaagattgccaaactcctgcacgtggaagacaaggagaaaggaaagaacaaaaaggcgaaggatctggccacgcagatctctaatgctgtcctcggcctgaaatgcaactttcaccttattttcgaactgcagcaaaagtattccttcgacctctgtagcgagaaaaccgaagagaatatcgccaagctgtctgaggtgcttgatgaaaaccagaaaatgctgctcatgattctgaaggaggttcaggaccaggtgatgctgaacgcttttgtcccttccgggatgagcctctccgaagccatgatgcaaaagtacgatgactatggagagcagctgaaaatctaccatgaacttgagcactctgtgagcgacgattccgcggccaagctgagaggcgcttaccgcgactataatgataacatcattaaacggatcgacggggataataagaaagacacattctacaagagagtgaagaacattctcaccaaaatcagcaaggagtatgtcgatcaggacgttctggaatcttgcggaaaacttaagaaactgattgatgagaataagctctttatccgccagcggacagccgctaacggcgtgctgccccatcaactgcaccagatcgaaatgagaaaaattatcgacaatcagaaggagtactatccttggctcgccgaacccaaccctaatgagaagcgccgggtgtactccaaatataaggtcgaggaactgattgccttcagaatcccgtactacgtgggcccccttgttgatcctaacaatgctgacaaaaacaaggaggcgcgctttagctggatggtgcggaaaaaggatggggaaattaccccctggaatttctatgacaaggtcgactgggccgagtctgctaacaattttatcgagagaatgaaaagcaaggatacgtacctgctcggagaagacgtggttcctaaagagtccatgctgtatcaaaagtacgaagtgctgaacgagcttaacaatctccgcatcaacgattctggcctgagcgactccttcgaagatgtcaaactgaagcaggccatttataatgacctctttaagaaacagaagatcgtgaaaattacagatctgcagaactaccttgtccaaaatcacaagtatctggtgaaacccaagatcagcgggctcgccgacgagaaccggttcctgtcttccctgagcacctactctgatcttaagacaatttttggagacaaagttgatgacagaacctacttcaatgattttgagaagatggtggaatattccaccgtcttcgaggacggccatgactacaaccagaaactcgatgaatatacatggctgacgaaggaggaaaaatacaagatcgggaaaaagcggtatcgcggatggggcaagctgagcaaaaagctcctgaccggccttagagacaaaaataaccacacaattatggataatctgtgggagaccaaccggaatttcatgcagatccagacagctgacgagttttccaagcaaatcgccgaagagaacgaaagacatctcaaagggtctgtgagcgatgcgattaatgacatgtacacctccccggctaacaagaaggccatccgccaggttctgcgggtggtcgatgacattcagaaagccatgggatatgctccttctagcatctccctggagttcgccagagaagatggccccagcgtgcgcacggtgtctagagctaaccggatgaagtccatttacgagaaatacgccagcgaggtttctgaagaggtcatgaaggaccttgatggggtgatcaaagacaagaagggactcaatgaccgcctgtatctgtactttgaacagcaaggcaaagatatgtattccgggcaccctctcgacttcgataaggtgatcagcggccaggagtacgacattgatcatatcctgccccaggcggtcattaaagacgattctcttgacaacagagtgctgacaaccaaggccctcaataacgatgttaaaagcaagggagtgccctgtcggatgtttaatggcatgcactccttctggaagaacctgtatgacaaagggtttatcagccgcagaaagttcaataacctgaccacaaatcctgagaacattgataaatacaagatgaaaggatttgtcaatcggcagcttgtggaaacccgccaaatcatcaagctcgttgctaacgtgctgaatgacaagtatcagaacgatgacgtcgacattatcgaggtgagagccgaactgacacacgatgttcggaaacatttcaagttttacaaaaatcgcaacgtgaacgactaccaccatgctttcgatgcctatctcacgtcttttattggccactacctgttcaagaaatatccgaatcttagacccctgttcgactacaacgattttatgaaggtctccgacaatgtgttcaaacagctccgggggaacaattttctgggagagttcctgaacaagaccggcgatatcattagcacagacgggaattttgtgcttaacaaggaagagatgatcaataaactgaacaaggcgtatgccttcaaaaagatcctcgtcaccaaagaggttggccaaagaacaggagctatgtttaatgaaacccgctaccctgcccccaactcccggaaggctgccctgaagtatagacgcatgcctaaacccgattctctcattagcgtgaaggactacaaaaatacggatatctacggcgggtattccggaaagaacgacgcctacatggtgattgtcgatatgggcaaacagtatatggtggttggggtgccggtccggtacaccgagaagctggacaaacttagaatcaaacactctgaactgtatcgcgacgagctccggaaggtgctgagcagagataaaacactgcttgactccaagggaaatgttaaacgcttcgatattgtgctggaccgggtcctctacggccagctgatcgaagatgggaacgagctctttaccctgggctctagcaagtataagagaaatttccggcagctttttctggacaaacaatgcattgagatcctcgattccagcgctacacctcagcccaccgacgaagaactgatctgggtgtacgatcagattctggacaaggttgataaatacttcgaactttatgacatcaaccgccagagagagacgctgcggaagggacgcgcggccttctgttctctccctaacatttccatgaaaaaggacgatgtgacaaagaagaagatcctgaatgaaattctcgtcgctctgcatgccaacgagagcgagtctaattgcgagaaaatcggcaagaaagtgtttgggagacttcaagtgcccggaggcatcaagctgtccaaagaggccaagctgatttaccagagccctaccgggctctttgaacgggtcgtttatctgaaggacctttga

SEQ ID NO: 4332 - RNA, 4128 nt, synthetic construct
  misc_feature 1..4128: note = Cas9 variant
  source 1..4128: mol_type = other RNA
atggagaacaagaaatacagcatcggcctggacattgggacctcctctatcggattcgccgtggtcgatgaaaataacagagttatgcgggtgaagggcaaaaatgctattggggtgcgcctctttagcgagggacagcccgccgcggacagacggtccttccgcacaacgagacggcgcctgtctagacggcgctggagacttcggctgctccgcgaaatctttgagccttatattaacccggtcgatgaggctttctttatgagactgaaggagagcaatctttcccccaaagacgccaacaagcactactctggcgatatcctgttcaataaccaaaccgaccaggatttttatgagaagtaccctacaatctatcatctccggcacgccctgatgaccgaacatcgcaaattcgacgtgagagagatttacctggctatccaccatattgttaagtttcgggggcacttcctcaatgccgctagcgcctccaactttacagtgggaaaactgaatcttgaaggcaagttcgatgcgctgaacgagatctatcagagagtcctcaccgacgatccctttgccctgcgcacagacaatcttgatcacattaaagagatcctgattgacaacaagcggagccaggctgacagacaacgcaccctcacgggcgatgtgtaccagtcttccgaagagaaggaaatcgagaaacggaataaggccatcgctaccgaaattctgaaagccgcggttgggaacaaggccaaactgaacgtgatcacaaatgtcgaggtggacaaggaggctgccaaagattggagcctcaccttcgactctgaaacaattgatgacgagctggctaaggtggatggacagatgaccgacgatggcagagaaatcattgagatccttcgctccctgtacagcgggatcacgctcgccgccattgtccctgaaaaccatacactgtctcagtccatggttgagaagtataatagccacaaagctcatcttaagctgctcaaagacctgatcaacaatatgaccgatacaaagaaagcgaagaacctgcgggccgcttacgacggatatattgacggcgtgaaggggaaagtgctcaccagagatgacttctacaagcaaatccagggaaatctggatgactccgccgaggcccagaaaattcaggatgtcatggaccaagatgaatttatgcccaagcagcgcaccaaagctaacggctctatccctcaccagcttcaacagcaggagctggaccagatcgtggaaaatcaaaaggagtattacccgtggctcgccgaagagaaccccaatgagacacggagaggcgttgcgaagtataaactggatgaacttgtgacgttccgcgtcccttactacgtggggcccatgattaccgctgaggaccaggaaaagcagagcggagcctcctttgcctggatgaaacggaaggagcctggcaacatcacaccctggaatttcgatcagaaagttgacagaatggctagcgccaaccaatttattaagcggatgaccacaaccgatacgtatctgctcggggaggacgtgctgccggctcagtctctgctctaccagcgcttcgaagtcctgaatgagcttaacaagatcagaattgaccggaaacctatctccattgaactgaagcagcaaatctttaacgatctcttcaaaaagtttaaaaatgtgacaatcaagcacctccaggagtatctggtcgccaccggaggctacgacaaaagaccccgcattgatgggcttgcggacgaaaagcggttcaacagcggactctctgcctatcatgatctgcacggcatcctgggcgctgaggtggttgacgccaatgataagcaggacgatctcgagaaaattatcgaatggagcaccatttttgaggacaagaaaatctacagagctaagctggatgaacttacatggctgaccgactcccagaaagagaagctcgccacaaagcgctatcaagggtggggaagactgtctaaaaagctgcttagcggcctccggaactccgatcatcgcagcatcctggacattctgtggatcacgaatgaaaacttcatgcagattcaggcggaccctgattttgccgagctcgtgaaaaatgctaaccaagggatgctgggaaagaataactctcaggacgtcatcaatgatctttacaccagcccccagaacaaaaaggccattagacagatcctgctcgtggttcacgacatccaaaatgctatgcatggccaggcccccgccaagattcacgtggagttcgctcgcggggaagaacggaaccctagacggtccatccagcgccagcaccaaattgaagcggcctacgataaagtcacatctgacctgctggtggatgctggcgtgagacaggagcttaaggacgccatcaatgataaacgggacttcaaggatcgcctctttctgtatttcatgcagggaggcagagacatttacaacggggaaccgatcaacatcgaccggctgtccagctatgatattgaccatatcctcccccaggcctttgttaaagatgactccctgaataacagagtccttaccgatgctgagggaaatcgccggaagtctgacgccgtgcctagcgagctgttcggcgcgaagatgagatccacatgggaactcatgcgcgagcaagggctgatttctaaagctaagtaccggaacctgaccatgaatcccgaaaacatcaatgcccacacggagaacggatttattaatagacagcttgtggagacccgccaggtcatcaaactcgccgtgaacattctggctgatgaatatacagaggacacccaaatcgttagcgtgaaggccgatctgtcccatcagatgcgggaagacttcgagctcctgaaaaatagagatgtcaacgactaccaccacgcgtttgatgcttatcttgccgccttcatcggcaattacctgctcgaacgctaccctaagctgcagagctattttgtgtacggggacttcaaaaagttttctcagaaggacacaaaaatgcggagattcaactttatttatgatctgaagcattccgaccaaatcgctgataaaaatggcaagaaaatttggcacaagaccaacgaccttgattacatccggcatctgttcgcctataagaaaattctcatcagccacgaggtttctgagcgcagaggagctctgtacaaccagacggtgtataaggcctccgacgataaagcgagcggccaggggtctaagaaactcatccccattaaggccaataagccgacagaaatctacggaggctacaccgggaaaacactggcttatatggccattgtcaaggtgatcaaaggaaagaaaattgcttacaaggttgtgggcgtccctaccagcgcccttgtgcagctggccgggatcgagcatggctcccaagaggaactcaaccggctgtatgacgtgctgaagccccagttcacccagcttaaaaagaataacaaaacaggagaaatcagcgagacggtctctaagtttgagattgttatccctcgcgtgaaataccagcaactggtggaagatgacgataagctgttcatgattggctccgacacctatccctacaatgctcagcagctggtcctcagcgagggggcgctgaaggtgatcaacaatgtttatagaaaaggagaaaactccgataagcaggagtcttacaaacttgacgacgtgtacgatgaaattatcattgccatgaagaaatattttcctctgtacgacaatcggggcttcagagagaaggtcgctgaggggaaaagcacatttgaaaacctccccatctccaatgagttcaagaacggaaagctgaccaaaatcggcaagaaagaagtgattaatcgcatgctgcaagggcttcacgccaacgccacaatgaccgatctgaagatcctcggcattaaatctccgtttggattcatgcagcagcctacgggcatcgctctgagcgagaatgcccaactcatttatcagtcccccacagacctgtttgagcggagagttcagcttaacaagatcaagtga

SEQ ID NO: 4333 - RNA, 4128 nt, synthetic construct
  misc_feature 1..4128: note = Cas9 variant
  source 1..4128: mol_type = other RNA
atgaagaaaatcctgggcctcgacctggggaccacaagcattggatgggcccttgtgtacgagtccgaaaacacggatgagaagtctagcatcgtcagactgggcgttcgggtgaatcccctctccgtggacgaaaaagggaacttcgagaagggaaaagctattaccacaaatgccgatcgccagcaaacccacggcgcgagaatcaacctgcagcggtataagctgcgcagagaaaatctgaaggactgcctccagaaacaggggtggattggaacagaggctctgtgtgaggaaggcaagacctctacatttgagacctacatgctgcgggccaaagccgctgaagaggagatcagcctccatgaactgtgccgcgtccttttcatgatgaacaagaaaagaggctataagtccaatcggaaggccaacaataaagaggatgggaagctgtttgacggaatgacggtggctaaaaagctctacgaggaacacctgacccctgccgaatattctttccaacttctgagctccggcaaaaagtttaaacaggagtactatcgcagcgatctcaaggaggaatttgacagaatctggaacgagcagcagaagtactacccggaaattctgacagatgactttaaacaacagctgcaggggaagtctaaaggaaatacctccaagatcttcctcggcaaatatgggatttacagcgcggatctgaagggacttgaccggaagctgcagcccctcaaatggcgcgttgaggccctgaagcaacaggtggataaagaagtccttgcttttgtgatctctgacctgaacggccagattgcctccacaagcggcctcctgggggctatctctgacagatccaaggagctgtatttcaataaacaaaccgttggacagtacctctggacgagcctgaaggagacacctcatgtgtccattaagaacaaacccttttatcggcaggattaccttgacgaatttgagaagatctgggaaacccaggccacatatcacaaagagctgacccctgaactcaagcaagagatccgcgatattatcattttctaccagagacccctgaaatctaagaagggccttatcagcgtctgtgagctggaacagcggaaagtgaaggtgaccattgacgggaaagagaaggaaatctccatcggacctaaagtcgcgcccaagagctctccgatgttccaggagttcagaatttggcaaaatctcaacaacatcctgctgattgataaaggcaataactccatccatcctctctacgaggaagagaagaatctgctttatgaggaactgagcgttaaggaaaaactctctaaggccgaggctctgaaagtgctgaacaagaatagcaaacagtgggaccttaactacaaggagattgaagggaatcgcacacaggccgtgctctatgattgctacaaccggatcatcgtcatgacgggacacgaggaatataattttaagaaactgaaggcttccgagattagatcttacgtgaaaaccacattcaccggcctgggctttaacacagacatcctcgagttcgatagctccctgaccgggcacgaacttgagaagcagcccatgtatcaactgtggcatctcctgtacagctacgaatctgacaattcccgcacgggaaacgatgccctgcttcggaaactcgagacagcctttggcttccctaaggaatatgctgcggttctgagcgacgtggtctttgaggactcttacgggaatctgtccgtgaaggccatgagaaaaattctcccccatctgcaggctggacttaactatagccaggcctgtgaagaggccggctacaagcactcccgccggtctctgaccaaaaatgagctcgatcagaaggaatataaagagaagctggaactgcttccgaagaacagcctccacaaccctgttgtggagaaaatcctgaatcaaatgattaacgtcatcaatgctgtgattgacgagtacgggaagcccgatgaaatcagaatcgagctggcccgcgaactcaaaattggcgcggctgagcgggaaaacatgaccagatccatcaatcagggaaacgccgagaataagcgcattcgggagatcctggaaaaagagttcgccctttcttatattagcagaaacgacatcatcaagtacaaactgtacgaggaactcaagtccaatggctttaagacactgtatagcgatacctacatttctaaagacaagctgttctccaaagattttgacatcgaacacattatccctaaggctcggcttttcgatgacagcctctctaacaaaacaattgaggcccgcgatgtcaatatcgctaagtccaacaagacggcctttgacttcatcagcgagaaatatgatcagcaagggattgaagcgtacaagaaaaagctggacatcctgctccaggacggatctattagcaaagccaagtataatagactgcttatgaaggaggctgatatcccctccggcttcattgaccgggatctgagagacacccagtacatcgccaaaaaggcttatgaaatcctcagcgatctggtgcgcaacgttacacccaccacaggggccgtgacctctcggctgagagaggactggcagcttgtcgatgtgatgaaagaactgaattttgagaagtaccaaaaactcggactggttgaggtgattgaagaccgcgatggcagaaagatcaagcggattaaagactggacgaagcgcaacgatcatagacaccatgcgatggacgccctcaccatcgctttcacaaaaccttcctacattcagtatctgaacaatcttaacgcccggagcgataaaaattcctctatctacgggattgagaacaaggaactgcaccgcgaggacaataagctcagatttaacgctccgctgcccatcaatgagttccgggccgaagcccgcagacatcttaagagcatccttgtctccgtgaaagctaagaacaaagtgatgacccagaatgttaacgtcattaagacaaaacacggcgtgatcaagaaagtgcagctgacccctcggggagagctccacaatgcgacgttttatggcacaaagaagcgccccattatcaaaatggtcaaggtgggggccgctctggacgaagttaccattaaaaaggtgtctagctccttcatcagagaggccctcctggatcggcttcatgaatacaacggagacgccaaaaaggcttttacaggcagaaattctatcgataagaaccctatttatatcgacgaggagcacaaaaagaccgtccccgccctggtgaaaaccattgaatgggagatgtaccatccgacacgcaagctcatcagccctgatctgaaaattgacaaggttatcgataaggggatccgggaaattctgaaaacgagacttgcgaagttcaatggagacgctcaaaaagccttttccaacctggatgagaaccccatctataaggacgaagccaaaaagattaccctcaagcgcgtgagcctggagggcgtctcttccgtgatccctctccacacactgaaagatcgggaggggaaacttgttgtgggcaaggacggaaagcccgtcctgggcgactacgtgcagaccagcaataaccaccatattgctttctacatggatgaaaatgggaacctgcaggacaatgtggtctctttcttcgaggccgcggaaagaaaatcccagggagttcctgtgatcgataagaactataatcacgacaaaggctggaactttctcttcacaatgaagcaaaatgagtacttcgtgtttcccaacgaagtcaccgggttcaatccgagcgaggtggatctgatggacgaggctaactattctattatctcccctaatctttaccgcgttcagaagatgagcaaagcctccggacgggattattggtttagacatcacctggaagccatgctcaacgacgatcccaagctgcgcaatagcatgttcaaacggatcacgtctctcaaggctctggagggcattgtgaaagtcagaatcaactgcattgggaagatcgtggccgttggcgaatacgactga

SEQ ID NO: 4334 - RNA, 4128 nt, synthetic construct
  misc_feature 1..4128: note = Cas9 variant
  source 1..4128: mol_type = other RNA
atgagcaacaagtcctactctatcggcctggacattgggaccaatagcgtgggatgggccgtcatcacagatgactataaagttccctccaagaaaatgaaggtgctcggcaacacggataaacacttcattaagaagaatctgatcggggcccttctgtttgacgagggaaccacagctgaagatagacggctcaaacgcaccgcgagacggcgctacacaagacggaagaaccgcctgagatatcttcaggagattttctctcaagaaatcagcaaagtggactccagctttttccatcggctggatgactttttcctcgtccctgaggataagcgcggcagcaaatacccgatctttgctaccctggtggaagagaaggagtatcacaagaaattccccacaatttaccatctgagaaagcacctcgccgactccaaagaaaagaccgatctgcggcttatctatctggccctcgctcatatgattaaataccgcgggcactttctgtacgaggaatctttcgacatcaagaataacgatattcagaaaatcttttctgagttcatttccatctatgacaatacgtttgagggaaagagcctttctggccagaacgcccaggttgaagctatcttcaccgacaagatttccaaaagcacaaagagagagcgggtgctgaaactcttccctgatgaaaagtctaccggcctgttttccgagttcctgaaactcatcgtcgggaatcaagccgactttaagaagcacttcgatctggaagagaaagcgccccttcagtttagcaaggacacatacgatgaggacctggaaaacctcctgggacagattggcgatgacttcgccgatctttttctggtggctaaaaagctctatgacgccatcctgctgtccgggattctcaccgttaaagatctgtctacgaaggctcctcttagcgcctccatgatcgagcgctacgaaaatcatcagaaggacctggcggccctcaaacaattcatccagaacaatctgcaggagaagtatgacgaagtgtttagcgatcagtctaaagacggatacgctggctatattgatgggaagacaacccaagaggccttctacaaatacatcaagaaccttctgtccaagtttgagggagctgactatttcctcgataaaattgaaagagaggactttctgaagaaacagcggacattcgataatggcagcatcccccaccagattcatctgcaagaaatgaacgccatcatcagacgccagggcgagcactaccctttcctccaggaaaacaaggagaaaattgagaagatcctgacctttcggattccgtattacgtcgggccccttgccagaggaaatggcgacttcgcttggctgacccgcaactctgatcaggcgatccggccttggaattttgaagagattgtggaccaagccagctccgctgaagatttcatcaacaaaatgacaaattatgacctctacctgcccgaggagaaggtgctgcctaagcactctcttctctatgaaacgtttgccgtctacaacgagctgaccaaagttaagttcattgccgaagggctgacaagataccagtttctcgataaaaagcagaaaaaggacatcttcgacacctttttcaaggctgagaataaacgcaaggtgacagaaaaagatatcattcattatctgcacaacgtggacggatacgatggcatcgagcttaaggggattgagaaacagtttaatgccagcctgtccacctatcatgacctcctgaagatcattaaggataaagcgttcatggacgatagcaagaacgaagagatcctggaaaatatcattcacacgcttacaatctttgaggaccgggaaatgattaaacaaagactcgctcagtacgattctctgttcgacgagaaggtcatcaaagccctgacccgccggcattataccggatggggcaagctctccgccaagctgattaacggcatcagagataaaaagagcgggaaaacaatccttgactacctgattgatgacggagagatcaatcgcaacttcatgcagctcattcacgacgatggcctgtcttttaaggaaatcattcagaaagctcaagtgttcgggaagaccaatgacgttaaacaggtggtccaggagctgcccggatccccggccatcaagaagggcatccttcagagcattaaaatcgtggatgaactcgttaaggtgatggggcacgctcctgagtccattgtcatcgaaatggcccgggagaaccaaacaacggcgagaggcaaaaagaactctcagcagcggtataaacgcattgaggacagcctgaagaatctggcctccggactcgattctaacatcctgaaggaaaatcccaccgacaacattcaacttcagaatgatagactgtttctctactacctgcagaacggccgggacatgtatacagggaaacctctggagatcaatcagcttagcaactacgatatcgaccatattatcccccaggctttcattaaggatgactccctcgacaatagagtgctgaccagctctaaagataaccgcggaaagtccgacaatgtccccagcctggaagtggttgagaaaatgaaggccttttggcaacagctcctggattctaagctgatctccgagcggaaattcaacaatctgacaaaggctgaaagagagcgcggcgggctcaacgaactggacaaagtgggatttattaagagacagctggtcgagacccggcaaatcacgaaacacgtggcccagttccttgatgcgcgctttaataaggaagttaccgagaaggacaaaaagaacagaaacgtgaaaatcattacacttaagagcaatctcgtctctaacttccggaaagagtttggcctgtataaggtgcgcgaaatcaatgattaccatcacgcccacgacgcttatctcaacgccgtgctggctaaggccattcttaaaaagtaccctaaactggagccggagttcgtttatggggattaccagaagtacgacctccagagatatatcagcaaatcccgggaacccaaggaagtcgagaaagccacccaaaagtacttcttttatagcaatctgctgaacttctttaaggaggaagtgcattacgctgatggcacaattgtgaaacgcgagaatatcgaatattctaaggacaccggagagatcgcgtggaacaaagaaaaggatttcgccacggtcaaaaaggtgctttccctgcctcaggttaatattgtgaagaaaacagaggtccagaccggcgggtttagcaaggagtccatcctccccaaaggaaactctgacaagctgattcctagaaaaacaaaggaaatcctctgggacaccaccaagtacggcgggttcgatagccccgtgattgcttattccatcctgcttattgccgacatcgagaaaggaaaggccaaaaagctgaaaacagttaagacgctcgtgggcatcaccattatggaaaaggctacatttgagaaaaatccgatcaccttcctggagaacaaggggtaccacaatgtccggaaagaaaacattctgtgccttcctaagtactctctgtttgagctcgaaagcggccgcagacggatgctggcctccgcgaaagagctccaaaagggaaatgaaatcgtgctgcccgtttatcttacaaccctgctgtaccattctaaaaacgtgcacaagctcgatgagcctgagcatctggaatatattcagaagcacagatacgagttcaaagaccttctgaacctcgtcagcgaattttcccagaagtatgtgctggctgatgccaatctcgagaaaatcaagaacctgtacgccgacaatgaacaggctgatatcgagattcttgccaacagcttcatcaatctgctgacgtttacagcgctcggcgctcccgccgccttcaaattcctggggaaggacgtggatcgcaagcggtataccaccgtctctgagattcttaacgctacactgatccaccaatccattaccggactctacgaaacaagaatcgacctgagcaaactcggcgaggattga

SEQ ID NO: 4335 - RNA, 4128 nt, synthetic construct
  misc_feature 1..4128: note = Cas9 variant
  source 1..4128: mol_type = other RNA
atggagaagaaatacagcatcggcctggacattgggaccaactccgtgggatgggccgtcatcacagatgactataaggttccctctaaaaagttcaaagtgctcggcaatacgaacagaaagagcattaagaaaaatctgatgggggcccttctgtttgattccggagaaaccgctgaggcgacacggctcaagcgcaccgctagacggcgctacacaagacggaaaaaccgcatcagatatctgcaggaaattttcgccaatgagatggccaagctggacgatagctttttccaacggctggaagagtcttttctcgtggaggaagacaaaaagaacgagcgccaccctatcttcggcaatctggctgatgaagtcgcctaccatagaaactatccgaccatctaccatctgcggaagaaactcgctgactcccccgagaaggccgatctgcgccttatttatctggcgctcgcccacatcattaaatttagagggcacttcctgatcgagggaaaacttaatgctgaaaactctgacgtggccaaactgttttaccagctcattcagacatacaatcagctgttcgaggaaagccctctggatgagatcgaagttgacgctaagggcattctctccgcccggctgagcaaatctaagcgccttgagaagctgatcgcggtgtttcccaacgagaaaaagaatggcctcttcgggaacatcattgccctggctcttggactgacccctaattttaaatccaacttcgatctcacggaagacgccaagctgcaactgagcaaagacacctatgatgacgatctcgacgagctgcttggccagatcggggatcagtacgctgacctgttctctgccgccaagaacctctccgatgctattctgcttagcgacatcctgagatctaattccgaagtcacaaaggcgcccctcagcgcctccatggtgaaacggtatgatgagcatcaccaggacctggctctgctcaagaccctggttagacaacagtttcctgaaaaatacgccgagattttcaaggatgacacaaagaacggatatgccggctacgtggggatcggaatcaagcaccgcaagcggaccacgaaacttgctacacaggaggaattttataagttcattaaaccgatcctggagaagatggacggcgccgaggaactcctggcgaaactgaatagagatgaccttctccgcaagcagcggacctttgataacggctctattccccatcaaatccacctgaaggaactgcatgctattctcagacgccaggaggagttctacccttttctgaaagaaaatcgggagaagatcgaaaagatccttacattccgcattccctactatgtcgggcctctggccagaggaaacagccggtttgcctggctcaccagaaagtccgaggaggctatcaccccctggaatttcgaagaggtggtggacaaaggcgccagcgctcagtcttttattgaacgcatgacaaacttcgatgagcaactgccgaataagaaagtcctgcctaagcactcccttctctacgaatattttacggtttacaacgagctgaccaaggtgaaatatgtgacagagcggatgagaaagcccgagttcctgagcggggaacagaaaaaggccatcgtcgacctcctgttcaaaaccaatcggaaggtgacagttaagcagcttaaagaagattactttaagaaaattgagtgcttcgactctgtggaaatcattggagtcgaggatcgctttaacgcgagcctgggcacctatcacgacctcctgaagatcatcaaagataaggacttcctggataatgaggaaaacgaggacattcttgaagacatcgtgctcacgctgacactgtttgaggatagagaaatgattgaggagcggctcaagacctacgcccatctgttcgacgataaagttatgaagcagcttaaaagacgccactacaccgggtggggacggctgtccagaaagatgatcaatggcattcgcgacaaacaatctggcaagacaatcctcgattttcttaagagcgacgggttctccaacagaaactttatgcagctgatccatgatgacagccttaccttcaaagaagagattgaaaaggctcaggtgtctggacagggcgattccctccacgagcaaatcgccgacctggctgggagccctgccattaaaaagggaatcctgcagacagtcaaaattgtggatgagctcgtcaaggtgatgggccataaacccgaaaatatcgttatcgagatggcgcgggaaaaccagacgaccacaaaggggctgcagcaatctcgcgagagaaagaaacggattgaagagggcatcaaggagcttgaatcccagattctgaaagagaatcccgtggaaaacacccagctccagaatgagaagctgtatctgtactatcttcaaaacggacgcgacatgtacgtcgatcaggaactggacatcaatagactcagcgactatgatgtggaccacattgttcctcagtcctttatcaaagatgactctatcgataacaaggtgctgacacggagcgtcgagaatcgcggcaagtccgacaacgtgccgtctgaggaagtggttaaaaagatgaaaaattactggagacaactcctgaacgccaaacttattacccagcggaaattcgataatctgacgaaggctgagcgcgggggactcagcgaagccgacaaggctggctttatcaaaagacagctggtcgagacccggcagattacaaagcacgtggccagaatcctggattcccgcatgaacaccaaacgggacaagaatgataaacccattagagaagtgaaggtcatcacacttaagagcaaactggtgtctgacttccgcaaggacttccaactctataaagttcgggatattaacaactaccatcacgcccatgacgcttacctgaatgcggtggtcgggaccgccctcatcaagaaatatcctaagctggagtccgagtttgtgtacggagattataaggtttacgacgtgagaaaaatgatcgctaagagcgaacaggagattggcaaagccacggccaagcgcttcttttattctaacatcatgaatttctttaaaacagaagtcaaacttgctaacggggagattcggaagagacccctgatcgagaccaatggcgaaacaggagaggtggtttggaacaaggaaaaggatttcgccaccgtgcgcaaagtcctcgcgatgcctcaggtgaatattgtgaagaaaaccgaggtccagacaggcgggttttccaaggaaagcatcctgtctaaacgggagagcgctaagctgatccccagaaagaaaggatgggacacgcggaagtacggcgggttcggatccccgaccgttgcctatagcattcttgtggtggccaaagtcgagaagggcaaagctaagaagctgaaatctgtgaaggttctcgtggggatcacaattatggaaaaaggctcctacgagaaggatcctatcggatttctggaagccaaaggctacaaggacattaagaaagagctcatcttcaagctgcccaaatatagcctttttgaactggagaacgggcgcagacggatgctggcgtccgctaccgagctccaaaaggccaatgaactggtccttcctcagcacctggtgcgcctcctgtactatacacagaacatctctgccaccacgggaagcaataacctcggctacattgagcagcacagagaagagttcaaagaaatcttcgagaagattatcgatttttccgagaaatatattctgaagaataaggttaactctaatcttaaaagctccttcgacgaacaatttgctgtgtctgatagcatcctgctgtccaacagcttcgtctctctcctgaagtacacatcctttggggccagcggaggcttcacctttcttgacctggatgtgaaacaggggcggctcagatatcagaccgttacagaggtgctggacgctaccctcatttaccaatctatcacaggcctgtacgaaacgcgcaccgacctttcccagctgggaggcgattga

SEQ ID NO: 4336 - RNA, 4128 nt, synthetic construct
  misc_feature 1..4128: note = Cas9 variant
  source 1..4128: mol_type = other RNA
atgaagaaaatcctgggcctcgacctggggaccacaagcattggatgggcccttgtgaacgagtccgaaaataaggatgagcagtctagcatcgtcagactgggcgttcgggtgattcccctcacggtggacgaaaaagggaacttcgagaagggaaaagctatcaccacaaatgccgatcgccaacaggtccacgcggctagaattaacctgcagcggtacaaacttcgcagagaaaatctgcgggactgcctccagaagcaaggctggatcgggtccgagcctatgtgtgaggatggaaaatctagcacctttgaaacatataagctgcgcgccaaagccgctgtggaggaagtttccctgcatgagttcgccagagtgctctttatgctgaacaagaaacggggctacaagtctaatcgcaaggctaacgacaaagaggaaggcaaacttttcgatgggatgaccatcgccaaaaagctgtatgaggaacacctcacaccggcggagtacagcctgcagcttctgaataccggaagaaaatttacgcccgaatattaccggtccgacctcattgaggagttcgaaaagatctggaacgagcagcagaaatattaccctgaaattctgaccgatgagtttaagcaacagctggaaggcaaggccaaaagcaatacatctaagctctttctggggaaatacggaatctattccgctgacaccaagggccttgatcgcagactgcagcccctcaaatggcgggtcgaggccatgaagcagcaagtggacaaggatgttctggcttttgtgattagcgaccttaaagggcagatcgccaacacatctggactgctcggcgcgatttccgaccgcagcaaggagctgtacttctctaaacagaccatcggccaatatctgtgggcctccctccaggaaaatcctcatatcagcattaagaaccagcccttttacagacaggattatctggacgagttcgaaaagatctgggagacgcaagctacataccacaaggaacttacctccgagctgaagcaggagattcgggatatcattatcttttatcagagacctctcaaatctaagaaaaatctgatcgccgtctgcgaacttgagcagcgcaaggtgaaagtgacagtcgacgggaaggaaaaggagattaccatcggaccgaaaattgctcccaagagctcccctatgttccaagagttccggatctggcagaacctgaacaatattctcctgctggatcatgaaaccaacagcaaaagacccctctacgaggaggaacgcaatctgctttacgaggaactgtctgttaaggagaaactctccaagacagaagccctgaaagtgctgggcaaaaagagcaagcagtgggaccttaactataaggagctcgaagggaatcggacgcaggccgtgctgtacgattgttataacagaatcatcgtcatgtctggacacgaggaatgcaattttaaaaagctgaaagctagcgacattcgccactacgtgaagatgatcttcaagaacctcgcgtttaataccgatattctgtgtttcgactcctctcttaaaggccatgagctggagcggcaacctatgtgccagctctggcatctgctgtatagctacgaaggggataactccagaacaggaaatgacgcccttctccgcaagctggagaccagctttggcttccccaaagaatatgctgccgttctggccgacgtgatctttgaggattcttacggcaacctctccgtcaaggctatgcggaatattctgccgcaccttcaggccgggaaagactacagccaggcgtgtgaagaggctggatataagcactctagacgctccctgacaaaggaggaactcaaccaaaaagtgtacaaggagaaactggaactgcttcctaagaatagcctccacaaccccgttgtggagaaaatcctgaaccagatggtcaatgtgattaacgccgtcatcgaggaatatggcaagcctgatgagatccggattgaactggccagagacctcaagatcggggctgccgagcgggaaaatatgacccgctccattaaccagggaaatgctgagaacaaaagaatccgggagattctggaaaaggagttcgccctttcttacctgagcagaaatgatatcatcaaatataagctctacgaggaactgaaatccaacggctttaagacgctgtattctgacacatacattagcaaagataaacttttctccaaggactttgatatcgaacatattatccccaaggcgcgcctcttcgacgatagcctgtctaataagaccattgaggcccgggacgtgaacatcgctaaatccaataagaccgcctttgatttcatcctggagagatacggggaacaaggcgttaaaacatataagaccaagctcctgcgccttctggaggacggagctattagcaacaaaaagtacaataacctcctgaaaacagaagccgacatcccctctggcttcattgatagagacctgcggaatacgcagtatatcgcgaagaaagcctacgagattctttccgaactggtgaagatcgtcacccctacaaccgggagcgtgacaaaccgcctcagagaggattggcagctggttgacgtgatgaaggagctcaactttgaaaaatatcagaagctgggacttgctgatgtcatcgaggaccgggatggccgcaaagtgaagagaattaaagactggaccaagcggaatgatcaccgccatcacgccatggacgctctgacgatcgccttcaccaagccgtcttacattcaatatctcaacaatctgaacgccagaagcgataaatccagctctatctacgggattgaagtgaaggagctgcatcgggaggaaggaaaatttcgcttcaatgctccccttcctatcaacgagtttagagcggaagccaagcggcacctgaaatccgttctcgtcagcattaaggctaagaaaaaggtgatgacacagaatgtgaacaaaatcaagaccaaacacggcatcattaagaaagtccagctgacacccagaggggagctccataatgccacctactatggcacgaagaagcgccctctggtgcggatggttaaagtgggagccgctcttgacgaagccacaatcaagagagtctgctcccccgcgattcgcgctgccctgctcaaacggctgaacgcctacaatggcgatgctaaggaggccttcaccgggagaaactctatcgacaaaaatccgatttatctggacatcgagcagacaaaacttgtgcctgttctggtgaagaccatcgaatggggaatgtaccaccccattcgcaagcggatcacccctgatctcaagattgacaaagtcatcgataagggcattagagagaaactgaaggcgcgcctcgctgaatttaacggggacgcccaaaaggccttcagcaatctggatgagaaccccatctatatggacgaagctaaacggatcacacttaagagagtgtccattgagggagttctgtctgccatccctctgcatacgctcaaagataaggctggcaaacccgtgattgggagcgacggcaagccggtctttggagattacgtgcagacctccaacaatcaccacatcgccttctatattgacgataagggcaacctgcaggacaatcctgtgtctttcttcgaggcggccgaacggaaaagccagggggtccccgttatcgaccgcagatacaactgtgataagggatggcattttgtgttcacaatgaaacaaaatgagtacttcgtgtttcccaacgaagctaccggcttcattccttccgaggtcgaccttctggatgaagccaattattgcatcatcagcccgaacctctaccgggtgcagaagctgtctaaggcttccgggcgcgactattggtttagacaccatctcgagacaatgctgaatgatgaccttcggctgaagaacagcaccttcaaacgcattcagtctctgaagggactcgaggatatcgttaaggtgagaattaattccatcggcaaaattgtcgccgtggggaagtacgactga

SEQ ID NO: 4337 - RNA, 4128 nt, synthetic construct
  misc_feature 1..4128: note = Cas9 variant
  source 1..4128: mol_type = other RNA
atggagaccaagttcacatactatctgggcctcgacatggggacggatagcctgggatgggccgtgaccgactcctcttaccacatccttagagctaaaggcaaggatctgtggggagtccggctctttcccgccgcggaaacaagcgttgaccgcagaacctatcgggtgaaccgcagacggcgccagagagaggtggctcggattggggccctgaaagaacttttcgccgatgagatcgaaaaggtcgaccctggctttttcgtgcgcctggatgagtccaaatttcatatggaggacagatctgaaaataacaagcaaaagtacggactcttcgctgataaactgtttagcgacgccgagtattacaagaaatatccgacaattttccatctgcggaaggaactcctggagtccgaggaaccccacgatgttcgccttgtgtacctggctctcctgaatatgtttaaacacagagggcatttccttaactctagcctgcagatcgagggcgaaaattccaacattgccgagagctaccagatgtttgtcgacaccctcaaggatgaagaactggacttccctgaacaggtgtctggcgaacggctgcaagagatctttcgctccagcgactctagaaagaaaaaggttgaaaatctcctggcggagatgaacctttccaaaaagcagaaacgggaaatccagttcgtgaatctgatttgcgggctcaagggaaaactgagcgagcttttccccgataaggagtatgacgaagaacagaagaaaatcgccttttctttccaagattccgactacgaagataaggagaacacaattcaggaactgctcgacgagagcgagatgaatatgatctatgctgtcaaagccgtgcacgattccggcgtgctgtctgggattatgaacggagaaagatacctgagcgtcgctcgcgttgcctcctatgagaagcacaaaaaggacctccagatcctgaaggatattcttaaaaagtacgacaccaaagaatattttgagatgttccggaatgagagcgaaaagtctgagaactactccgcgtacgtgggcagcgtgaaatatcatgggacgtttagacgcggactgtctggcggcaagcaggaagatctctacaagcacatcaaaaaggtcctggggaaattccctcaagacgacgagggagtgacctatgttcttgaagagatcgagacagagagctttctgcccaagcagctcaccgcctccaatggcgtgattcctaaccaggtccatgctcgggagatgctggccatcctgaaacacgctgaactctacctgccgttccttcaagagaaggatgacacagggctgtctgtgagcgaaaagattctcaaactgtttatgttccagatcccctattacgttggacctctgggccaggagtataaggataaaaaggggtacaacgtgtgggccgagagaaaagaacccggaaagatttacccttggaattttgaggaaaagatcgacgtcaagaagtccgccgagaaattcatcggccgcatggtgcggagatgtacctatcttagcggcgaacaggctctccccaagcaatctctgctgtacgagaaatttcaggtcctcaacgagctgaataaccttcgcattagaggggaaaagatcccggtgtccctgaaacaggagatttatcacgatctcttcggagacggcaagaaggttagcatgacgcggctgacaaattacctgcttcagaacggggtgatctcttccgaagagaaagatagctgcatttccggaatcgacggcgggttccataattctctcagctccgtcggcaagtttaaaggagtgttcggcgataccgttcacacagacgagcatcgcaagatgatcgaagatattatcttttgggggaccgtgttcggagacggcaaaaagctgctgaaggagaaagtcgaagaggtgtatgggaaccaactcaccgaagcgcagaagaaacggatttttggattcaagttttctggctgggggagactgagcaaagccttccttacaatggagggcgcttccaaggataatggagagatcaagggcctgattcaggccatgtgggacacgaactgtaatctcatggaactgctgagcgagcggtttacctacaaagacaaacttaacgaaatggtgacaaccgccgagaaacctctctgcgaatggaagatcgaggatctggacgagatgtatctgtctgctcccgttaaacgcatggtctggcagacaattagagtggtggatgaagtccaacagatcatggggtgtcctcccaagcggatcttcgtggagatgaccagatccgacggagaaaaaggcaagcgcacggttagccggcagaagaaactcgtggatctgtacaaggcccttgggaaagagggaaagatttggtctgaggagctgaataacacacccgagggccagtttagaatcaaaaagctctacctgtattacctgcaaatggggaagtgcatgtataccggcgaatccattgagcttgaacctctcatgaatgacaaccacctgtacgatatcgaccatatttatccgcgccacttcatcaaagatgacaacatcagcaataacctggtcctcgtgaagaaagagagaaatgcgcacaagtctgatagctttcccattgagcctgaaatccggaacaaaatgatgcccttctggaagtccctgcgcaagaaaggattccttaccgaggaaaagtacaatagactgacacggatgagcgcttttaccgacgaggaaaaagccgccttcatttctcgccagctcgttgagacatcccagggcacgaaggctatcacccaaatttttaaacaggccttcgctgatagcgagatcgtgttttccaaggcctctgtcgtgagcgcgttcagacagaagtttgactgttataaagttcggtgcgtgaacgactaccatcacgcccatgatgcttacctgaatatcgtcgccgggaacacatatcgcgtgaagttcacctccaatcctctgaactttattaaagaagctaagaaaaatcccaactctagagagaatcggtacaacatggacaagacattcgaatgggatgtgacccgcaatggagagacggcctgggtcgcgcagagcaacgaaaacccgggcaccatccaacttgttaagaaatatctgaataagaactcccctctcattacaaaaatggtgtacgagaagcacgggggaatcacccagaaagccacaatttggtctgctaagaaagccgagagcggcaataccgacgcttatatccccgtgaagatgaacgatcctagactggccgacgtcacgaagtacgggggcgtgacaaccatcgccgttgctggatatacactcctggaatacaaagcgggcgggaagaccgtgcggtcccttgaggccctgcccatttacctcggaggcagcaaaaatctgaccgaggagcagatggtcgaatatttttctaacatcctgcagcaagagaataaggagaaagtggtttccgatgtgattatcagaaagaagatgattcctagcgggtctcttatcaaatacaacggattctattactatctggctggcaagacaggcaatcgcattgtcctcatctccgccgtgcagctgtgtctccccatggacacgatgctgtacatcaaaaagattgaaaaagcctgcagcaccgggaacttcgaggaaaaggataagaatggaaaacaggttctttctaagcagcaaaacgagtttgtgtatgagctgatcattgaaaaataccagcagtccatcttcaagaaaaaggtcggcgctattggggacacaatcatcgagaagcgggaaaaatttgccgagattagcctcgaggaacaatgtaaggtgctgatgcagatcttcctgaattttcagtccggaattggcgtggatcttaccagcgtcgacgggtctaacaaaagcggagttacatacctgaataagaaaatcatgaacgcgcaggagctcaagctgattgaccaatccgtgaccggcgtgttctctagagaaatcgatctcctgacgatctga

SEQ ID NO: 4338 - RNA, 4128 nt, synthetic construct
  misc_feature 1..4128: note = Cas9 variant
  source 1..4128: mol_type = other RNA
atgagcaacaagtcctactctatcggcctggacattgggaccaatagcgtgggatgggccgtcatcacagatgactataaagttccctccaagaaaatgaaggtgctcggcaacacggataaacacttcattaagaagaatctgatcggggcccttctgtttgacgagggaaccacagctgaagatagacggctcaaacgcaccgcgagacggcgctacacaagacggaagaaccgcctgagatatcttcaggagattttctctgaagagatgagcaaagtggactccagctttttccatcggctggatgactcttttctcgtccctgaagataagcgcggctccaaatacccgatcttcgctaccctggccgaggagaaggaatatcacaagaaatttcccacaatctaccatctgagaaagcacctcgccgacagcaaagagaagaccgatctgcggcttatttatctggctctcgcccatatgatcaaataccgcgggcacttcctgtacgaagagtcttttgacattaagaataacgatatccaaaagattttctccgagtttatcagcatttatgacaatacgttcgaagagtcttcccttatcggacagaacgctcaggtggaagccatctttaccgacaagattagcaagtctgcgaaaagagagcgggttctgaaactcttccctgatcagaaatccacaggcctgttcagcgaatttctgaagctcatcctgggcaatcaagccgacttcaaaaagcactttgatcttgaggagaaggctcccctgcagttctccaaagacacctacgatgaagacctcgagaacctgcttgggcagattcgcgatgactttgccgatctgttcctcgtggctaagaaactgtatgacgccatcctgctctctggcattctgacagtcaaggatcttagcaccaaagcgcctctgtccgccagcatgatcgaacattacgagaatcaccagaaggacctcgctgccctgaagcaatttatccagaacaatcttcaggaaaaatatgacgaggtgttctctgatcagtccaaggacggatacgctgggtatattaacggaaaaacgacacaagaggccttttacaagtacatcaaaaatctgctcagcaagttcgaaggcgccgattattttctggacaagattgagagagaagatttcctgcggaaacagagaacctttgacaacgggtctatcccccatcagattcacctccaagagatgaacgctatcctgcaccgccagggagaacattaccctttccttaaggagaataaagagaagatcgagaaaattctgatcttccggattccgtattacgttggccccctcgcgagaggcaaccgcgattttgcctggctgacacggaatagcgacgaagctatcagaccttggaacttcgaagagattgtggataaggcctcctctgccgaggactttatcaataaaatgaccaactatgatctgtaccttcccgaagagaaggtcctccctaagcacagcctgctgtatgaaaccttcgctgtgtacaatgagctcacaaaagtgaagtttattgccgaagggctgacgcgctaccagttccttgacaaaaagcagaaaaaggatatcttttataccttctttaaggcggaggacaaacggaaggtcacagagaaagacatcattcattacctgcacaccgttgatggatatgacggcatcgaactcgaggggattgaaaagcaattcaacgcttccctgagcacataccatgatctgcttaaaatcattaaggacaaggagtttatggatgacgataaaaatgaagccatcctcgagaacatcgtgcacaccctgacgattttcgaggacagagaaatgatcaagcagcgcctggcccagtataattctctctttgatgagaaagtgattaaggctctgacacggagacactacaccggatggggcaaactttccgccaagctgatcaacgggattcgcgacaagaaaagcggaaagaccatcctcgattatctgatcgacgatggcgaaattaatcggaacttcatgcagctgatccatgacgacggcctttctttcaaagagattatccaaaaggctcaggtctttgggaaaacaaatgatgtgaagcaggttgtgcacgaactccccggatccccggccattaaaaagggcatcctgcagagcatcaagattgtcgacgagctggtgaaagttatggggcatgcgcctgagtccatcgtgattgaaatggccagagagaaccaaaccacagctcggggaaagaaaaactctcagcagcgctacaagagaatcgaagatagcctcaaaaatctggcctccggccttgactctaacattctgaaggagaatcccacggataacgtccagctccaaaatgaccggctgttcctgtactatcttcagaacgggagagatatgtacaccggcaagcctctcgagatcaatcagctgagcaactatgacattgatcacatcatcccccaggcttttattaaagacgattccctggacaatcgcgtgctcacaagctctaaggacaaccggggaaaatccgataatgtccccagcctggaagtggttgagaagatgaaagccttctggcaacagcttctggactctaagctcatctccgaaagaaagtttaacaatctgaccaaagcggagcgcgaaagaggcgggctgaacgagcttgataaggtgggattcattaaacggcagctggtcgagacacgccaaatcaccaagcacgtggcccagattctcgacacgagatttaataaagaagttaccgagaaggataagaaaaaccggaacgtgaagatcatcacactgaaaagcaatctcgtctctaacttccgcaaggaatttggcctgtacaaagtgagagagattaatgactatcatcacgctcatgatgcctaccttaacgctgtggttgccaaggccatcctgaagaaatatcctaagctcgaaccggagttcgtctacggggagtaccagaaatatgacctgaagcggtacattagccgctccaaagatcccaaggacatcgaaaaagctaccgagaagtactttttctatagcaatctgcttaacttctttaaggaagaggtgcagtatgcggatggaacaattgccaaaagagaaaatatcgagtactctaaggacaccggcgagatcgcttggaacaaagaaaaggatttcgccacggtgaaaaaggtcctgtccctccctcaagtgaatattgttaagaaacgggaggtgcagacagggggctttagcaaggaatccatcctgcccaaaggaaactctgacaagctcattcctcgcaaaaccaaggacatcctgtgggagacaaccaagtatggcgggttcgatagccccgtcattgcctactccatccttctgattgctgacatcgagaaaggaaagtctaaagaactcaagaccgtgaaaacactggttggcatcacgattatggagaaggccacctttgaagagaatccgatcacattcctggaaaacaaggggtaccacaatgtgagaaaagagaacattctttgcctgcctaagtatagcctctttgagctggaaaatggacggagacgcctcctggcgtccgctaaagagcttcagaagggcaacgaaatcgtcctgcccgtgtacctgaccacactcctgtatcattctaaaaaccttcacaagctggatgagcctgggcacctcgaatacattcagaaacatcggaatgagttcaaggacctgctcaacctggttagcgagttttcccaaaagtatatccttgccgatgccaatctggagaaaatccagaacctgtacgctgacaatgaacaggccgatattgaaatcctcgcgaacagcttcattaatctgcttacctttacgacactgggcgctcccgccgccttcaagtttttcggaaaagacatcgatagaaagcgctataccaccgtgtctgagattctcaacgctacactgatccaccaatccatcaccggcctctacgaaacacggattgacctgagcaaacttggggaggattga

SEQ ID NO: 4339 - RNA, 4128 nt, synthetic construct
  misc_feature 1..4128: note = Cas9 variant
  source 1..4128: mol_type = other RNA
atggaaaagagctactccatcggcctggacattgggaccaactctgtgggatgggccgtcatcacagatgactataaagttcccgctaagaaaatgaaggtgctcggcaatacggataaaaagtacattaagaaaaacctgcttggggccctcctgttcgacagcggagaaaccgcggaggtgacaagactgaagcggaccgctcgcagacggtatacacgcagaaagaatcggcttcgctacctgcaggaaatctttgccaaggagatgaccaaagtcgatgaatccttctttcaaagactcgaggagtctttcctgacagacgatgacaagacctttgatagccaccctattttcggcaacaaggccgaagaggacgcttatcatcagaaatttccgacgatctaccatctgcggaagtatctcgccgattcccaggaaaaagctgacctgcgccttgtgtacctggccctcgcgcacatgatcaagtacagagggcacttcctgattgagggagagcttaatgccgaaaacaccgatgttcagaaactgtttaatgtgttcgtcgagacatatgacaagatcgtggacgaatctcatctcagcgagattgaagttgatgcttccagcatcctgaccgagaaagtgtctaagtcccggcgcctggagaacctcattaagcaataccccacagaaaagaagaataccctgtttggcaaccttatcgccctggctctcggcctgcagcctaatttcaaaacgaactttaaacttagcgaggacgccaaactgcagttctctaaggatacatatgaagaggacctcgaggagctgctggggaaggtcggagatgactacgcggatctcttcatttccgccaaaaatctgtatgacgctatccttctgagcggcatcctcaccgtggatgacaactctacaaaggcgcccctgtccgctagcatgattaaaagatacgtggagcaccacgaagatcttgagaagctgaaagaatttatcaagattaataagctcaaactgtatcatgacatcttcaaggacaaaaccaagaacgggtacgccggatacattgataacggcgtcaaacaggacgagttttataagtacctgaagaccatcctcacaaaaatcgatgactccgattatttcctggacaagattgaacgggatgactttcttcgcaaacaaagaacgttcgataatgggtctatccctcaccagattcatctgcaggagatgcacagcatcctccggagacagggagactactatccctttctgaaggagaaccaagccaaaattgaaaagatcctgaccttccgcatcccttactatgttggcccgcttgctcggaaagattccagatttgcgtgggccaattaccacagcgacgagcccattacaccttggaacttcgatgaagtggtggacaaggagaagtctgctgagaaatttatcacccgcatgacactcaatgacctgtacctgcccgaagagaaggtcctccctaaacattcccacgtgtatgaaaccttcacggtttacaacgagctgacaaagattaaatatgtgaatgaacagggcgagagctttttcttcgatgccaacatgaagcaggagatctttgaccatgtcttcaaggaaaatcggaaagtgaccaaggccaaacttctgtcttacctcaacaatgagtttgaagagttcagaattaacgatctgatcgggctggacaaggatagcaaatcctttaatgcttctcttggaacctatcacgacctcaagaagattctggataagagcttcctggacgataagacaaacggccaaatcatcgaagacattgttctcaccctgacactttttgaggatcgcgacatgatccatgagcggctgcagaaatactccgatttctttacgagccagcagctcaagaaactggaaagacgccactataccgggtggggacggctgtcttacaaacttattaatggcatcagaaacaaggagaacaataaaacaattctcgacttcctgatcgacgatgggcacgccaaccgcaattttatgcaactgatcaacgacgaatccctcagcttcaagaccattatccaggaggcccaggtggtcggagatgtggacgatattgaagctgtcgtgcatgacctgcccggctctccggccatcaaaaagggcattcttcagtccgttaaaatcgtggatgagctggtcaaggtgatgggggacaatcctgataacatcgttattgagatggcccgggaaaatcaaacaaccggatacggcagaaacaaaagcaatcagcggctcaagcgcctgcaggactccctgaaggagtttgggtctgatatccttagcaaaaagaaaccctcctatgtggactctaaggtcgaaaacagccacctccagaatgacagactgttcctgtactatattcaaaacggaaaagatatgtacacgggcgaggagctcgacatcgatcggctgtccgactatgatattgaccatatcatccctcaggctttcattaaggataatagcatcgacaacaaggtgcttacctcttccgccaaaaatagaggcaagagcgatgacgtgccctctattgaaatcgttcgcaaccggagatcctactggtataaactgtacaagagcgggctcatttctaaacgcaagtttgataacctgacaaaggctgagagaggaggcctgaccgaagccgacaaagcggggttcatcaagcggcagcttgtcgagacacgccagattaccaaacacgtggcccaaatcctggatgctagatttaatacgaagcgggacgaaaacgacaaagtgatccgcgatgtcaaggtgattacactcaagagcaatctggtttcccagttcagaaaagagtttaagttctacaaagtgcgggagatcaacgactatcaccatgcccacgatgcttacctcaatgccgtcgtgggaaccgcgctgcttaagaaatatcccaagctgacacctgaatttgtttacggcgagtataagaaatacgacgtgcgcaagctcattgccaaaagctctgatgactattccgaaatggggaaggctaccgccaaatacttcttttacagcaacctgatgaatttctttaagaccgaggtcaaatatgctgatggaagagtgttcgaacggccggacatcgagacaaacgccgatggcgaggttgtgtggaataagcagaaggacttcgatattgtccgcaaagtgctgtcctacccccaagtgaacatcgtcaagaaagttgaagcccagacagggggcttttctaaggagagcatcctttccaaaggagactctgataagctgattcctagaaagaccaaaaaggtgtattggaatacgaaaaagtacggcgggttcgacagccccaccgtggcttattccgtcctcgtggttgcggacatcgaaaaaggaaaggccaagaaactgaagacagtgaaagagctcgtcggcatttctatcatggaacggagctttttcgaggagaaccctgtgtcctttctggaaaagaaagggtaccataatgttcaggaggataaacttattaagctgcccaaatatagcctcttcgaatttgagggaggcagacgccggctgctggcttctgccaccgagcttcagaaggggaacgaagtgatgctgccggcccacctcgtcgagctgctctaccatgctcacagaatcgactccttcaatagcacggaacacctgaaatacgtgtctgagcataagaaagaatttgagaaggttctttcctgcgtggagaacttcagcaacctgtatgtcgatgtggagaaaaatctgtctaaggtgcgcgccgcggctgaatccatgacaaactttagcctcgaagagatctccgccagcttcattaatctgcttaccctgaccgccctcggcgctcctgccgactttaacttcctgggagaaaagatcccccggaaaagatacacatctaccaaggagtgtctcagcgcgacactgattcaccaatccgtcacgggcctttatgagacccgcatcgatctgtctaaactgggggaagagtga

SEQ ID NO: 4340 - RNA, 4128 nt, synthetic construct
  misc_feature 1..4128: note = Cas9 variant
  source 1..4128: mol_type = other RNA
atgaccaagatcaaagacgattacattgtgggcctggacatcgggacagatagctgcggatgggtcgccatgaactccaataacgacattctcaagctgcagggcaaaacggctatcgggtctagacttttcgagggaggcaagagcgccgcggaacggcgcctgtttagaaccacacaccggcgcattaaaagacggcgctggagactcaagctgcttgaggagttctttgatccctatatggctgaggttgacccttacttctttgcccggctgaaggaatccgggctctctccgctggataaacgcaagaccgtgagctccatcgtgttccccacatctgccgaggacaaaaagttttatgatgactaccctaccatctatcatctgagatacaaactcatgacagaggatgaaaagttcgacctgcgggaggtctatcttgctattcaccatatcattaagtaccgcggaaattttctgtacaacaccagcgtgaaagatttcaaggcctccaaaatcgacgttaagagctctattgaaaaactcaatgagctgtatgagaaccttggcctggacctcaatgtggaatttaacatctccaatacggctgagattgaaaaggtcctgaaagataagcaaatcttcaagagagacaaagtgaagaaaatcgccgagctgtttgcgattaagaccgataacaaagaacagagcaagcggatcaaggacatttctaaacaggttgccaatgctgtgctcggctacaagacacgcttcgataccatcgccctgaaagagatttccaaggacgagcttagcgattggaacttcaaactgtctgacatcgatgctgactccaagtttgaagccctcatggggaatctggatgagaacgaacaggcgatccttctgacaattaaggaactcttcaatgaagtcaccctgaacggaatcgtggaggacggcaacacgctgagcgagtccatgattaataaatataacgaccacagagatgacctcaagctgcttaaagaagtgatcgagaatcatattgatcggaagaaagccaaggaactggctctcgcctacgacctgtatgtcaacaatagacacgggcaacttctgcaggctaagaaaaagctcggaaaaatcaagccccgctctaaagaggatttttacaaggttgtgaacaaaaatctggacgatagccgggcctccaaggaaatcaagaaaaagattgagctggacagcttcatgcctaaacagagaacaaacgccaatggcgtgatcccctatcagctccaacagctggagcttgataagattatcgaaaaccagtctaaatactacccttttctgaaggagattaatccggtctccagccacctcaaggaagctccctataaactggacgagctgatccgcttccgggtgccttactatgttgggccccttatttctcctaacgagagcaccaaggatatccagaccaaaaagaatcaaaactttgcgtggatgatcagaaaagaagagggacgcattacaccctggaatttcgaccagaaggtggatcggatcgaatccgccaacaagtttattaaaagaatgaccacaaaggacacgtacctcttcggcgaggacgtcctgccggctaactctctgctctatcagaaatttaccgtgctgaatgaacttaacaatatccgcattaacggcaagcggatcagcgttgatctgaaacaagagatctacgagaatctcttcaagaagcatacaaccgtgacagtcaaaaagctggaaaactatctgaaagagaatcacaaccttgtgaaggtcgaaattaaagggctcgccgacgagaagaaatttaattccggactgaccacgtacaacagattcaagaatctgaacatcttcgataatcagattgacgatctcaagtaccgcaacgactttgagaaaatcattgagtggagcacaatcttcgaggataagtctatctataaagaaaagctgcggtccattgactggcttaatgagaaacagatcaacgccctgagcaacattagactccagggctgggggcggctgtctaagaagctgcttgctcaactccatgatcacaatggacagaccatcattgaacagctgtgggactcccagaacaattttatgcaaatcgtgacccaggccgatttcaaagacgcgatcgctaaggccaaccagaatctgctcgttgccacaagcgtggaggatattctgaacaatgcttacacctcccctgccaacaaaaaggctatccgccaggtcattaaagtggttgacgacatcgtgaaggccgcgtctggcaaggtccccaaacaaattgccatcgaatttacaagagatgctgacgagaatcctaagcggagccagacgagagggtccaaacttcagaaggtgtataaagatctgtctaccgagctcgccagcaagacaattgctgaggaactgaacgaagccatcaaggacaaaaagctggtgcaggataaatactatctttacttcatgcaactcggacgcgacgcgtataccggcgagcccatcaatattgatgagatccagaagtacgacattgatcacatcctgccccagtcctttattaaagacgatgccctggacaaccgggttctcgtcagcagagctgtgaataacggcaagtctgacaatgtgcctgtcaagctgttcgggaacgaaatggccgctaaccttggaatgacaatccgcaaaatgtgggaggaatggaagaatatcggcctgatttccaaaaccaagtacaacaatctcctgacggatccggaccatatcaacaaatataagagcgccgggtttattagacggcaactggtggagacctctcagatcattaaacttgtttccacaatcctgcagagccgctaccccaataccgaaatcattacagtgaaggccaagtataaccactacctcagagagaaattcgatctgtataagtctcgggaggtcaatgactaccatcacgctatcgatgcgtatctcagcgccatttgtggaaacctgctttaccagaattaccctaacctgcgcccctttttcgtgtatggccaatacaaaaagttttccagcgaccctgataaagaaaaggctatcttcaataagaccagaaaattctcttttatttcccagctcctgaagaacaaaagcgaaaattccaaggaaatcgccaaaaagctgaagcgggcctatcagttcaaatacatgcttgtttctcgcgagacggaaacaagagaccaggagatgtttaagatgaccgtgtatccccggttcagccatgatacagtcaaagctccgcgcaacctgattcctaagaaaatggggatgtcccccgacatctacggcggatataccaataactctgatgcctacatggtgatcgttagaattgacaagaagaaaggcaccgagtacaagatcctcgggattcctacacgggaactggtgaatctcaaaaaggcggagaaagaagatcactataagagctacctgaaagagatccttacgccccgcattctgtataacaagaacggaaagagagacaaaaagatcacctcctttgaaatcgtcaaatctaagattccttacaaacaagtgatccaggacggcgataagaagttcatgctcgggagctccacatatgtgtacaatgctaaacagctgaccctgagcacagagtctatgaaggccattaccaacaattttgacaaagattccgacgagaacgatgcccttatcaaggcttatgacgaaattctggataaagtcgacaagtacctccccctgttcgatatcaataagtttcgggagaaactccacagcggaagagaaaagttcatcaaactgtctcttgaggacaagaaagatacgattctgaaggttctggagggcctccatgacaacgccgtgatgacaaagatcccgaccattgggctgtccacccctcttggctttatgcagttccccaatggagtgatcctgagcgaaaacgcgaaactcatttaccaatctcccacaggcctgttcaagaaatccgtcaagatcagcgatctctga

SEQ ID NO: 4341 - RNA, 4131 nt, synthetic construct
  misc_feature 1..4131: note = Cas9 variant
  source 1..4131: mol_type = other RNA
atgagcaacttcgacaatcacaaggattccatctgcaaacataagggcctgaaaaaggggaactactatattggactcgacatcggcaccaattctgtggggtgggccgctacaaacgagcagtacgaactgcttaaatttaagagccacaagatgtggggatccagactgttcgccgaggcgcaaacggctgtcgatacccggatgaaacgctctgccagacggcgcctccagagacggaagtttcgcctgattcttctggaaagcctcttctccaaagagatcaatgccgttgacgaaacatttttcatgagactgcatgagtctaactatcacgtggaggataagaccaatctggtgaaatacacactctttattgacaagaactataccgatgtcgactactataaggagttccccacaatctaccatctgcggcaccaccttatgaccgagggcacgaaagatatccgcctgctctttctggctattcatcacatccttaagtacagagggaatttcctgtatgggaaaaaggaatttagcgtggacggcgagatgtactccgttctccggagcaccctggaggaactgggcttcgggtcttatgtggaggatgaaaacgtcctccagtccattgccaatctggtgcttgaccgcggaatcgctagaagcgagaaagttaagcagattgaacctctgatcgcccaaggcaaaaagctctcttccgtggagaagaaccggctgaaagcgtgggcctaccttattatggggctgaaggctaatctcgtcaacctgtttacagatgaggacgtggaagtggtcctgccggaggaaaaagagttcaagagcatcaatctccatgaaggaatctatgaggacgttcgcgatgcctacgaggacgcttggggcgatagattcgccattgtggaccagtgtaaagtgctgcacgatatcattgtcatctcttccattatcaagcccgggcagagcctttccgaagcgaagatcgagtcttataaccagcacaaagaagacctggtgctccttaagagcgttcttaaagaggataagaaactgtacgacgatatgtttgtggtcgacattgataagggaaccaactacgtgaagtatatcaaacaaggcgttaatggcaacacatccaccacgcaggaagccttctacaagtatgtgcggaaagtcgtgagcgtcctccctgagacagagaataccagatgcattgtgcagaagctggaagaggggacatttctgcccctccagcgcatctctaaaaacggagttgtgccttaccaactgcataaggaggaacttgtccggattctggagaaggctaaactcaatttcccctttctgaacgaagtggaggacggcctgaccgttgccgacaagatcatctccattcttgagttcaaaatcccttattacgtggggccgctcaatcccacccacagcattgaaaacggaggctttgcttgggtcgtgagaaaggaagccggacaggtgctgccttggaatttcgagcagaaagttgatgtccaagcctctgctgtgaagtttatcgagaacctgacaaataaatgtacgtatctcattgaccaggatgtgctgcccaagtacagccttctgtacgcggagttctccctcctgaacgaactgaataacatccgcgtcaatgacaagcctcttcccgccgatgtgaaacaggcttttattcgggaccatttcatctctctccaggatagcaagaccgccaccaaaaaggttgtggccaaatatctggtcgacaacaactacgtgtcccaaccgcctatcattacaggaatggatcagcagatcgctacaaagctgaccagccacagagacatgacgcgcattctcggcgaacattttgattatgccatggcggaggacatcattcggtacatcacaatcttcggcgaatctaaggatatgctgagacaggttcttaaaaattattacggggaccgcctgaccaccgagcaaattaagaaactcggaaagctgacatataccggctgggggcggctgtccaaaaagttccttagcgacatctggggaatgaagaaaaacgatgacgatgctgaggccggcacaattatcgaacacatgagagaggggcaggaaaatctcatgcagctgctgtcttccagctactcctttattgacgtggtccaggagtacgtgacgaacgttctcggcgccaaggagaaaaccgctttcgaaatgctggaggatctttctctgagccccatggtgaagcgctccgtctggcaaacactccggatcctggacgaaatcgtgtctattagaaaagagctgcctaagaagatctttgtggaagtcgcccggaccaataaagctgataagaaacgcacacagagcagaaaggcccttctcgaggagctgtatgaacagattaaagacgaggatgttcacgtgctgcagcaagaactcgagtccaaggaagacagcgcgctgaactctaaaaagctgtacctgtatttcacccagatgggacggtgcatgtactccggcagacgcatcgatattcatgagctctttacggacacctatgatatcgaccacatctacccccggagcctgacaaaggacgattcttggcataatattgtgctggtcgagaaacagcttaacgccgaaaagaccgacagattccccatcctgtccgctattcaaagcaaacagaaggggttttggaaactcctgtgggatcgcggattcatctctgagaagaagtatgacagactcgtgcggacaaccgatctgacggacgaggaacttaatcagtttattaaccgccagatcgttagcacaaatcaatccgtgaaagccgtcaccacactgctccaccagctgtaccctgaaaccgaggtggttttcagcaaggctgagaacatttctgattttagacgggactacggcttcgtgaaagtccgctccatcaatcaccatcaccatgccaaggatgcgtatctgaacatcgtggttgggaatgtgtaccacgaaaaatttaccaagaacttccttagcttcgccaagcagaaaggaacacatagaacgtataacctgaccaagatgtttgagtacgaaattaaactcacagaggaatccaagaaagtcatctgggacccgaatattcacatggatatcgtgaagaagatgatgaaatctaacgacgtgcgggtcacccagcgcgctgttccccaaaagggcgggctgagcgacgagacaatttataaaaagggcatcgccaaaagaggagtgtacctccctctgaagtcctctgatgagcgggtgcgcgacgtcgaaaagtatggcgggagaaccagcatcacgatttccgagtacatcattcttaatatccgggatacatctgaccaggatagaattgaaatcttcagcctgcccctctacatcgctggcaaaaaggacattcacaaagccatcgaggaggcctatctgtccacctgtaagaaacctgctagcgtggttgatattcagatcctgtaccgcggactttatattgggtctaaggtgaacatcaatggatttacctactatatgggcgggaaaacaggctccaacgtcagcgtggactctgcggttgatgtggtcatggacattacctccagcgtgtacatcaagctgctcgaaaaggtcgccatcaaaaagattgaaaattctaaaacattccggatcgaaaacattaagacgtcctataatcataaagaggtgaccgttagcaaggaacagaacatcgctctgtaccaagagctcctgaagaaacttgatacacccctgttttccaagatgaaaggaaataagctggaggagttcagaaccgtgggctttgacacattcattgccctcagcctggaagatcaggcctctgtccttctggaagtgctcaacgttctgaccaattttaaaacgaagcgcgacatcaccaagatcgggatgacaagctcccggtctaccctcggaattaacatcagcaatacagagcagttctccgtgattaccacatctatcaccggcctgtacgaacaagagattaaaatcaagtga

SEQ ID NO: 4342 - RNA, 4131 nt, synthetic construct
  misc_feature 1..4131: note = Cas9 variant
  source 1..4131: mol_type = other RNA
atgaccacaaagaacagagagaaaaataacaagttccacaaagccagccccctgtacacgctcggcctggacatcgggaccacatccgtgggatttaccgctattgatgaagcccagcggcctatgcgcgcgaagggcaaaacagtcatcggggttagacttttccaagagggacagtctgctgtgggccggaagaattttcgcaccacaagacggcgcctgaagagacggcgcagacggctcaacctgcttaaacagttctttagcgccccgctgcgcaagattgaccccaccttctttaaaagactcaaggcctcctctctgagccctgctgataaacggcgctatctggcccccgggctgttccctaatggaggcgacatcaagttttaccagaagtatcccacgatttaccatctgagacttgctctgatgaccgaaaaacggcctttcgatctcagagaggtgtatctggccatccaccatatcgtcaagtaccgcggcaactttcttaatccgctgcccgtgtccgcgttccgggggagaaaccaacgctttgaagaccagttctctgagctcaatcagctgtataaaagcctggagggagaatcccctttccagtttgatgagaagattttcagcgaactcgacaaacaactgcttgttaacgatggccggaagatcgacagacagaaacagctggccaagcgcgtgtttattaagacaaatgagaaacggatcgattctcaccatcagaagattgcttccgccttcagcaaagctgtctttgggtacaagttcagacccgacgtgctcctgaactctgatcctaatgagtccatcgacgaatttattaaattcggagacgaggattttgacgataaacttgttatcctgcgcgaaagcctcaacgccacccaaaaggagatcctggcggtgacacagcggatttactctcagatcattctgaatgaaatcgtcccctccagagagaccctcagcgaggccatggtgtcccgctatcaaaaacaccactctgacctgcagcttctgacggaggcttgcaagaaaatgacaaaggccaaagctgcccggattcaggccgcttacaccgattatatcggcaagggggacggacataagctcgtgcacgatcagttcgtcgcgctgatcaaaaagaaccttgacccgagcgaagaaggcagagatctggccgagcggctcgctcaagacgattttatgcctctgcagcgcacacccctgaacagagttattcctcatcagctccagcaagaggaactggaccggatcattgagaatcagggcgaatactatcccttccttaaaaccctgaaccccaatagatcccgcgccggggtggccaactaccagctcgacgagctggtgagctttcggatcccttattacgtcggaccgctgattaccgctacagatcagcttcacacgtctggcgccaagttcgcgtggatgaccagacgcgctgccggggaaatcacaccctggaatttcgaccaaaaagtggatagactcgcctccgctaaccagtttatccggcagaatatgcctaaggacaaccatctgctggaggccgatgttctccccgctaatagcctgacctaccagcgctatcttgtgctggacgaactcaacgccgtcaaggtgaatcacaaatctctgacagttagccaaaagcagagaattttcaacgatctgtttaaacggcagcgcaccgtgacggtccttaatctccaaaactacctgaagtccatcgagaaactgcctacactccccgtgattaccggagtctctgacagcgagagattcaagaccacactgtccacctatcttgattttaaaaatatcttcggcgggaaggtggacgatagctctcagaaggaaaaatttgagaagattatcctgtacgcgacaattttcgaagaccacgccgtttataaagctaagctcgatcagatcgactggctgggacagcaacagaaaacggacctgctttccaagaactaccagggctggggccagctcagcgagaagctgctgctcgggctgaaaaaccaagccggacagtctatccttgatgagctgtggcagaccaataagcggtttcgcgaaattatgaacgaggctcatttcgccaaacagatcatggcgtccaatgccgctctcctgagaaagaaaggcctggacgatgtgcttagcacagcctttctctccccgcaaaacaagaaggctattcggcagaccgtcgaagtggttgacgatatcgtgaaagccattgggtgtcctccccagaagatctctctgcacttcagcaaagcccctgctgacgcgatccgccatgagagagataatgccaacattatcctgcggacatatagaaatctccccgctaagatggtcgacgatcaactgaaagccgaacttcaggccaccgctgagaagcaccaggtgctgtccgacaagctctacctgtactttacgcagctgggacgcgatctttataccggcgagatgctgaaaatgtctgaactcgagaacgacatgattgatcacatcatgcctcaaacattcgcctacgacgacagcgtgaataaccgggttctggtctcccagaatcatagctctcagctcgggaagacctccggcgaaaagagcgatgcgaagatgattagattctggcaagtgctgcgcgacaacaaacttatctctgagcagaagtatcagaatctgacactcgattccgaccacctgagcaaatctacccgggaacagctgcttaacagatacctggtggagaagaatcccatcacgcagtgggtcgctagcgtgctcacagagaagtatggagataacggcacccgcgttctgacaattaacccgcggatggtgtaccaaatgagacgccagtttaatctcgtcaacctgcctgaagtgaatgactatgatcatgggcttgacgcctacctggccgctttcatcggaaactacgttgatcggagatatccccggctccgctcctactttgtgtatggcgacttctctagctccaaagagattgtctttagactgaatcggttcaactttctgttcgatcttgggcaggccgaacccaatgagctgaccgactgggaaaccggagagatgatctgggacaaggcggctgccaacagcgtgctccgcgatgtttaccagtataaatttatgctgatttcccaagccgtgtactctagacagggcgctatgttcaatcagacaatctatcctgccagccaagctgccgggcggcagctcatcccggtcaagaaaaacagagcgacgaagctgtacggcggatactccggcaatgtggacgcctatcttgctattgtgcgcctcgggggacccaagtctgatcagtaccgggtcgttggcatccctaccagaatggtggggcgcctgcagagcgccatgaaacaaggagctgacacatatgccaacaccctccacaagattctgcagccccagtttacaaaacggaagaaaaatagacagaccggctactatgaggaaacgacagagcctttcgccgtgatccttgataaggtctactatcgccaactgattatcgacgggcagcagaagttcatgctcggctcctctacctaccagtttaacgctaaacaactggtgctcagctcccgggcgagacagattctgagcggagaggaacgccttaccgatgagaatggctctcaggacctgatcgatgtttacgacgaaatcctgacaaagattgatagatatttcgagctctacgaccaacggcactttcgccagtccctgcatgatgggagaaaacagttcatcagccttcccattcacaacgtgtatcgggccaaccgcctgatcgaacatggaaagtacgagaccctctctcagattctgaatggcctccacgctaacacaatgatgacgaatctgagatatcttgggatctccagcccttttggaaaattccaatctcccaacggcatcaagctgtccaaggacgccgtcctggtgtaccagagcccgtccgggctctttgaacggagagttcgcctgcgggacctttga

SEQ ID NO: 4343 - RNA, 4131 nt, synthetic construct
  misc_feature 1..4131: note = Cas9 variant
  source 1..4131: mol_type = other RNA
atgaacaataagccctacagcatcggcctggacattgggaccaactccgtgggatgggccgtcatcacagatgactataaagttccttctaagaaaatgaaggtgctcggcaatacggataaacacttcattaagaagaacctgcttggggctctgctctttgacgagggaaccacagccgaagatagacggctgaaacgcaccgcgagacggcgctacacaagacggaagaatcgccttagatatctgcaggagatcttcaccgaagagatgagcaaagtggacatttcctttttccatcggctcgatgactcttttctggtcccggaagataagcgcggcagcaaataccccatcttcgctacactggaggaggaaaaggagtatcacaagaactttcctaccatctaccatctcagaaaacacctggccgactccaaggaaaaagccgatttccggcttatttatctggctctcgcccatatcattaagtaccgcgggcactttctgtacgaggagtctttcgacatcaaaaataacgatattcaaaagatctttaatgagttcattagcatctatgacaacacgtttgaaggatccagccttaatggccagaacgctcaggtggaagccatcttcaccgacaaaatttctaagtccgcgaagagagagcgggttctgaaactcttccccgatgaaaagagcacaggcctgttttctgagttcctgaaactcatcgtggggaatcaggccgactttaagaaacacttcgatctggaggaaaaggctcctcttcaattttccaaggacacctacgatgaggacctggaaaacctcctggtccagattggagatgacttcgccgatctttttctggtggctaaaaagctctatgacgccatcctgctgagcggcattctcacagttaccgatccctctacgaaagcgcctctgtccgccagcatgatcgaccgctacgagaatcatcagaaggaccttgctgccctgaaacagttcatcaagacaaacctcccggaaaagtatgatgaggtgttttccgaccaatctaaagatgggtacgctggatatattgacggcaagaccacacaggaggccttctacaaatacatcaagaacctgcttagcaaactggaaggggccgattattttctcgacaagattgagagagaagatttcctgcggaagcagagaacctttgacaatggatccatcccccaccagattcatctgcaagagatgaacgctatcatccgccggcagggcgaacactaccctttcctccaggagaataaagagaagattgagaaaatcctgaccttccgcattccctattacgtcggccctcttgcgagagggaaccgggattttgcctggctgacaagaaatagcgaccaagctatccgcccctggaacttcgaagaaattgtggataaggcccggtctgccgaggactttatcaataaaatgacgaactatgatctctacctgccggaggaaaaggtgctgcctaaacactcccttctctatgagaccttcgctgtctacaatgaactgacaaaggttaagtttattgccgagggactgagagactaccagttcctcgacagcggccagaaacagcaaatcgtgacccagctgtttaaggaaaaacgcaaggtgacagagaaagatatcattcagtatcttcataacgtcgactcttacgatgggatcgagctgaagggaattgaaaagcagttcaatgcgagcctctccacctatcacgacctgctgaaaatcattaaggataaagagtttatggacgattctaagaacgaagctatccttgagaatatcgtgcatacgctcacaattttcgaagaccgggagatgatcaaacaaagactggcccactacgccagcatttttgatgagaaggttatcaaggctctgacccgccggcattataccggctgggggaaactctccgccaagctgattaacggaatctacgacaaacagagcaagaaaacaatccttgattatctgattgacgatggcgaaatcaatagaaacttcatgcagctcattaacgacgacggcctgtcttttaaggagatcattcagaaggctcaagtggtcgggaaaaccaatgatgtgaagcaggttgtgcaggaactgcccggatcccctgccatcaaaaagggcatccttcagagcattaaactcgtcgacgagctggtgaaggtcatggggcacgcgcccgaatctatcgtgattgagatggcccgggagaaccaaacaacggctcgcggaaagaaaaattcccagcagagatacaagcggatcgaagatgccctgaaaaacctcgctcacggcctggacagcaatattcttaaggagcatcccaccgataacatccaactgcagaatgacagactcttcctgtactatctgcagaacgggaaagatatgtacacaggcaagtcccttgacattaatcagctctctagctgcgatatcgaccacatcattcctcaagccttcatcaaagatgactccctggacaaccgcgttctgacctctagcaaggataatcggggaaagtccgacaacgtgccgagcctcgaaattgtccagaaaagaaaggcgttttggcagcagctgcttgattctaaactgatctccgagcgcaagttcaataacctcacaaaagccgagagaggcgggctggacgaacgggataaggtgggatttattaagcgccaactggttgagaccagacagatcacgaaacatgtggctcagatccttgacgcccggttcaataccgaagtcacagagaaggataaaaaggaccgcagcgtgaaaattatcaccctgaagtctaacctcgtgtccaactttagaaaggagttccggctgtataaagttcgcgaaattaatgattaccaccacgctcatgacccctatctcaacgccgtcgtggccaaggctatcctgaaaaagtaccctaaacttgagcccgaatttgtgtatggcgattaccagaagtacgacctgaagagatatattagccggacaaaagatcctaaggaggtcgaaaaagcgaccgagaagtacttcttttattctaatctcctgaacttctttaaagaagaggtgcactacgccgacgggacgatcgttaagcgcgagaatatcgaatatagcaaagacacaggagagattgcttggaacaaggaaaaggatttcgccaccatcaaaaaggtgctgtcccttccccaagtcaatattgtgaaaaagacagaggaacagaccgttggccagaacgggggcctgttcgacaataacatcgtgagcaaaaagaaggtcgtggatgcctctaaactcaccccgattaagtccggactgagccctgagaaatacggcgggtatgctagacccacaatcgcctactccgttctcgtgattgcggacatcgagaagggaaaagctaagaagctgaaacggatcaaggaaatggtcggcattacggtgcaagataaaaagaaatttgaggccaatcctatcgcctaccttgaagagtgtgggtataagaacattaatcccaacctgatcattaagctccctaaatactctctgttcgagtttaataacggacagagacgcctgcttgctagctccatcgaactgcagaagggcaacgagctcatcgtgccctatcatttcaccgccctgctctaccacgcgcagcggattaataaaatctctgaaccgattcataagcaatatgtcgagacacaccagagcgaatttaaagagctgcttaccgctatcatttccctgtctaagaaatacatccagaagcctaacgttgagagcctgctccagcaagccttcgaccagtccgataaggacatctatcagctgagcgaatcttttatttcccttctgaaactcatcagcttcggggcccccggcacatttaagttcctgggagtggagatttctcagtccaatgtgagataccaaagcgtctcttcctgctttaacgctaccctcatccaccagagcattacgggcctgtacgaaacacgcatcgatctttccaaactgggggaggactga

SEQ ID NO: 4344 - RNA, 4131 nt, synthetic construct
  misc_feature 1..4131: note = Cas9 variant
  source 1..4131: mol_type = other RNA
atggacaagaaatacggcatcgggctggatattggaaccagctccatcggctggacagtggtcgacaagtatgggcacattatcagagttaaaggacagacgggcattggggtgcgcctcttccgggagggacaaaccgccgctgaaagacggacatttcgcaccacaagacggcgcctgtctagacggcgctggagacttcggctgctccgcgagatcttcgatgaacccatcagcgccattgacgagaactttttcgcgagacagaaggcttcctctctggcccctggcgatgcccggtaccagcaggcttttcaacttttcaatgaccgcaccgatcaggccttttattgcaaatacccgacaatctatcatctgagacaggctctcatgaccgaaagccggcagttcgacattagagagatctacctggccctgcaccaaattatcaagtatcgcggccattttctccttgggggagcggccaaggatttccagtccgacaaacttgatctggaggcttactttacgaccattaacgcccagctcgctggcatctactctgacgggagcgtgcagctgcccacacttgattggaatcaagcctgtcaggaactgaccgacacatcccggacccagagcgacagaaagaactggctcgtcaaagagctgaagtcttatggagattcccaactgaaacctatctacacgcagattgcgaatgccatcctcggcttcaagacagacctggctaagattatggggatcaacgatcccgaaaaagcccttagctttaatctggacgctctcgatgaccaccgcgatgacgtggccgagctgcttaccgatgagcagattcctctggttaacctcctggccaagctgcatacagctctcgaactggcggccatccttcccgacggacagaccctgtctggcaaaatggtggagatctatgaaacccaccggaagcaactcaaaacatacaaggctttcattagacagctgcctgatcgccagcagcggcttgccctgaaacaagcctatgaccactacatcgaccagggcctcaatagagaggctttctattccgaagtcaaggccattctggagaagcagaaaccgctgacggcgaccgggcaggctatgaagaaagccatggatcaaaacgcctttctcctgaagcagcgcacaaaaaccaatatcgctattccctaccaggtgcagcaacaggagatggaccagatcatcgccaaccaaagcaagtactatccttggcttgctacacccaatcctgttaagtctcggagagtgattgccccctacaaactggatgaactcgtctgcttccgcgtgaactattacgtgggaccgctggtccagtccaagcctggcgaggcgaccaaagaagccaagtttgcttggatgacgcggaaagacccccagagcacagttgccatcaccccttggaatttcgatcagcaagtggacagacaggcttccgccaacgcgtttattcagcggatgaagaccacagatacctatctgcttggggaggacgtgatccccaagaactctctcctgtaccagaaatatgaagtcctgaatgagctcaacaatgtgcgcgttaacggagattggctggacccccaaagaaagcagtaccttttcaaaaagctgtttatggatcagcctcagagcgtggtcacagtgaaagccctccaaaagacgctggttgtgattggcgcttgtccgaccctgcccacagtcgaggggcttgccaatcctaagcggttcctctcccagctgaccacataccatgacttttgcaaactgctccccgatgacatccagagagctgaccgccaagccgatattgaaaagatcatcaactggagcaccattttcgaggacacggccatctttaaagaaaagctgcgggatattaaatggctttctgctgaccagatcagacgcctgtccagcagacctcggtatcgcggatggggcagattctctgcgaagctcctgtgtggcctgcacgatcggcaggggaataccgtgatggacgagctttggcagacaagccgcaactttatgcaaattatcagacagtccgatttccagaccgccatcgctgccgtcaatcagcaagacctcggacggcaggatctgcagcgcgtgattgacgatctgtacacatctccccagaacaaaaaggccatcagacaagttctcgctgtggtcaccgacattcagaaggccatgcatggcaaagcgccgagctggctgttcgtggaagttgctaagggggcccagaaaaatcctcagcggacgcaatcccgccagagcaagctggccgaggcttatagagagtctgcccgggaactggtggatgaggcggtcaaagaacagctcctgacactgcccgacgacagacaaaccttttccgatcgccttgtgctctacttccagcagaacggacgggacatctatacaggcgagcctctggattttgagagactgagcaattaccacattgaccacatcatcccccaggctgtggttaaggatgactctctcgataaccgcgtcctgacctccaatcaagccaaccttgaaaagggggcccatgtgcctaccattttccgggacaaacaggagcccgtgtggcaggaactgtatagagtcggcctcatcagccaccgcaagctgcggaacctgcttacaacgccggatgacctggatgacagaggacgcgctaccggctttattgcccggcagctcgtggagacaagacaagttatcaaactggtgatggaagtcctctcccagtactacgacaccacagagaccgagctgatttctatcaaggctgggcttagccatcagttccggcaggaactgaatctccctaaactgcgcgccctgaacgattatcaccatgcgcaagacgcctaccttgctgccagaatcggaacgtatctgctccagcggtaccccaatctgaagcgctttttcgtgtatggcgattttaagaaaacacacttcgacctccagagacggtttaacttcattgggggaatgatctccagagagaagcaaccctacaatctgattaaaaaccctgttacccaccaggtgatctgggatgaagagatggaaattggcgactgccagaagaaaaatccggagcagcccaagcatgatgctaccgtcaagatgatgaaccttacaaaaatcatgaatctgaagcacattctcgtgacccatgaggtttatgaaaaccacggggccctgtttaatcaaacaatctaccctgcctctcaggctcacaaaaagaaactgatcccccagaagacggagaaacctattgaactttacggcggacatagctccgagcaggcgggctatatggccatcattcgcctgctcgggaagcggcccggatacaaggtgatgagagtccctgtgcgctatgtgagccaactgcagcaccaggacgtcgctgaacagaaaaagctcctgtacaaaatcttcgtttctgagcttacctcccggaacaaggtgaaacccttcgaggtggtcgtgccgcatgtttgtctgaatcaacctgtggaagatatgattaagggccagtggcacagatttgccctgcgcacaaacgggtattaccagaatcagcaacagctcatcctgagccttgtcgcccagcggaccctggctggatataagcccaaagacgatgagctcatggccgtgtaccatgaaatctgcaagcaagttaaatactatttccctctgtacaagatgaacaaatttcagtctagactcttcgcggctgaggagctgcttcagaagcgctccacagtgaacagcttttctattaccatcggcaagaatgggaaagaaaacaagacgctgaatctgggcaaaagagagctcctgcttcggctgctcggaggcctgcacgccaacgccacccgcgtcgacctcaaggatattgggtgtacaggacagttcggccaacttcaggtgaaaaatgggatcaagctgaccgaacaggctgttctgattcacgagagccccacaggactgtttcatagacgggtgcgcctcaacgacctgtga

SEQ ID NO: 4345 - RNA, 4134 nt, synthetic construct
  misc_feature 1..4134: note = Cas9 variant
  source 1..4134: mol_type = other RNA
atgaccaagaaaaactacagcatcggcctggacattgggacaaattccgtgggatgggccgtcatcacggatgactataaggttcccgctaaaaagatgaaagtgctcggcaacaccgataagaagtacattaaaaagaatctgcttggggcccttctcttcgactctggagagacagcggaagctaccagactgaaacggacagcccgcagacggtatacccgcagaaagaaccggcttcgctacctgcaggagatctttgccgaagagatgacaaaagtggatgagagcttcttttatagactcgacgagtccttcctgaccacggatgagaaggactttgaacggcaccctattttcggcaataaggctgatgagatcaaataccatcaagaatttccgaccatctatcatctgcgcaagcacctcgccgactctagcgagaaagctgatctgagacttgtctacctggccctcgcgcacatgattaagttccgggggcattttctgatcgagggagaacttaacgccgagaatacagacgtgcagaaaattttcgctgattttgttggcgtgtacgaccgcaccttcgacgattcccacctgtctgaaatcacagtcgacgccgctagcattctcaccgagaagatctccaaaagcagacggctggaaaacctgattaagtattaccccacggagaagaaaaatacactctttggcaacctgatcgcccttgcgctggggctccagcctaatttcaagatgaacttcaaactgtctgaggatgccaagctgcagttttccaaagacagctataatgaagatctggaggaactcctgggaaagatcggcgacgattacgctgacctgttcacctctgccaagaacctctatgatgctattctgctttccgggatcctgacagtggacgataatagcaccaaagcgcccctctctgcctccatgattaagcgctacgctgagcaccatgaagacctggagaaacttaaggagtttatcaaagcgaacaagagcgaactgtatcacgacattttcaaggatgagaccaaaaacggatacgccggctacatcgaaaatggggttaagcaagacgagttttataaatacctcaagaacacactgtccaaaatcgctggatctgattatttcctggacaagattgaaagagaggattttctccggaagcagagaacgttcgacaatggcagcatccctcatcagattcatctgcaggagatgcacgccatccttcgccggcaaggcgattactatccctttctgaaagaaaaccaggacagaattgagaagatcctcaccttccgcatcccttactatgtggggccgctggcccggaaagattccagatttagctgggctgaataccactctgacgagaagattacaccctggaatttcgataaagtcatcgacaaggagaaatccgccgaaaagtttattacccgcatgacactgaacgatctttacctccctgaggaaaaggtgctgcccaaacacagccatgtgtatgagacctacgcggtctataatgaactgacgaagatcaaatacgttaacgagcagggaaaggactctttcttcgacagcaatatgaaacaggagatttttgatcacgtgttcaaggaaaaccggaaggtgacaaaagagaagctcctgaattatcttaacaaagaatttcctgagtacagaatcaaggacctgattggcctcgataaagaaaataagtccttcaacgcttctctggggacctatcatgacctgaagaaaatccttgataaggcctttctcgacgataaagtcaatgaggaggtgatcgaagacattatcaagaccctgacactgttcgaggataaagacatgattcacgaacgcctccaaaagtacagcgatatctttaccgccgaccagctgaagaaacttgagcggagacactacacaggatggggccgcctgtcctataagctcattaacgggatccggaacaaagaaaataacaagacgatcctggattacctgattgacgacggaagcgctaatagaaacttcatgcagcttatcaatgatgacaccctcccctttaaacaaattatccagaagtctcaggttgtgggcgatgtcgacgatattgaggccgtggttcatgacctgccgggctcccctgctatcaaaaaggggatcctgcagagcgtgaagattgtcgatgagctcgtgaaagtcatgggagacaaccccgataatatcgtgattgaaatggcccgggagaaccaaacaaccaatcgcggcagatctcagtcccagcagcggctgaagaaacttcaaaacagcctgaaggaactcgggtccaatatcctgaacgaggagaaaccttcttatattgaagacaaggttgagaatagccatctgcagaacgatcagcttttcctctactatatccagaatggaaaggacatgtacacaggcgacgaactggatatcgaccacctgtccgattatgacattgatcacatcattccccaagcgtttatcaaagacgattctattgacaacagagtgctcaccagctccgccaagaaccgcgggaaaagcgatgacgtcccctctctggatatcgtgcgggctagaaaggccgagtgggttcgcctttacaaatccggcctgattagcaagagaaagttcgacaatctcacgaaagctgaacggggaggcctgaccgaggccgataaggcggggtttatcaaacgccagctggtggagacaagacagatcaccaagcacgtcgcccagattcttgacgctcggttcaacacagaatctgacgagaatgataaagtgatccgcgacgtgaaggttattaccctgaagtccaacctcgtcagccaattcagaaaagattttgagttctacaaggtgcgggaaatcaatgactatcatcacgcccatgatgcttacctgaacgccgtggtcggaacggccctcctgaaaaagtatcctaaacttgcttctgaatttgtgtacggcgagtataagaagtacgacgttcacaaactgattgccaagagctccgatgaccatagcgagatggggaaagccacagctaagtatttcttttactctaatctcatgaacttctttaaacgcgtgatcagatactccaatggaaaggtcatcgtgcggccggttgtggaatatagcaaagataccgaggacattgcctgggataagaagtccaacttccgcacaatctgcaaagtcctgtcttacccccaggtgaatattgttaagaaagtggaaacccagaccggcgggtttagcaaggagtccatcctgcctaaaggcgactctgataaacttattcccagaaagacaaagaaggcctattgggacacgaaaaagtacggaggcttcgacagccctaccgtcgcttattccgtgtttgtggtcgccgatgttgaaaaagggaaggcgaagaaactgaagacagtgaaagagctcgtgggaatctctatcatggagcggagcttcttcgaagagaaccccgtcgaatttctggagaataagggctaccacaacattagagaggacaaactcatcaagctgccgaagtattcccttttcgaatttgaagggggaaaacgccggctgctcgctagcgcctctgaactgcaaaagggcaatgagatggtgattcctgggcacctggttaaacttctgtaccatgcccagagaatcaactccttcaacagcaccaagtacctcgattatgtgtctgctcacaaaaaggaatttgagaaagtcctgtcctgtgtggaggacttcgccaatctctacgttgatgtggaaaagaacctgagcaagattcgcgcggtcgctgactctatggataatttttccatcgaggaaattagcaactccttcatcaatcttctgacactgaccgccctcggcgcccccgctgactttaacttcctgggagagaaaatccctcggaagagatatacgagcacaaaagaatgccttaatgccaccctgattcatcagtctatcaccggcctctacgagacacgcattgatctgagcaagatcggggaggaatga

SEQ ID NO: 4346 - RNA, 4134 nt, synthetic construct
  misc_feature 1..4134: note = Cas9 variant
  source 1..4134: mol_type = other RNA
atgaagaaaccctacagcatcggcctggacattgggaccaactccgtgggatgggccgtcatcacagatgactataaggttccttctaaaaagatgaaagtgctcggcaatacggataagcacttcattaagaaaaacctgatcggggcccttctgtttgacgagggaaccacagccgaagatagacggctcaagcgcaccagcagacggcgctacacaagacggaaaaatcgcctgagatatcttcaggagattttctccgaagagatctctaagctggacagctcctttttccatcggctcgatgactcttttctggtgccggaagataaacgcggcagcaagtaccccatcttcgcgaccctggaggaggaaaaggagtatcacaaaaagtttcctacaatttaccatctcagaaaacacctggctgactccaaggagaaaaccgatcttcggctgatctatctcgccctggcccatatgattaagtaccgcgggcacttcctttacgaagagagctttgacatcaaaaacaatgatattcaaaagatcttcaacgaatttatttctatctatgacaatacgttcgagggatccagcctgtctggccagaacgctcaggtcgaagccatctttaccgacaagatttccaaaagcacaaagagagagcgggtgctcaaactgttctctgatgaaaagtccaccggcctgttcagcgagtttctcaaactgatcgttgggaatcaggctgacttcaagaagcactttgatcttgaggaaaaagctcccctgcaattctccaaggacacatacgatgaggacctcgaaaacctgcttggacagattggcgatgggtttgcggacctgttcctcgtggccaaaaagctgtatgatgctatcctgctctctgggattctgaccgtcacggaccctagcacaaaagctcccctttccgctagcatgatcgagcgctacgaaaatcatcaggaggatctggccgcgctcaagcagtttatcaagaacaatctgtctgagaaatatgccgaagtgttctccgaccaaagcaaggacggctacgctgggtttattgatggaaaaaccacacaggaggccttctataagtacatcaaaaaccttctgtctaagctcgaaggcgctgactactttctgaataagattgagagagaagatttcctgcggaaacagagaacctttgacaacggcagcatccctcaccagattcatctccaagagatgaacgccatcctgcgccggcagggggagcactatcttttcctgaaggaaaatagagagaaaatcgaaaagattctcgccttccgcatcccgtactatgttggacccctggctcggggcaacagagattttgcgtggctgacccgcaattccgaccaggccattcggccttggaacttcgaggaggtggtcgataaagcctctagcgccgaagactttatcaataagatgacaaactacgatctttatctccccgaggaaaaagtgctgcctaagcactccctgctctacgagacgttcgccgtgtataatgaactgaccaaggtcaaatttattgctgaggggcttagagactaccaattcctggatagcggacagaagaaacagatcgttaaccagctctttaaggacaaacgcaaggtgacagagaaggatattatccattacctgcacaatgtggacggctatgacgggatcgaactgaaaggaattgagaagcaattcaacgcctctctttccacctaccatgatctcctgaaaatcattaaggacaaagaatttatggataatcccaagaacggcgagatcctggaaaatattatccacacactcaccatcttcgaggaccgggagatgattaagcagagactggcgcagtatgatacgctttttgacgaaaaagtcatcaaggctctgacacgccggcattacaccggctgggggaaactcagcgccaagctgattaacggaatcagagataaacagaccggcaagacaattctggagtatcttatcgacgatggggactgcaatcggaacttcatgcaactcatcaacgatgacggactgtcttttaaggaaattatccagaaagcccaggtggttggcaagaccgatgacgtgaaacaggtcgtgcaagagattccggggtcccctgctatcaagaaaggcattctgcagagcatcaagatcgttgacgaactcgtgaaagtcatgggacacaatcccgagtccattgtgatcgagatggcccgcgaaaaccagacaacggctaagggcaagaaaaattctcagcaaagatacaagcggattgaggatgccctgaaaaaccttgcgcctgggctggacagcaatatcctcaaggaaaaccccaccgataatattcagctgcagaacgacagactgttcctttattacctccaaaatggaaaagatatgtacacaggcaaggccatcgacattaaccagctgtccaattatgatatcgaccacatcattccccaggctttcatcaaggatgactctctggataaccgcgtcctcaccagctccaaagacaatcggggaaagagcgacaacgtgccttctattgaggttgtgcagaaaagaaaggccttttggcaacagctgcttgattccaaactgatcagcgagcgcaagttcaataacctcacaaaggctaaaagaggaggcctggacgaacgggataaggtcgggtttattaaacgccagctggtggagaccagacagatcacgaagcatgttgcccaacttctggacacccggttcaacacagaagtgaatgaggaaaaccagaaaatccgcaccgtcaagattatcacactcaagtctaatctggtgtccaactttagaaaagagttcggcctctacaaggtgcgggagattaatgattatcaccatgcgcacgacgcctacctgaacgctgttgtcgccaaagctatccttaagaaatatccgaagctggaacccgagtttgtgtacggagattatcagaagtacgacctcaaacgctacattcttaagagcaaagcctctaataccatcgataaggccacggaaaaatatttcttttacagcaacctgctgaatttctttaaggagaaagtgagatatgctgacggcacaatcaagaagcgggaaaacattgagtactccaatgataccggggagatcgcgtggaacaaagaaaaggacttcgccacaattaaaaaggtcctgagcctccctcaggtgaatatcgttaaaaagaccgaggaacaaaccgtgggacagaacggcgggctgttcgataataacattgtctctaagaaaaaggtggttgacgcttccaaactcatccccattaagagctccctgtctcctgagaaatatggaggctacgcccgccccacaatcgcctatagcgtgcttgtcatcgctgacattgaaaaggggaagggcaaagccaagaaactgaagagaatcaaagagattgtgggaatcacgattcaggataagaagaaatttgagtccaacccggttacctacctcgaagagtgtggctacaagaatatcaactctaatctgatcattaaactgcctaagtatagccttttcgaatttaacgacgggcaacggagactgctcgcgtcctctatcgagctgcagaaaggaaatgagctcattctgccctaccaccttacagctctgctgtatcatgcccagcgcatcaacaagattagcgaacctatccacaaacagtacgtggaggcccatcaaaatgagttcaaggaactcctgaccacaatcatttcccttagcaagaaatatatccagaagcccaacgtcgaactgctcctgcagcaggcttttgatcaagccgacaaagatatttaccagctctctgagtccttcatcagcctgcttaagctgacctcttttggcgcgcctggggctttcaaatttctgggagtggagatttcccagagctctgtgcggtataagcccaattcccagttcctcgacacgacactgatccaccaaagcattaccggcctttacgaaaccagaatcgatctgtccaagctcggggaggactga

SEQ ID NO: 4347 - RNA, 4134 nt, synthetic construct
  misc_feature 1..4134: note = Cas9 variant
  source 1..4134: mol_type = other RNA
atgaacaataagccctacagcatcggcctggacattgggaccaactccgtgggatggtctgtcatcacagatgactataaagttcctagcaagaaaatgaaggtgctcggcaatacggataaaagattcattaagaagaacctgatcggggcccttctgtttgacgagggaaccacagctgaagcccggcgcctcaaaagaaccgcgcggcgcagatacacacggcgcaagaatagactgcggtatcttcaggagattttcgctgaagagatgtccaaagtggattctagctttttccaccgcctggacgattcctttctcatcccggaagacaagagaggctctaaataccccatcttcgccaccctggtcgaggagaaggaatatcataagcaatttcctacaatttaccatctgcggaaacagctcgccgatagcaaggagaaagctgacctgcgccttatctatctggtgctcgcccacatgattaagtacagagggcacttcctgtacgaagaggcttttgatatcaaaaacaatgacattcagaagatcttcaacgagtttatttccatctatgataataccttcgaaggaagctctctttccggccagaacgcccaagttgagacgatctttaccgacaaaattagcaagtctgcgaagcgggaacgcgtgctgaaactcttccccgacgagaagtccacaggcctgttcagcgaatttctgaaactcatcgtcgggaatcaggccgatttcaagaaacattttgacctggaggagaaggctcctcttcagttctctaaggatacctacgacgaagatctggagaacctcctggaacagattggagacgattttgccgaccttttcgtggctgccaaaaagctgtatgatgcgatcctcctgtccggcattctgacagttaccgaccccagcacgaaagcccctctctccgcttctatgatcgagagatacgaaaatcaccaaaaggatctggccgtgcttaaacagtttatcaagacaaacctgccggagaagtatgtcgaggtgttcagcgaccagtccaaagacgggtacgctggatatattgatggcaagaccacacaggaagccttttacaaatacatcaagaatctcctgagcaaattcgacggggccgattattttcttgacaagattgagcgggaagtgttcctgagaaagcaacgcacctttgataacggatctatcccccaccagattcatctccaggagatgaacaccatcctgcggagacaaggcgaacactaccctttcctgaaagagaataaggagaaaatcgaaaagattctcacattccgcatcccctatcatgtcggccctctggctcgggggaacagagactttgcgtggcttacgcgcaattccgatcaggccattcggccctggaacttcgaggaaatcgttgacaaagctagctctgccgaggattttattaataagatgaccaactacgacctgtatctcccggaggaaaaagtgctgcctaagcacagcctgctttacgagacattcgccgtgtataatgaactcaccaaggtcaaatttatcgctgagggaatgagagattaccagttcctggactccggccagaagaaaaagattatcaaccaactgtttaaaaagaagcgcaaagtgacagaagatgacatcattgactgcctccagaagatcgataattacgacgggattgagctgaaaggaatcgagaagcagttcaacgcctctcttagcacctatcacgatattctgaaaatcatccgggacaaggaatttatggatgaccccaagaatggcgatattctcgagaacgttatccatacgctgacaattttcgaagacagagagatgatcaaacagcgcctggcgcaatacaattccatttttgatgaaaaggtgatcaaagctcttagccggaagcactataccgggtggggaaaactctctgccaagctgatcgacggcattagagataagcagaccggcaaaacaatcctggactacctcatggatgacgggaagtccaaccggaatttcatgcagctgattaaagacgatgagcttagctttaccgagatcattcagaaggcccaagtcgtgggagacacagataacctgcgccaggttgtgcagaacctccctggctctcccgctatcaaaaaggggatcctgcagtccattaaaatcgtcgacgaactggtgaaggtcatgggacatgcccccgagagcattgtgatcgaaatggctagagagaatcaaacgaccgcccggggcaagaaaaactcccagcagagatataagcgcattgaagattctcttaaaaatctcgcgagcgggctggactccaacatcctgaaggagaatcctacagataacattcaactccagaatgaccggctgttcctttactatctgcagaacggcaaagatatgtacaccggagaggccctcaatatcaaccagctgtctagctacgacatcgatcacattatcccgcaggctttcattaaggacgactccctggataatagagttcttacaagctctaaggacaaccgcggcaaatccgataatgtgcccagcctcgaagtcgtggagaagatgaaagccttttggcaacagctgctggactctaagctcatctccgaaagaaaatataacaatctgaccaaggctgagcgggagcgcgggggacttaacgaactggataaggttggcttcattaaaagacagctcgtggagacgcggcaaatcaccaagcatgtcgcccagatcctggacgcgcgctttaacaaagaagtgacagagaagaataaaaagaacagaaatgtgaagattatcaccctgaaaagcaacatggtttctaatttccggaaggaatttgggctttacaaagtccgcgagattaacgattatcaccacgcccatgacgcttacctgaatgccgtggtggctaaggccatcctcaaaaagtatcctaagctggagcccgaatttgtctacggagattatcagaaatacgacctcaagagatacattagccggtccaaagatcctaaggaggtggaaaaagccacagagaagtatttcttctacagcaacctgcttaactttttcaaagaagaggttcactatgctgacggcaccatcgtgaagcgcgagaatatcgaatactctaaggatacgggggagattgcgtggaataaagaaaaggactttgccacaatcaaaaaggtcctgtccctcccccaggtgaacattgttaaaaagaccgaggaacaaacagtgggccagaatggaggcctgttcgacaacaatatcgtcagcaagaaaaaggtggttgatgcttccaaactgattccgatcaagtctgggcttagccctgagaaatatggaggctacgccagacccaccattgcctattccgtgctggtcacctacaagcagaacaacaagatcaaaaatacaatggtggggatccctgtgctcacgaagctggagttcgaacgggaccccaacctctacctgagaaatcttggaattaacaatgtctctcatgttatcaaactggtgaagtataccgtgctcgagtttaaacacaagtacggcacatatcgccggttcattgtcagcaaccaagaactgaagagagctaatcagatctttgtgaccacaaaacagatgaagctgatttcccagtacaccacgcttgataaaaacgagcacgactctctgctcaagaataaccaacagctgatccagagcatctggaatcagttcctcgagtttatgctggccacagatcttgttaacaaaaagcaatatgacgaactgattctgaccaataaccagaccatcgaggaatgtcgcaatattatgaaccgggtgatcacaaccctctccttcacaaatattaacgcggggcagaaaaagatcatctttgatgacacgctgagccttcctattaagagatggcagttcaccgattctgacaaaatggtcaagaaaatcattgagtccacactgatccatcaaagcattaccggcctctacgaaacacgcatcgatctgtctaagctcggagaggactga

SEQ ID NO: 4348 - RNA, 4134 nt, synthetic construct
  misc_feature 1..4134: note = Cas9 variant
  source 1..4134: mol_type = other RNA
atggagagcaaccacgacggcgaacaggtgaagtacaccctggggctcgatatcggaacatcctctattggctatgccgctatcgacaaacatcaaaagcccattagagccaaagggaagcacgtcatcggagttcggctgttccaggagggccagacggcggctgatcgcagagcctttcggaccacacgcagacggcttaaacgcagaaagtggcggctgaatctcctgaaccgccttttcgacccttacctgagcgaagtggatccgaattttctccccagactgcggcagtccaacctgtctcctaaggacgataataaacatttcaacgggagcaccctctttcccgacaagacagatgccgctttctatcgccaataccctaccatgtatcacctgagatacgcccttatgacagagaaacggaagtttgacattcgcgaagtgtatctggctatccatcacatcgtcaaatacagaggaaatttcctcaactccgccaccgtggattcttttaagacgagcaatattgacttcacctcccagtttgatcggctgaacgagctttacagacaggttatcctggacgagcccttccagattaatatggaccaagtggatgaaatgacaaacaagctcctggacaatgatgcgctgaaactcgacacccagaagcaggtcgccaaactgcttcctgtgatctataacgataagccgattgacaaacagtacacacgcatcgctaccgagtttagcaaggccattctgggctataaaacgaagctcgatgttatcctgaatcttgacacacaaaacgctaaggattgggtgatccggctggacgatgaagacattgacgataaactccccgccctggtcgagaacctggacgagtctagacaggaaatcgtgaccattatccgcgatctctacgcgcagattacactgaatgccatcgtgcctaagggcaaatcccttagcgagtctatggtcgacaagtataacgatcacaaagaccatctggatctcctgatggggcttatccacgaactgggagacgattccgctaagggcattaagctccgggaggcctacacccaatatgttgggaaaagcgacgataagaccctgaatcaggacgatttctacgctgccatcaaaaagaacctggacgaagactctaaaagatcccccaagattcagcgcctcatcgagcaggccagcttcatgcctaagcaacggacatccgctaatggagtgattccccatcagctgcaccagcttgagctggatagaatcatcgaaaaccagggccgctactatccgtttctcaaaaagcctaatcccaacacgcacaaacctaatgggggaaagtacaaactggacgagctggtggcgttccggattccctattacgtcggcccccttatcaccaagagagatcaagaaaagacatctggcgccgactttgcttggatgattcgcaaacctgggcaggagggagaaatcaccccgtggaacttcgatcagaaggtggaccggatggccagcgccaatagatttattcggcgcatgacaaccaaagattcctatctcgttgctgaggacgtgctgcccgatgccagcctgatctacgagaagttcaaagcgctcaacgaactgaatatgcttaaggtcaacgactctagactgtcccctagccagaaacaagatctctttaataacctgttcaagaagcagaaaacgattcggacaaagaaactgcagacctatatcagaaccaactgggagcttccctctgtgatgatcagcggcctcgctgaccctgataagtttaattcctctctgagcacatacattgacttccgcgacatctttggggaaaaagttgatgaccccaaccggcaggccgattacgaggaaattatcgagtggtccaccgtgttcgaggacagaaagatttatcaagccaagctgaatcagctcgattggctgacagaaccgcagcgcaaagcccttctgacgaagagatacaccggatggggccggctcagcaaaaagctgctgacagggcttaaagaccaaaacggagattctatcctcgaccagctgtggaagaccaatgataactttatgcagatccagtcccgcgacgagttcgctaagcaaattcatgatgaaaatgctaaacagttccacgaggccaacaatgtcgacgacatcctggatgacgcgtttacaagccctcagaacaagaaagccattagacaggtggataaggtcgtgcaagacgttgtgaaagctgtcggctatgcccccgataagatcgctattgagttcacccggtctctcgaaaataaccctcagcgcacggtgtccagacagcggcagctgcaagccgcgtacaagaatatcccccgcgagatcatgaaaagcggccttatggccgaactggggtccgttgctgactctaagaaagtgctcagcgataagctgtatctgtactttacccagatgggaaaagacatgtatgaggataagacaattaacatcgacaatcttcctaactacgatattgaccatatcctcccccaggccttcattaaagatgactccatcgacaacagagtcctgatctctaaggaagagaatgctcgcaagagcaaccgggtgccgctgaaatttttcggcgccaagagaatggggttttggaaagatctcctgaataacggacttatttccaatcggaagttccaaaacctgaccacagaccctgagaaaatcagcaagtactctgccaagggctttattcacagacagctcgtggaaacctcccaggttatccgcctggtcgctaatattctggggaacgagtatagccaggcgggcacgacaatcattgaagtgtctgccaaaatgaatcggcaacttagagaggatttccatctgatcaagaaccgcaatgtgaacgactaccaccacgctatggatgcctatctcaccgcctacgtcggagactatctgtacctccggtatcccaaactgagaccctactttgtgtacggcgatttcaagaaagctgaagaccaggatcttaatatccgcaactttaatttcctgcatgacctcaaggataacgagtccctggacaagattgttgatagcgagacaggggaaatcgtgtgggagaaacacggatctgtcaagcagctgaaaaaggtgtatcattacaaattcatgcttgttagccaggaagtgtatacccggcaagacgccctgtttaaccagaccatttaccctgcgtccgacgctgataagagaaagctcatcccgattaaaaatagcaagcccgtcgacgtgtatggcgggtactctggaaacatcgatgcctatatggccatcgttcgcgtgcacggcaaaaaggaggacaattacaaagtcgtggggattcctatgcgggctgtgacaaagctgaagaaagccgaaaaggagggccacgattcctacctcaacgcggtccatgaggttctgaaaccccagttcacgaagaaaaagaaaaatagaaagaccggagaaatcacagagaccgtggacgaatttgatgtgcttctgggcaaggtctattaccggcagctcattgtggacgggaacaaaaagttcatgctgggaagctcctcttatcaatacaatgctaaacagctggttcttagcgataaggccatgcaagtgctgtccaaaaacggcaaggtcaagtctcaggacgagaatcagaacctcatcgatgtgtatgacgagattctggaaaaagttgaccagtactttgagctctatgatcagcgccactacagagaaagcctgcataaggggcggggaatcttcgtgaatcttcctctgtccaaccaatacgacggctctaaactgacaagctatgggaagtacgagaccatcgatgccattctcaatggcctgcacgctaacgccacgatgtccaatcttcgctatctgggaatcagctctccctttggcaaaatgcaggcttccaacgggctcacaattgaccctgatagcatcatttgctaccagtctcccaccggactgttcgaaagacagatcaagctctccgacctgtga

SEQ ID NO: 4349 - RNA, 4134 nt, synthetic construct
  misc_feature 1..4134: note = Cas9 variant
  source 1..4134: mol_type = other RNA
atgaacaagccctacagcatcggcctggacattgggaccaattccgtgggatggtctatcattacagatgactataaagtccctgccaagaaaatgagagttctcggcaacacggataaggagtacatcaaaaagaatctgattggggcccttctgttcgacggaggcaacaccgctgcggatcggcgcctcaagagaacagctcggcgcagatatacccggcgcagaaatcggatcctgtaccttcaggaaatctttgccgaggaaatgagcaaagtggacgattccttctttcaccgcctggaggactctttcctcgtggaagaggataagagagggagcaaatatccgatttttgccacaatgcaagaggaaaagtactatcatgagaaattccccaccatctaccatctgcggaaggaactggctgacaagaaagagaaggccgatctccgcctggtctaccttgctctggcccacattatcaaatttagaggacacttcctcattgaggacgatcggtttgacgtgcgcaacacagacatccagaagcagtatcaggcgttcctggaaatttttgataccacgttcgagaataaccatcttctgtcccaaaatgttgacgtggaagccatcctcaccgataaaatctctaagagcgctaaaaaggaccggattctggcccagtaccctaaccagaagtccacaggcatctttgctgagttcctgaaactcattgtcggcaatcaggccgatttcaagaaacactttaacctggaagacaagacaccccttcaattcgcgaaagatagctatgacgaggatctggagaatctcctggggcagatcggagacgaatttgccgatcttttctctgtggctaagaagctgtacgactccgttctcctgagcggcattctgaccgtgaccgacctctctacgaaagcccctctgtccgctagcatgatccagagatatgatgagcaccatgaagaccttaagcacctgaaacagtttgtcaaggcctctctccccgagaactacagagaagtgttcgccgattccagcaaagacgggtatgctggatacatcgagggcaagacaaatcaagaggcgttttacaagtatctgcttaaactgctcaccaagcaggaagggtccgagtacttcctggagaaaattaagaacgaagattttctgcgcaaacagcggacattcgacaacggatctatccctcatcaagtgcacctcaccgaactgagagccattatccgccggcagagcgagtattacccgtttcttaaggagaatcaggatagaattgaaaagatcctgaccttccgcatcccctattacgtcggccctctcgctcgggagaaatccgactttgcctggatgacaagaaagacggatgacagcattcgcccctggaacttcgaagatctggttgacaaagagaagtctgccgaggctttcatccaccggatgaccaataacgatctgtatcttcctgaagagaaagtgctccccaagcattccctgatttacgaaaaatttacagtgtacaatgagctgaccaaggtcagattcctcgccgaaggctttaaggacttccagtttctgaaccgcaaacaaaaggagacaatcttcaatagcctttttaaagagaagcggaaagtgaccgaaaaggacattatctctttcctgaacaaggttgatgggtatgagggaattgcgatcaaaggcatcgaaaagcagtttaatgctagcctctccacgtaccacgacctgaaaaagattctggggaaagatttccttgacaacacagataatgagctcatcctggaagacattgtgcagaccctgaccctctttgaggatagagagatgatcaagaagtgcctggacatttataaagatttctttacagaatctcagcttaagaaactgtaccggcgccattataccggatggggcagactcagcgccaagctgatcaacgggatccggaataaagagaaccaaaagacaattctggactaccttatcgatgacggatccgccaatagaaacttcatgcagctcattaacgatgacgacctgagcttcaagccgatcattgataaagctcgcacgggctctcactccgacaatctgaaggaagtcgtgggcgagctcgccgggagccctgctatcaaaaagggaatcctgcagtctcttaaaattgttgatgaactggtgaaggtcatgggctatgagcccgagcagatcgtggtcgaaatggcccgggagaaccaaaccacagcgaaagggctctccagaagccgccagagactgaccacactgcgggaatcccttgccaatctcaagtctaacattctggaggagaagaaacctaagtacgtgaaagaccaggttgaaaatcatcacctgagcgatgaccgcctctttctgtactatcttcagaacggaagagatatgtacaccaagaaagctctggacatcgataatctctcccaatatgacattgatcacatcatcccccaggccttcattaaggacgactctatcgataaccgggtgctggtcagctccgctaagaatcgcggcaaaagcgacgatgtgccctctattgagatcgttaaggccagaaaaatgttttggaagaacctgcttgacgcgaaactgatgtcccagcggaagtacgataatctcacgaaggccgaacgcgggggcctgaccagcgacgataaagctagattcattcaacggcagctcgtggagacacgccagatcaccaagcatgtcgcccggattctggacgaaagatttaacaatgaggtggataacggcaaaaagatctgtaaagtgaagatcgttacacttaagtctaatctggtctccaacttcagaaaagagtttggattctataagattcgcgaagtgaacgactaccaccatgctcacgatgcctatctcaatgccgtggtcgctaaagcgatcctgaccaagtaccctcagctggagccggaatttgtgtacgggatgtatcggcaaaagaaacttagcaagattgttcacgaggacaaagaagagaagtactctgaggccacgagaaaaatgttcttttatagcaacctgatgaatatgttcaagcgcgtggtccggctcgctgatggatccatcgtggttagacccgtgattgaaacaggccgctacatgcggaaaaccgcctgggacaagaaaaagcatttcgccacagtcagaaaggtgctgagctatcctcagaacaatatcgttaaaaagaccgagatccagaccgggggattttctaaagaatccattctcgctcacggcaacagcgacaagctgatcccccgcaaaacaaaggatatttaccttgaccctaagaaatatgggggcttcgattcccccatcgtggcctactctgtcctggtggtggcggacattaagaaaggaaaggctcagaaactcaagacggtcaccgagctgctgggcatcacaatcatggaacggagcagatttgagaagaatccgtccgccttccttgagtctaaagggtacctgaacattcgggatgacaagctcatgatcctgcctaaatatagcctctttgaactggagaatggacgcagacggcttctggcctccgctggcgaactgcaaaaggggaacgagctcgccctgcccacccagttcatgaaatttctttacctggcgtctcgctataatgagagcaagggaaagcctgaagagattgaaaagaaacaggagttcgttaaccagcatgtgtcctactttgatgacatcctccaactgattaatgatttcagcaaaagagtgatcctcgctgacgccaacctggaaaagattaataaactttatcaggataacaaggagaacatccccgtcgacgagctggccaataacatcattaatctgtttacattcacctctctcggcgctcctgccgcttttaaattcttcgataagatcgtggaccggaagagatacacgtccacaaaagaagttctgaacagcacccttattcaccagtctatcaccgggctgtatgagacacgcattgacctcggcaagctgggagaagattga

SEQ ID NO: 4350 - RNA, 4134 nt, synthetic construct
  misc_feature 1..4134: note = Cas9 variant
  source 1..4134: mol_type = other RNA
atggagaagacctacagcatcggcctggacattgggacaaactccgtgggatgggccgtcatcacggatgactataaagttcccgctaagaaaatgaaggtgctcggcaataccgataaaaagtacattaagaaaaacctgcttggggccctcctgttcgactctggagaaacagcggaggctaccagactgaagcgggccgcccgcagacggtatacacgcagaaagaatcggcttcgctacctgcaggaaatctttgctaaggagatggccaaagtggatgaatctttctttcaaagactcgaggagtccttcctgaccgacgatgacaagacatttgattctcaccctattttcggcaacaaggctgaagaggacacctatcatcaggaatttccgacgatctaccatctgcggaaacacctcgccgatagccccgagaaggtcgacctgcgccttgtgtatctggcgctcgcccacatgatcaaattcagagggcattttctgattgagggacagcttaatgctgaaaacaccgatgttcagaagatcttcgccgactttgtgggcgtctacgaccggacattcgatgactcccacctgtctgagattaccgtggatgctgccagcatcctcacagagaaaatttccaagagccgcagactggagaatctgatcaaacaataccctaccgaaaagaagaacacgctctttggcaatctggttgcgcttgccctggggctccagcccaacttcaaaacaaatttcaagctgtctgaggacgctaaacttcagttttccaaggatacctatgacgaggatctggaggagctcctgggaaaaattggcgacgattacgccgacctgttcacagctgccaagaacctctatgatgccatcctgcttagcgggatcctgaccgtggacgacaattctaccaaggctcctctctccgcgagcatgattaaacggtacgaggaacaccatgaagatctggagaaacttaaaacatttatcaaggtcaacaatttcgacaaatatcacgagatttttaaggataagtctaaaaacggatacgccggctatatcgaaaacggggtgaagcaggacattttctacaaacatctgaagtccatcatcagcgagaaaaatggaggccaatactttctcgataagattgaacgcgaggacttcctgagaaagcagcggacgtttgataacggctccatcccctatcagattcatctgcaggaaatgagaaccatcctccgccggcaaggggagtactatcctttcctgaaagagaatcaggctaagattgagaaaatccttacatttagaatcccgtactatgtgggacccctggcccgcaagaactctcggttcgcctgggctaaataccacagcgacgaacctattaccccctggaattttgatgaagtcgttgacaaggagaaatccgccgagaagttcatcacaagaatgaccctcaacgatctgtatctgcctgaagagaaggtgcttcccaaacacagctacgtgtacgaaacgttcgcggtctataatgagctcacaaagattaaatacgtgaacgaacagggcaagagctttttctttgacgctaatatgaaacaagagatcttcgatcacgtttttaaggagaaccgcaaggtgaccaaagccaagctgctgtcctatctcaataacgagttcgaagaatttcggattaatgacctgatcgggcttgacaaagatagcaagtctttcaacgccagcctgggaacctaccatgacctcaaaaagattctggataagtcctttctggacgataaaacaaatgagcagatcatcgaagacattgtccttaccctcacactgttcgaggatagagacatgatccacgagcgcctgcagaagtattctgatatttttacgagccagcaactcaaaaagctggaacggagacattacaccggctgggggcgcctttcctataaactgatcaacggcattcggaacaaggagaataacaagacaatcctcgacttcctgatcgatgacggagatgctaatagaaactttatgcagctgattaatgacgacagcctttctttcaaaaccacaatccaggaagcccaggtggttggcgatgtggacgatattgaggctgtcgtgcacgacctcccggggtcccctgccatcaagaaaggcattctgcaaagcgtcaagatcgtggatgaactggttaaagtgatgggacacaacccccagaatatcgtcattgagatggcgcgggagaaccagatcaccgggtacggacgcaatagatctaaccagcggctcaagagactgcaagactcccttaaagagttcggcagcgatattctgtccaagaagaaaccttcttacgtggacagcaaggttgaaaattcccatctccagaacgatcgcctgtttctgtattacatccagaatgggaaagacatgtatacgggcgaggaacttgatattgaccacctctctgactacgatatcgaccatatcattccccaggccttcatcaaggataacagcattgacaatcgggtgctgacctccagcgctaaaaacagaggaaagtctgatgacgtcccctccatcgaaattgtgcgcaacagaaagagctattggtacaaactgtataagtctggcctcatctccaaacggaagtttgataatctgacaaaagccgaacgcgggggacttaccgagacagacaaggctggcttcattaagagacaactggtggaaacccggcagatcacgaaacacgttgcccagatcctcgatgcgcgctttaacacaaagtgcgacgagaatgataaagtcattagagacgtgaaggtgatcaccctgaaaagctctctggtcagccaattccggaaggaatttaagttctacaaagtgcgcgagattaacgattaccaccatgcccacgacgcttatcttaatgccgttgtggggacagctctgctcaagaaataccctaagctggccccggagtttgtctatggagaatacaaaaagtatgacgtgagaaagctcgttgccaaatccagcgataaccattctgagctgggcaaggctaccgcgaaatacttcttttattccaatcttatgaacttcttcaagaccgaagtgaaatacgccgacgggcgggtctttgagcgccccgatatcgaaacaaatgctgacggcgaggtggtttggaacaagcagagagatttcaatattgtgcggaaagtcctgagctaccctcaggtgaacatcgtgaagaaggtcgaggttcagacgggaggcttttccaaagaatctatcctccccaagggggacagcgataaactgattcctagaaagaccaaaaagctgcaatgggagacacagaagtatggaggcttcgactcccccaccgtggcctactctgtgcttgtcgtggccgatgttgaaaaagggaagacacgcaaactgaagaccgtgaaagagctcgtcggaatcagcattatggaacggtcctcttttgaggagaatccggtgagcttcctggaaaagaagggctatcacaacgttcaggaggacaaactcatcaagctgcctaaatactccctttttgagttcgaagggggcagacgccggctgctcgctagcgccacggaactgcagaagggaaatgaagtggtcctgccccaatatatggtgaaccttctgtaccattctcagcacgttaacaattcccacaaacctgagcatctcaactatgtgaagcagcacaaggatgaatttaaagacattttcaatctgatcatcagcattgcgagaatcaacattctcaagcccaaagtcgtggataatctgatcaacgagtttacagaatacggccaggaggacatttcttcccttagcgagtctttcatcaatctgctgaagtttatttccttcggggctcctggagccttcaaatttctcaagctggacgtgaaacaaagcaaccttcgctacaagtccaccaccgaagccctgagcgctacactcatccatcagtctgtcaccggcctgtatgagacacggatcgatctcagcaagctgggggaagagtga

SEQ ID NO: 4351 - RNA, 4137 nt, synthetic construct
  misc_feature 1..4137: note = Cas9 variant
  source 1..4137: mol_type = other RNA
atgaagaccttcgccgaggaatacgtgatggacaaaagcaagccctatggcatcgggctggatattggaacaaactccgtcggctttgttgctacggacgccgaggggcacctcatcagactgaaaggaaagaccgtgattggcgcgtaccttttcaatgctgggatctctgccgccgaacggcgcggatttagaacaacccggcgcagactgagccgggtgaaatggcgcctcggcctgcttagagagattttcgaaacacattttcaggagtccatgggcgagaacgaagataatgacttctttctgcggttcaagtattctaacatcagccctaaggatccgcaattttccaccgctaaaggactcttcaatgaccgcacagataaggagttttacgaccagtatcccaccatctaccacctgagacgggccctgatgacggaagatcatcagttcgacattcgcgagatctatattgctatgcaccatatcgtcaaatacagagggcactttctcaaggagggccgggccaaagatttcaaggtgggggacctgcgccttctggataacttcaagatgatgaatgaacagattgaggaaatcaaccctctctggcaactgaaacttcccaccgacgacgcgtctattaagagcatcacagccatcctgctcgataatacccagtcccagaacgacagacagaaagctgttacaaaggtgattctggccaccctggtcaaagctagcgataaggacatcaatgccgcgcggaaaagatttgtgggagagctctctaaggccatggttggcctgaagacgaaactttgggtgctggctgatgtctcccaaaacggggactgggaaattaagtacgagaattatgccgatttcgctgagacaatcggaagcggcgaatctgacaccattcagtccctctttaacgagatcaatgatctgtacggcgtgatcacacttgccgggattatccctaaagaagccgagagcttctctgacggaatggtgcgcaagtatgaacaccatcggaaaaacctggagctcctgaaggtctactgcgctgagcagtccgatggcaagagagggcgccagattcggcaaacctatgacaaatacatcgacggagttgatagcaagcagtttacccaggaagacttctataaagcgctgtccaagtttacagccaaagatgaggctacgtctgaaaacgccaagctcattgcccaagagatcgctgtgggcaccttcatgcccaagctgagaacaaaagccaatgggaccatccctcaccagcttcatcagaaggaactggacgcgattatcgagaaccagaaaaagtactacccgtggctcggagaggtgaatcccgtcgaaagccaccgccgggctctgccttataaacttgatgagctggtgtcctttcgcattccctactatgttggccctatggtgacacccaccaagggcgacccggaaaagagcaaattcgcctggatggtcagaaaggagcctgggacgatcacaccctggaactttgatcaaaaagtggaccggtctgcctccggagaggctttcattcagagaatgaagaccaccgatacatttctcatcggcgaagacgttctgcctcagcagagcctgctctaccaaaaattcgaggtgctgaatgaacttaacaagattatgatcaatgggaaacccatctgtcgcgagcagaagcagcggctgttcaagcagctctttatgcaatataaaaccgtcacagtgaagaaagtccagcagaacctgattgccaatggagaagagtctgagaacgtgcccatcacgggcctgagcgatcctcttagattcaattcctcttttagcacctacattgactataaggatatcctcgggacagctgccgttaacgacaatgcgaaacagtccgacattgaacaaatcatcgcctggagcaccattttcgaggatgctgccatctttcgggaaaagctgaacgacattacatggctgaatgatgaccagcgcaacaagctctctcacaaaagataccggggctggggaagacattcccgcaagctgcttgctggcctgcgggatggggagggacagaccatcattgaaagactctggaacacgaatgacaacttcatgcaaatccagaatgatagcgagatcgcccgccagattaccgaggcgaactcttccaaaatggccacagctgaaggcaccgacgagatcattgatgggttttacacaagcccggaaaataagaaagccctgagagaggtgatgaaggtcgtgaaggacatccagcgggctcaccatggacaagcccccgcctgggtttatattgaatcccctcgcgagacccccagacctggccagcggacggtgtctcgcgagcagcagctgacagatctttacgaaggggctgcgaaagagatcgtcgacgatgccgtgctcaacgaactgaaggacaaagttaagagcaaagagaatttcaccgacaagctggtgctctattttctgcaaaacggccacgatatctacgctaatgactccattaacatcgataatcttaacgcctatgacattgatcatgtcctgccccagtctctcatcaaggacgatagcctggacaatagagtgctgacaacccacgagcggaaccttaaaaagtccaatcgcttcgccaccgaactctttgctgatcagagaaagaagtgggagaaatggcaccggctgggactgattagctctcgcaagctcaaacatctgacaatgcagccgaactccgtggaaaagttcgcccacggctttatcgcgagacaacttacggagacccggcagattatccatctgacagctaacgtcctcagcaatctgtaccaggaaaacgacaccaagatcgtgatgattaaagccgggcttaattctgagttcagacgcacattcgattttcctaagaaccggtccgttaatgactatcaccacgccttcgacgcttttcttaccgccaaaatcggaagatacctcctggcgcgctaccccaagctggagcctttctttgtgtatggcaacttcgtcaaaaatcccaaggctatgaagcggctcagctcttttgatttcattgcccaactggccgctaaaacggacgatacaagccatatcgaccagagatcccttaaacaggtgcctgttgtgaacgaagagaccggggaaattgtctgggataaagacatcgagctggccgaactcgataagacctacaattataaaacaatgctggtgaagcgcgctcagaccgagaacaatgcccaaatgtttaagcagacagttttcaaagcgcgggacaaccagaataagacgctgatccccgtgaaaaacggacttagcaccgatgtctacggcgggcactctcagcaagccatttcctatctgtgcatcgtgtgggtgggccagaagaaaaagtacagagtcctcggaattagcacagctcatgccggcatcctgaataactttgagaagaactatgggcgcttcgaagctaaaaagaaactccaggagattgtttccaataccctggacaacgccgatcggaatgacttcaagatcgtggccccgaaagtgctttttgaacaggtcgtggaggatgacaacatgaagttcggactgggctctgctagcgactacagaaatgttcaacagctctttctgtcccggaagaaccagctgcttctggcgaatatgatgacagatcagatccacgaccaagatctcgtgcatctgttcgacgaaattgtcgggcagatgaacgcccactttcctatcttcgatcgcggaggctacagatctagcctcacccagtcccgggacaaatttctgaagctgcccttcaaaaagaatgaggatctgattacgaaacaagaggtgatccgccggattctcgacgggctgcacgctaacgccaatagaaaggatctgaaaatcattggctctaagggagactttggcagacttgggaccaagaaaatctatctgagcaaggatgccaaactcatctacacatcccccacctgtctgttcacacgcaccgttcctctcagctctctgtga

SEQ ID NO: 4352 - RNA, 4137 nt, synthetic construct
  misc_feature 1..4137: note = Cas9 variant
  source 1..4137: mol_type = other RNA
atgaccaacgagaagtacagcatcggcctggacattgggacatcctctatcggattcgccgtggtcaatgataacaatagagttattcgggtgaaaggcaagaacgctatcggggtgcgcctctttgacgaaggaaaagccgcggctgatagacggagcttccgcacgaccagacggcgcctgtccagacggcgctggagacttaagctgctccgggagatttttgacgcctatatcacacccgtcgatgaagccttctttatccgcctgaaagagtctaatcttagccctaaggactccaagaaacagtactctggcgatattctgttcaacgacagaagcgataaggacttttatgaaaaatacccgaccatctatcacctccggaatgctctgatgacagagcatcgcaagttcgatgtgagagagatttacctggccatccaccatattatgaaatttcgggggcacttcctcaacgctacccccgccaataactttaaggttggaagactgaatcttgaagagaagttcgaggaactgaacgacatctatcaacgcgtgtttcctgatgagtccattgaatttcggacagacaatctcgagcagatcaaagaagtcctgcttgacaacaagagaagccgcgcggatcggcagagaaccctggtgtctgacatctaccagtccagcgaggataaagacattgaaaagcgcaataaagccgttgctacggagatcctcaaggcctctctgggcaacaaagctaagctgaacgtgattaccaatgtcgaggtggataaggaagccgcgaaagagtggtccatcacattcgacagcgaatctattgatgacgatctcgccaagatcgagggccaaatgaccgacgatgggcatgaaatcattgaggtgctgcggtccctttacagcggaatcacactgtccgctattgtccccgagaaccacaccctctctcagagcatggttgccaaatatgacctgcacaaggaccatcttaaactgtttaagaagctcatcaatggcatgacggatacaaagaaggctaaaaacctgagagccgcctacgacgggtatattgatggagtgaagggcaaagtgctgcctcaggaagacttctacaagcaggtccaagtgaatctcgatgactccgctgaggcgaacgaaatccagacctatatcgatcaggacatttttatgcccaagcagcgcacaaaagccaatgggagcatccctcaccaactgcagcagcaagagcttgatcagattatcgaaaaccagaaggcttactatccgtggctggccgagctcaatcccaaccctgacaaaaagcggcagcaactggccaaatacaaacttgatgagctggttaccttcagagtgccctactatgtcggacctatgattaccgctaaggaccagaaaaatcagtctggcgccgaatttgcgtggatgatccgcaaggagcccggcaacattacaccgtggaatttcgatcagaaagtggaccggatggctacggccaaccaatttatcaagagaatgaccacaaccgacacatacctcctgggggaagatgttctgcctgcccagtccctcctgtatcagaaattcgaggtgcttaatgagctgaacaagatccggattgaccataaacccatcagcattgaacagaagcaacagatctttaacgatctcttcaagcagtttaaaaatgtcaccattaagcatctgcaggactacctggtgtctcaaggacagtatagcaaacgccctcttatcgagggcctcgctgatgaaaagagattcaactcctctctgagcacgtactccgacctgtgcgggatctttggagccaaactcgtcgaggaaaatgatcggcaggaggacctggagaagattatcgaatggagcacaattttcgaggataagaaaatctatagagctaaacttaacgacctgacctggctcaccgatgaccaaaaagaaaagctggccacaaaacgctaccagggctgggggcggctgtctagaaaacttctcgtgggactgaaaaattccgagcaccgcaacattatggatatcctgtggatcaccaatgaaaacttcatgcagattcaggcggagcccgactttgccaagctcgttacagacgctaataagggcatgctggagaagacggatagccaagacgtgatcaacgatctttacacctctccccagaataagaaagccattagacagatcctgctcgtcgtgcacgacattcagaacgctatgcacggccaagcccctgcgaagatccatgttgagttcgcccgcggggaagaacggaatccgagacggtccgtgcagcgccagagacaggtcgaggctgcctatgaaaaggtgagcaacgagctggtgtccgctaaagttcggcaagagtttaaggaagccatcaataacaaacgcgatttcaaggacagactgcttctctactttatgcagggaggcattgatatctatacagggaaacagctgaacattgaccaactgtctagctaccagatcgatcacattctcccccaggccttcgtcaaggacgattccctgaccaatcgggtgcttacaaacgagaatcaggtgaaagctgactctgtccctatcgacatttttggaaagaagatgctgagcgtgtggggccgcatgaaagatcaagggctcatctccaagggcaaatatagaaacctgaccatgaatcccgaaaacatcagcgcgcatacggagaatggattcattaaccggcagctggttgagaccagacaggtgatcaaacttgccgtcaatattctcgctgacgaatacggcgattctacacagatcatttccgtgaaggccgacctgagccaccaaatgcgcgaggattttgaactgctcaagaaccgggacgttaatgattatcaccatgccttcgacgcttacctggccgcgtttatcgggaactaccttctgaagagatatcctaaactcgagtcttacttcgtgtatggagattttaagaaattcacccagaaggaaacaaaaatgcgccggttcaattttatctacgacctgaagcactgtgatcaggtcgtgaacaaggagaccggcgagattctgtggacgaaagacgaagatatcaagtatattagacatcttttcgcttacaaaaagatcctggtttcccacgaggtgcgcgaaaaacggggagccctctataatcagacaatttacaaggccaaggacgacaaagggagcggccaagggtctaagaaactgatcagaatcaaggatgacaaagagaccaagatttacggcggatatagcggcaagtccctcgcttacatgacaatcgtccagattaccaaaaagaacaaagtgagctatcgcgtgatcgggattcccaccctggcccttgcgcggctgaacaagctcgaaaatgattctacagagaacaatggagagctgtacaaaatcattaagccgcagtttacgcactataaagtcgacaagaagaacggcgaaatcatcgagaccacagatgacttcaaaattgttgtgtccaaggtgagatttcagcaactgatcgatgacgctgggcagttctttatgcttgccagcgatacctacaaaaataacgcccagcaactggtcatttccaataacgctctcaaggccatcaataacacaaatattaccgactgccctcgggatgacctggaacgcctcgataacctgagacttgactctgctttcgacgagatcgtgaaaaagatggataagtattttagcgcctacgacgcgaataacttccgggaaaagatccgcaattccaacctgattttctaccagctccccgttgaggatcagtgggagaataacaagatcacggaactgggaaaaagaacagtgctgacccggattcttcagggcctgcatgccaacgctaccacaaccgacatgtctatcttcaagattaaaacacctttcgggcaactcagacagcgcagcggcatctccctgtctgagaatgcccagctcatctatcagagccccacgggactgtttgaacggagagtccaacttaacaagattaagtga

SEQ ID NO: 4353 - RNA, 4137 nt, synthetic construct
  misc_feature 1..4137: note = Cas9 variant
  source 1..4137: mol_type = other RNA
atgaagaacaaagactacagcatcggcctggatattgggacctcctctatcggattcgccgtggtcgacgagaataaccacgttatgagagtgaagggcaaaaatgctattggggtgcggctctttgatgaaggaaagcccgccgcggaccgcagagctttccggacaacgcgcagacggctgagccgcagacggtggcgccttaaactgctcagagagatctttgattcctatattacccctgtcgacgaagccttctttatccggctgaaggagtctaaccttagcccgaaggattccaaaaagcagtactctggcgacatcctgttcaatgatcgcagcgacaaagatttttatacaaagtaccccaccatttatcatctcagaaacgccctgatgacagaacaccaacggttcgacatccgcgagatttacctggctatccatcacattgtgaaatttagagggcatttcctcaatgccacccctgctaacaattttcaggttggaaagctggatcttgaccagaagttcgaggacctgaacgatatctatcagcgggtgtttcccgacgattccattgagttcagaatcgacaatctcgaacaaatcaaagccgtcctgcttgatagcaagcgctctcggtccgacagacagcgcagcctggtggatgacgtttaccagacatctgaagataaagaggtggagaagcagaacaaagcggtcgccaccgaagtgctcaaggctattctgggcaataaagccaagctgaacatcattgctaatgtggaggtcgacaaggaagccgcgaaagagtggacgatcaccttcgattccgaaagcattgacgacgatctcgccaagatcgacggccaaatgacagatgacgggcgggctatcgttgagattctgagatctctttactccggaatcaccctgagcgccattgtgcctgagaaccacacactctcccaggctatggtggccaaatatgatctgcacaagaaacatcttaccctgctcaagaagctgatcaactctatgacggacacaaagaaggccaaaaatctgcgcgctgcgtacgatggctatgtcgacggggtgaagggaaaagttctcacccaggatgaattttacaagcagattcaaagcaacctggacgagtccgtggaagccagcgagatccagacatatatcgatcaggacattttcatgcccaagcaacggaccaaagctaatggctctatccctcaccagcttcagcagcaagaactggatcagattatcgagaaccagaaggagtactatccgtggctcgccgaactgaatcccaaccctgacaaaaagagacagcaacttgccaaatacaagctggacgagctcgtcacctttcgcgtgccctactatgttgggcctatgattacagctgaagcccagaagaaacagtccggagcggagttcgcttggatgatccggaaggaaagcggcaatattacgccctggaactttgatcagaaagtggacagaatggccaccgccaatcaattcatcaagcgcatgacaaccacagatacctacctgctgggcgaggacgtcctcccgtctcagagcctgctttatcagcggtttgaggtgctgaacgaactcaataaaatcagaattgatcggaagcctatctccgtcgagctgaaacagcaaattttcaacgacctgtttaagaagttcaaaaatgtgacgatcaagcatcttcaggattacctcgttgctcaggggcaatattctaaacgccccctgattgaaggactggccgacgagaagagatttaacagcggcctctccacatacaatgatttctgcgggatctttggagctaaactggtggacgagaacgatcggcaggccgaccttgaaaagatcattgagtggagcaccatcttcgaagataagaaaatttatagagcgaagctgaacgacctcgcctggctgaccgacgagcagaaagataagctggctacaaaacgctaccagggctgggggcggctttcttccaagctcctgatcggactgcaaaatagcgaacacagaaacattatggacctcctgtggatcggcaatgagaacttcatgcagatccaggccgattctgactttgctaaacttattaaagatgccaatcagaacgcgctgcaaaataacgactcccaggatgtcatcaatgacctctacaccagccctcagaacaagaaagccattcgccagatcctgctggtggttcacgatattcaaaatgctatgcatggccaggcccccacaaagatccacgtggagttcgctaaaggggaagagagaaacccccggcgctccgtccagagacaacgccaggtggaagccgcctatgagaaggcttctaatgaacttgtgggagcgaacgttcgggaggagctcaaggacgccatcacgaataaaagagattttaaggaccggctgttcctgtactttatgcagggcggggtcgacatgtatagcggagaacctattaacatcgataacctctcccgctacgacattgatcatatcctgccgcaggctttcgtgaaagacgattctcttaataacagagtgctgaccgacgccgagaagaatcggcgcaaaagcgatgccgtccccaacgaactctttggcgctaagatgagagtgacatgggagcggatgaaagaacaagggctgatttccaagggcaagtatagaaatctgaccatgaaccctgagaatatcaacaaatacacagagaatggattcattaaccgccagcttgttgaaaccagacaggtgatcaagctcgccgtcaatatcctggcggacgagtataaagaaaacacgcagattatcagcgtgaaggctgatctgtctcaccaaatgcgggaggactttgagctcctgaaaaatcgcgatgttaacgactaccatcacgccttcgatgcctaccttgctgcctttatgggcaattatctgctcaagcggtaccccaagctgagatcctatttcgtgtacggggactttaaaaagttcacccagaaagaaattaagctgcgccggttcaactttatctatgaccttaaacacgaggatcaggtcattgacaaggaaacaggagagatcctgtggaacaagaatgaagatatcgcgtacattagacatctcttcgcttataaaaagatcctgattagccacgaggtgtctgagcgccggggcgccctctacaaccagaccgtttacaaagcctccgacgataaggctagcgggcaaggatctaaaaagctgatccctattaagagcgacaaacccacagaaatctatggcgggtacaccggcagaacgcttgcctatatgacaatcgtgaaggtcaccaaaggaaagaaaatttcctacaaggtggtgggcgtcccgacagctgttctggccaagatggcgggggtgcggcagggaagccaggaggaacaggataaactctatggcgtgctgaagcctcaatttacccatcagaaagagaataagaaaaccggggaaatcacagagacggtcgacaagttcgatattatcgtgcccaaagttaagtaccagcaactggtgaacgacaatggacagctttttatgattggctctgataccctgccttataacgccgagcagctcgtcctgtccaaggaaagcgtgcagacaatcaataaccccgggattaaagacgagggctccgatgaagagtctgaaaataagaaactcgacaacgtttacgacgagatcgtgctgtgtatgaataagtacttccctctttatgataaccgcggatttagaaatagcatcaccaacggcaaaaataagttcctgaagctccccattaaaaacatctacaagaatgggaaactgattaacgtcggaaagcgggaggtgatcaaccgcattctgcaaggccttcacgctaatgcctccgttacagacctgtctaacctcgggatcaaaagcccgtttggattcctgcagaagggcgctgggctctccctgtctggcgaagcccagcttatccaccagagcgccaccggactgtttgagcatagagtgcaactgaataagattaaatga

SEQ ID NO: 4354 - RNA, 4137 nt, synthetic construct
  misc_feature 1..4137: note = Cas9 variant
  source 1..4137: mol_type = other RNA
atgagcaacaagccctactccatcggcctggacattgggaccaattctgtgggatgggccgtcatcacagatgactataaagttcctagcaagaaaatgaaggtgctcggcaacacggataaacacttcattaagaagaatctgatcggggcccttctgtttgacgagggaaccacagctgaaggcagacggctcaaacgcaccgcgagacggcgctacacaagacggaagaaccgcctgagatatcttcaggagattttctccgaagagatctctaaagtggatagctcctttttccatcggctggacgattcttttctcgtcccggaagacaagcgcgggagcaaataccccatcttcgctaccctggccgaggagaaggaatatcacaagaattttcctacaatttaccatctgagaaaacaactcgccgattccaaggagaaagctgacctgcggcttatctatctggccctcgctcacatgatgaagtaccgcggacatttcctgtacgaagagagctttgatattaaaaacaatgacatccagaagattttcaacgagtttatctctatttatgataataccttcgaaggctccagcctttctgagcagaacgtgcaggttgaagccatctttacggacaaaatctccaagagcgcgaagagagagcgggtgctgaaactcttccccgacgaaaagtctaccggcctgttctccgagtttctgaaactcattgtcgggaatcaagccgagttcaagaaacactttgatctggaagagaaggctcctcttcagttcagcaaggacacatacgatgaagacctggagaacctcctgggacagatcggcgatgggtttgccgaccttttcctggtggctaaaaagctctatgatgccattctgctgtccggaatcctcaccgttacagacccctctaccaaagcgcctctgagcgcctccatgattgaacgctacgagaatcaccagaaggatcttgctagcctgaaacaatttatcaagaacaatctcccggccgagaagtgcgtggaagtcttctctgaccagtccaaagatggctatgctgggtacatcgacggaaagacgacacaggaggccttttataaatacattaagaacctgcttagcaaactggaaggcgcctactatttcctcgacaagatcgagagagaagattttctgcggaagcagagaaccttcgacaacggctctattccccatcaaatccatctgcaggagatgaatgctattctccgccggcagggggagcactacccttttctgaaagaaaacagagagaagatcgaaaagatccttacattccgcattccctatcacgtgggacctctggcgcggggcaatagagatttcgcctggctcacccgcaacagcgacgaggctatccggccctggaattttgaggaaattgtggatcaagcctcctctgccgaggacttcatcaacaagatgaccaattacgatctgtatctgccggaagagaaagtccttcctaagcacagcctcctgtacgaaacatttgctgtttataacgagctgacgaaagtgaagttcattgccgaggggctcaccagataccagtttctggacaagaaacagaagaaagatatcttctacacatttttcaaggcggaagacaaacgcaaggtgaccgagaaggatattatccattatcttcacaatgtcgacggatacgatggcatcgaactgaaagggattgagaagcagtttaacgcttccctcagcacatatcatgacctgctgaaaatcattaaggacaaagaatttatggatgaccccaagaatgaggagatccttgaaaacattgtgcacaccctcacgatctttgaggatcgggaaatgatcaagcaaagactggcccagtacgactctctgttcgatgagaaagttattaaggccctcacacgccggcattataccggatggggcaaactgtccgctaaacttatcaatggcatttgtgacaaacagaccgggaagacaatcctggattacctcattgacgatggaaagatcaacagaaattttatgcagctgatcaacgacgatggcctgagcttcaaagaaattatccaaaaggcccaggtggtcgggaaaacctatgacgtgaagcaggttgtgcaggagcttcctggatctcccgctattaaaaagggcatcctccaatccgtcaaactggtggatgagctggtcaaggtgatggggcacgcccccgaaagcattgttatcgagatggcgcgggaaaaccagacaacggccaagggcaaaaagaactcccagcagcgctacaaaagaatcgaggacgctattaagaatctcgcccctggactggactctaccatccttaaagagcacccgacagataatattcaactgcagaacgacagactcttcctgtactatctgcagaatggccgggatatgtacaccgggaagccccttgaaatcaaccaactcagcaattatgacattgatcatatcattcctcaggcttttatcaaggacgattccctggacaaccgcgtgctgacatctagcaaagagaatcggggaaagtccgataacgtccccagcctcgaagtggttgagaaaatgaaggccttctggcagcagctgcttgactctaaactgatctccgaaagaaagtttaataacctcaccaaggcggagcgcggcgggctggatgagctggacaaagtgggattcattaagagacaacttgtcgaaacgcggcagatcaccaaacacgtggcccagattctggacgctcgctttaataaggaggtgacagagaaaaacaagaagaatagaaacgttaaaatcattaccctcaagagcaacatggtctctaatttccggaaagaatttggcctgtacaaggtgcgcgaaatcaacgattatcatcacgcccacgacgcttacctcaatgccgtggtcgccaaagctatcctgaagaagtatcctaaacttgagcccgagttcgtgtacggggattaccagaagtatgacctgaaaagatacatttccaagagcaaagatccgaaggaagttgagaaagcgacagaaaagtatttcttctactctaacctcctgaactttttcaaggaggaagtgcattatgccgacggcaccatcgtcaaacgggagaatattgagtacagcaaggatacgggagaaatcgcttggaataaagagaaggacttcgccacaattaaaaaggtgctgtcctttcctcaagttaacatcgtgaagaaaaccgaggaacagacagtcggccagaatgggggacttttcgataacaatatcgtgagcaaggagaaagttgtggacgcctctaagctgattcccatcaaatccggcctcagccctgaaaagtatgggggatacgctcgccccaccattgcctactccgtcctggtgacctataagcagaacaataaaatcaagaacacaatggtgggcattcctgtcctcacgaaactggagtttgaaagagatcccaatctttacctgcggaacctcgggatcaacaatgtttctcacgtgattaagctggtgaaacataccgtcctggagttcaagcacaagtatggcacataccgcagatttatcgtgagcaaccaagaacttaaacgggcgaatcagatcttcgttaccacaaagcagatgaaactgatttcccaatataccacgctcgacaagaacgagcatgattctctgctcaaaaataaccagcagctgatccagagcatttggaatcaatttcttgagttcatgctggctacagacctggtgaacaagaaacagtacgacgaactcatcctgaccaataaccagaccattgaggaatgcagaaatatcatgaaccgcgtcatcacaaccctttcctttacaaatattaacgccggacagaagaagatcattttcgatgacacgctgtctctcccgatcaaacggtggcaatttaccgatagcgacaagatggtgaaaaagattatcgagtccacactgatccaccagagcattaccggcctctatgaaacaagaatcgatctgaataaacttggggaggactga

SEQ ID NO: 4355 - RNA, 4137 nt, synthetic construct
  misc_feature 1..4137: note = Cas9 variant
  source 1..4137: mol_type = other RNA
atgaacaagccctacagcatcggcctggacattgggaccaattccgtgggatggtctatcattacagatgactataaagtccctgccaagaaaatgagagttctcggcaacacggataaggagtacatcaaaaagaatctgattggggctctgctgttcgacggaggcaacaccgccgcggatcggcgcctcaagagaacagctcggcgcagatatacccggcgcagaaatcggatcctgtaccttcaggaaatctttgccgaggaaatgagcaaagtggacgattccttctttcaccgcctggaggactctttcctcgtggaagaggataagagagggagcaaatatccgatttttgccacaatgcaagaggaaaagtactatcatgagaaattccccaccatctaccatctgcggaaggaactggctgacaagaaagagaaggccgatctccgcctgatttaccttgctctggcccacatcattaaatttagaggacacttcctcatcgaggacgatcggtttgacgtccgcaacacagacattcagaagcagtatcaggcgttcctggaaatctttgataccacgttcgagaataacgaccttctgtcccaaaatgtggatgttgaagccatcctcaccgacaaaatttctaagagcgctaaaaaggatagaatcctggcccggtaccctaaccagaagtccacaggcatttttgctgagttcctgaaactcatcgtgggcaatcaggccgacttcaagaaacattttaacctggaagataagacaccccttcagttcgcgaaagacagctatgatgaggacctggagaatctcctggggcaaattggagatgaatttgccgaccttttctctgctgccaagaagctgtacgactccgtcctcctgagcggcatcctgaccgtgatcgatctctctaccaaagctcctctgtccgccagcatgattcagagatatgacgagcaccacgaagatcttaagcatctgaaacagtttgttaaggcctctctccccgagaactaccgcgaagtgttcgctgactccagcaaagatgggtatgcgggatacatcgagggcaagacgtcccaggaggccttttacaagtatctgcttaaactgctcacaaagcaagaagggtctgagtacctgctggaaaagattaagaatgaggacttcctccggaaacagagaacctttgataacggaagcatccctcaccaggtccatctgacagaacttcgcgctattatccggagacaatccgagtattacccgttcctgaaggagaacctcgaccgcatcgaaaagattctgacctttcggatcccctattacgtgggccctctggccagagagaaaagcgatttcgcctggatgacccgcaagacagacgattctattcggccctggaattttgaagaccttgtggataaagagaagtccgctgaggccttcatccacagaatgacgaacaatgacctctatctgcctgaagagaaagtcctgcccaagcacagcctcatttacgaaaaattcaccgtttacaacgagctgacaaaggtgcgctttcttgcggaaggcttcaaggactttcagttcctgaatcggaaacagaaggagaccatctttaactctctcttcaaagagaagagaaaagtgacagaaaaggatattatcagctttctgaataaggtcgacgggtatgagggaatcgctattaaaggcatcgaaaagcagttcaacgcctccctgtctacctaccatgatcttaaaaagattctcgggaaagactttctggataatacggacaacgagctgatcctcgaagatattatccaaacactgacccttttcgaggaccgggagatgatcaagaagcgcctggatatttataaagactttttcaccgaaagccagctcaagaaactgtacagacggcactatacaggatggggcagactgtccgccaagctgatcaatgggattcgcaacaaagagaatcagaagaccatcctcgattacctgattgacgatggaagcgctaaccggaattttatgcagctgatcaaggacgccggcctctctttcaaaccgatcattgacaaggctagaacaggctcccatagcgataacctgaaagaagtggttggggagcttgccggatctcctgcgatcaagaaaggcattctgcaatccctcaagatcgtggacgaactggtcaaagtgatggggtatgagcccgagcagattgttgtggaaatggcccgcgagaaccagacgaccgctaagggactgagcagatcccggcagcgccttacaaccctcagagaatctctgggcaatctgaaaagcaacatcctcgaggagaaaaagcctaaatacgtcaaggatcaagtggaaaatcaccatctgtccgacgatcggcttttcctgtactatctccagaacgggaaagacatgtacacagatgacgagctggatatcgacaatctgtctcagtatgatattgaccacatcattccccaggcctttatcaaggacgatagcattgacaaccgcgtccttgtgtccagcgctaagaatagaggcaaatctgatgacgttccctccatcgaaattgtgaaggcccggaaaatgttctggaagaacctgctcgatgcgaaactgatgagccaacgcaagtacgacaatctcaccaaggccgagagaggaggcctgacgtctgatgacaaagctcggtttatccagcgccagcttgtcgaaaccagacaaatcacaaagcacgtggcccggattctggatgagagattcaacaatgagctcgactccaaagggcgccggatcagaaaggttaaaattgtgacccttaagagcaacctggtctctaattttcgcaaggagttcggattttataaaatccgggaagtgaacaattaccatcacgctcatgatgcctatcttaacgccgtggttgctaaggcgattctgacaaaataccctcagctcgaaccggagttcgtctacggcctgtatagacgcaagaaactcagcaagatcgtgcgggaagacaaggaggagaaatactccgaagccaccagaaagatgtttttctatagcaacctgatgaatatgtttaaacgcgtggtccggcttgctgatgggtctatcgtggttagacccgtgattgagacgggacggtacatgggcaagacagcctgggacaaaaagaaacacttcgccaccgtccgcaaggtgctgtcctatcctcagaacaatatcgttaagaaaacagaaattcagaccgggggcttcagcaaggagtccatcctcgctcacggaaactctgacaaactgattcccagaaagaccaaagatatctacctggaccctaagaagtatggcgggtttgatagccccatcgtggcctactccgtccttgtggttgcggacattaaaaagggaaaagctcaaaagctgaaaacagtgacggaactcctgggcatcaccattatggagcggtctcgcttcgagaagaatacaagcgcctttctcgaatccaaggggtacctgaacatcagagatgacaaacttatgattctgccgaagtattctctgttcgagctcgaaaatggacggagacgcctgcttgccagcgctggcgagctgcagaaagggaacgagctcgccctgcctacccagtttatgaagttcctctacctggcgtcccggtataatgaaagcaaaggcaagcccgaggaaatcgagaagaaacaggaatttgtcaaccaacatgtgtcttacttcgatgacattcttcagctgatcaatgatttttccaacagagtgatcctggctgacgccaatctcgagaagattaacaaactgtatcaggataataaggagaacatccctgtcgacgaacttgccaacaatattatcaacctgttcacatttaccagcctcggagctcccgccgctttcaaatttttcgataagattgttgaccgcaaacggtacacgtctacaaaggaggtgcttaattccaccctcatccaccagagcatcaccggcctgtatgaaacaagaattgaccttgggaagctgggagagggctga

SEQ ID NO: 4356 - RNA, 4137 nt, synthetic construct
  misc_feature 1..4137: note = Cas9 variant
  source 1..4137: mol_type = other RNA
atgaccaacgagaagtacagcatcggcctggacattgggacatcctctatcggattcgccgtggtcaatgataacaatagagttattcgggtgaaaggcaagaacgctatcggggtgcgcctctttgacgaaggaaaagccgcggctgatagacggagcttccgcacgaccagacggcgcctgtccagacggcgctggagacttaagctgctccgggagatttttgacgcctatatcacacccgtcgatgaagccttctttatccgcctgaaagagtctaatcttagccctaaggactccaagaaacagtactctggcgatattctgttcaacgacagaagcgataaggacttttatgaaaaatacccgaccatctatcacctccggaatgctctgatgacagagcatcgcaagttcgatgtgagagagatttacctggccatccaccatattatgaaatttcgggggcacttcctcaacgctacccccgccaataactttaaggttggaagactgaatcttgaagagaagttcgaggaactgaacgacatctatcaacgcgtgtttcctgatgagtccattgagttccggacagacaatctcgaacagatcaaagaagtcctgcttgacaacaagagaagccgcgcggatcggcagagaaccctggtgtctgacatctaccagtccagcgaggataaagacattgaaaagcgcaataaagccgttgctacggagatcctcaaggcctctctgggcaacaaagctaagctgaacgtgattaccaatgtcgaggtggataaggaagccgcgaaagagtggtccatcacattcgacagcgaatctattgatgacgatctcgccaagatcgagggccaaatgaccgacgatgggcatgaaatcattgaggtgctgcggtccctttacagcggaatcacactgtccgctattgtccccgagaaccacaccctctctcagagcatggttgccaaatatgacctgcacaaggaccatcttaaactgtttaagaagctcatcaatggcatgacggatacaaagaaggctaaaaacctgagagccgcctacgacgggtatattgatggagtgaagggcaaagtgctgcctcaggaagacttctacaagcaggtccaagtgaatctcgatgactccgctgaggcgaacgaaatccagacctatatcgatcaggacatttttatgcccaagcagcgcacaaaagccaatgggagcatccctcaccaactgcagcagcaagagcttgatcagattatcgaaaaccagaaggcttactatccgtggctggccgagctcaatcccaaccctgacaaaaagcggcagcaactggccaaatacaaacttgatgagctggttaccttcagagtgccctactatgtcggacctatgattaccgctaaggaccagaaaaatcagtctggcgccgaatttgcgtggatgatccgcaaggagcccggcaacattacaccgtggaatttcgatcagaaagtggaccggatggctacggccaaccaatttatcaagagaatgaccacaaccgacacatacctcctgggggaagatgttctgcctgcccagtccctcctgtatcagaaattcgaggtgcttaatgagctgaacaagatccggattgaccataaacccatcagcattgaacagaagcaacagatctttaacgatctcttcaagcagtttaaaaatgtcaccattaagcatctgcaggactacctggtgtctcaaggacagtatagcaaacgccctcttatcgagggcctcgctgatgaaaagagattcaactcctctctgagcacgtactccgacctgtgcgggatctttggagccaaactcgtcgaggaaaatgatcggcaggaggacctggagaagattatcgaatggagcacaattttcgaggataagaaaatctatagagctaaacttaacgacctgacctggctcaccgatgaccaaaaagaaaagctggccacaaaacgctaccagggctgggggcggctgtctagaaaacttctcgtgggactgaaaaattccgagcaccgcaacattatggatatcctgtggatcaccaatgaaaacttcatgcagattcaggcggagcccgactttgccaagctcgttacagacgctaataagggcatgctggagaagacggatagccaagacgtgatcaacgatctttacacctctccccagaataagaaagccattagacagatcctgctcgtcgtgcacgacattcagaacgctatgcacggccaagcccctgcgaagatccatgttgagttcgcccgcggggaagaacggaatccgagacggtccgtgcagcgccagagacaggtcgaggctgcctatgaaaaggtgagcaacgagctggtgtccgctaaagttcggcaagagtttaaggaagccatcaataacaaacgcgatttcaaggacagactgtttctttacttcatgcagggaggcattgatatctatacagggaaacagctcaacattgaccaactgtctagctaccagatcgatcacattctgccccaggcctttgtcaaggacgattccctcaccaatcgggtgctgacaaacgagaatcaggtgaaagctgactctgtccctatcgacattttcggaaagaagatgcttagcgtgtggggccgcatgaaagatcaagggctgatctccaagggcaaatatagaaacctcaccatgaatcccgaaaacatcagcgcgcatacggagaatggatttattaaccggcagctggttgagaccagacaggtgatcaagctggccgtcaatattcttgctgacgaatacggcgattctacacagatcatttccgtgaaagccgacctcagccaccaaatgcgcgaggatttcgaactgctgaagaaccgggacgttaatgattatcaccatgcctttgacgcttacctcgccgcgttcatcgggaactacctgcttaagagatatcctaaactggagtcttactttgtgtatggagatttcaagaaattcacccagaaggaaacaaaaatgcgccggtttaatttcatctacgacctcaagcactgtgatcaggtcgtgaacaaggagaccggcgagattctgtggacgaaagacgaagatatcaagtatattagacattcctttgcttacaaaaagatcctggttagccacgaggtgcgcgaaaaacggggagccctttataatcagacaatttacaaggccaaggacgacaaagggtctggccaagggagcaagaaactgatcagaatcaaggatgacaaagagaccaagatttacggcggatattccggcaagagcctcgcttacatgacaatcgtccagattaccaaaaagaacaaagtgtcttatcgcgtgatcgggattcccaccctggccctcgcgcggctgaacaaacttgaaaatgattccacagagaacaatggagagctgtacaagatcattaagccgcagttcacgcactataaagtcgacaagaagaacggcgaaatcatcgagaccacagatgactttaaaattgttgtgagcaaggtgagattccagcaactcatcgatgacgctgggcagtttttcatgctggcctccgatacctacaaaaataacgcccagcaactggtcatttctaataacgctcttaaggccatcaataacacaaatattaccgactgccctcgggatgacctggaacgcctcgataacctgagactcgacagcgcttttgacgagatcgtgaaaaagatggataagtatttctccgcctacgacgcgaataactttcgggaaaagatccgcaattctaacctgattttctaccagcttcccgttgaggatcagtgggagaataacaagatcacggaactgggaaaaagaacagtgctcacccggattctgcagggcctgcatgccaacgctaccacaaccgacatgagcatcttcaagattaaaacaccttttgggcaacttagacagcgctccggcatctctctgagcgagaatgcccagctcatctatcagtcccccacgggactgttcgaacggagagtccaactcaacaagattaagtga

SEQ ID NO: 4357 - RNA, 4137 nt, synthetic construct
  misc_feature 1..4137: note = Cas9 variant
  source 1..4137: mol_type = other RNA
atgaccaacgagaagtacagcatcggcctggacattgggacatcctctatcggattcgccgtggtcaatgataacaatagagttattcgggtgaaaggcaagaacgctatcggggtgcgcctctttgacgaaggaaaagccgcggctgatagacggagcttccgcacgaccagacggcgcctgtccagacggcgctggagacttaagctgctccgggagatttttgacgcctatatcacacccgtcgatgaagccttctttatccgcctgaaagagtctaatcttagccctaaggactccaagaaacagtactctggcgatattctgttcaacgacagaagcgataaggacttttatgaaaaatacccgaccatctatcacctccggaatgctctgatgacagagcatcgcaagttcgatgtgagagagatttacctggccatccaccatattatgaaatttcgggggcacttcctcaacgctacccccgccaataactttaaggttggaagactgaatcttgaagagaagttcgaggaactgaacgacatctatcaacgcgtgtttcctgatgagtccattgagttccggacagacaatctcgaacagatcaaagaagtcctgcttgacaacaagagaagccgcgcggatcggcagagaaccctggtgtctgacatctaccagtccagcgaggataaagacattgaaaagcgcaataaagccgttgctacggagatcctcaaggcctctctgggcaacaaagctaagctgaacgtgattaccaatgtcgaggtggataaggaagccgcgaaagagtggtccatcacattcgacagcgaatctattgatgacgatctcgccaagatcgagggccaaatgaccgacgatgggcatgaaatcattgaggtgctgcggtccctttacagcggaatcacactgtccgctattgtccccgagaaccacaccctctctcagagcatggttgccaaatatgacctgcacaaggaccatcttaaactgtttaagaagctcatcaatggcatgacggatacaaagaaggctaaaaacctgagagccgcctacgacgggtatattgatggagtgaagggcaaagtgctgcctcaggaagacttctacaagcaggtccaagtgaatctcgatgactccgctgaggcgaacgaaatccagacctatatcgatcaggacatttttatgcccaagcagcgcacaaaagccaatgggagcatccctcaccaactgcagcagcaagagcttgatcagattatcgaaaaccagaaggcttactatccgtggctggccgagctcaatcccaaccctgacaaaaagcggcagcaactggccaaatacaaacttgatgagctggttaccttcagagtgccctactatgtcggacctatgattaccgctaaggaccagaaaaatcagtctggcgccgaatttgcgtggatgatccgcaaggagcccggcaacattacaccgtggaatttcgatcagaaagtggaccggatggctacggccaaccaatttatcaagagaatgaccacaaccgacacatacctcctgggggaagatgttctgcctgcccagtccctcctgtatcagaaattcgaggtgcttaatgagctgaacaagatccggattgaccataaacccatcagcattgaacagaagcaacagatctttaacgatctcttcaagcagtttaaaaatgtcaccattaagcatctgcaggactacctggtgtctcaaggacagtatagcaaacgccctcttatcgagggcctcgctgatgaaaagagattcaactcctctctgagcacgtactccgacctgtgcgggatctttggagccaaactcgtcgaggaaaatgatcggcaggaggacctggagaagattatcgaatggagcacaattttcgaggataagaaaatctatagagctaaacttaacgacctgacctggctcaccgatgaccaaaaagaaaagctggccacaaaacgctaccagggctgggggcggctgtctagaaaacttctcgtgggactgaaaaattccgagcaccgcaacattatggatatcctgtggatcaccaatgaaaacttcatgcagattcaggcggagcccgactttgccaagctcgttacagacgctaataagggcatgctggagaagacggatagccaagacgtgatcaacgatctttacacctctccccagaataagaaagccattagacagatcctgctcgtcgtgcacgacattcagaacgctatgcacggccaagcccctgcgaagatccatgttgagttcgcccgcggggaagaacggaatccgagacggtccgtgcagcgccagagacaggtcgaggctgcctatgaaaaggtgagcaacgagctggtgtccgctaaagttcggcaagagtttaaggaagccatcaataacaaacgcgatttcaaggacagactgtttctttacttcatgcagggaggcattgatatctatacagggaaacagctcaacattgaccaactgtctagctaccagatcgatcacattctgccccaggcctttgtcaaggacgattccctcaccaatcgggtgctgacaaacgagaatcaggtgaaagctgactctgtccctatcgacattttcggaaagaagatgcttagcgtgtggggccgcatgaaagatcaagggctgatctccaagggcaaatatagaaacctcaccatgaatcccgaaaacatcagcgcgcatacggagaatggatttattaaccggcagctggttgagaccagacaggtgatcaagctggccgtcaatattcttgctgacgaatacggcgattctacacagatcatttccgtgaaagccgacctcagccaccaaatgcgcgaggatttcgaactgctgaagaaccgggacgttaatgattatcaccatgcctttgacgcttacctcgccgcgttcatcgggaactacctgcttaagagatatcctaaactggagtcttactttgtgtatggagatttcaagaaattcacccagaaggaaacaaaaatgcgccggtttaatttcatctacgacctcaagcactgtgatcaggtcgtgaacaaggagaccggcgagattctgtggacgaaagacgaagatatcaagtatattagacatctgtttgcttacaaaaagatccttgtttcccacgaggtgcgcgaaaaacggggagccctgtataatcagacaatttacaaggccaaggacgacaaagggagcggccaagggtctaagaaactcatcagaatcaaggatgacaaagagaccaagatttacggcggatatagcggcaagtccctggcttacatgacaatcgtccagattaccaaaaagaacaaagtgagctatcgcgtgatcgggattcccaccctcgccctggcgcggcttaacaagctggaaaatgattctacagagaacaatggagagctctacaaaatcattaagccgcagttcacgcactataaagtcgacaagaagaacggcgaaatcatcgagaccacagatgactttaaaattgttgtgtccaaggtgagattccagcaactgatcgatgacgctgggcagtttttcatgctggccagcgatacctacaaaaataacgcccagcaacttgtcatttccaataacgctctgaaggccatcaataacacaaatattaccgactgccctcgggatgacctcgaacgcctggataacctcagactggactctgcttttgacgagatcgtgaaaaagatggataagtatttcagcgcctacgacgcgaataactttcgggaaaagatccgcaattccaaccttattttctaccagctgcccgttgaggatcagtgggagaataacaagatcacggaactcggaaaaagaacagtgctgacccggattctgcagggccttcatgccaacgctaccacaaccgacatgtctatcttcaagattaaaacaccttttgggcaactgagacagcgcagcggcatctccctctctgagaatgcccagctgatctatcagagccccacgggactcttcgaacggagagtccaactgaacaagattaagtga

SEQ ID NO: 4358 - RNA, 4140 nt, synthetic construct
  misc_feature 1..4140: note = Cas9 variant
  source 1..4140: mol_type = other RNA
atgaagcagatcctgggcctcgacctggggaccacaagcattggatgggcccttgtgagagaggctgaaaacaaagatgagcaatcctctatcgtccggattggcgttcgcgtgaatcccctgacgagcgacgaacagaagaacttcgagcaggggaaatccatcaccacaaatgccgatagaaccctcaagcggtctatgcgcagaaacctgcagcggtacaaacttcgcagagaccacctgaaggattgcctccaaaagaatggaattatcacagacaaagcggtgctgagcgaaaacggcaattataccacatttcagacctactatctgcgggctaaggccgtcaacgagaaaatctccctcgaggagttcgcccgcgtgctgcttatgctgaataagaaaagagggtacaagtctagccggaagatgaaatccgctgatgaaggacagctcattgacggcatgagcgttgccaagcgcctgtataacgataatatcacgcctggccagtacgtgctttctctgctcgaagaggggagaaaatatattccggacttttaccggtccgatctgctggacgagctcgataagatctggaccttccaacagtgtttttaccccgaaattctgacacctgagtgccgcaaacttatcgctggaaagggcaaacaggccaccgcgaagattttcctggggaagtataaaatctacacagccgacaacaagagcaaagacaagagactccaggcttatcaatggcgggtcgaagccctgtctggacagcttcccatcgaggtggttgcttttgtggtctgtgaaattaatggcgccatccaggcgtccagcgggtacctgggagccatttctgatagatccaaagagctctatttcgagggcctgaccgtgggccaatacctggtgaagcagctcgaaaagaaccctgacacgagcctgaaaaataaggtcttttatcgccaggattaccttaacgagttcgaaaagatctgggagaagcaggctgaataccatacagagctgacaccccaactcaaaaaggaggttcgggacattatcatcttttatcagagaaccctgaagtcccagaaagggcttgtgggattctgcgaatttgagtctcgccagattgaagtgatgatcgatggcaagctgaaaaagaaaaccgtcgggtgtcgggtgtgccctaagagctccccgctgttccaagagtacaagatttggcacaacctcaataacctgaaaatcgttgaaaaggagctcggaaaaagcagattcctgaatcaggacgagaaggaatctctttttcaggagctgaacattaaagaaaagctctccaaaaccgatatcctgaagctgctttgtctcaaggccaaagagttcgacctgaattttgagaaggtggaaggcaaccgcacacaggctgagctgttccgggcctatcaagccatcattgaaatgagcgggaatggagattacgacttttctaaaatgacgagctccgagatccaggataccgtcacaggcgtgttcagaggcctcgggtataacaccgacattctgtcttttgacgctgaaaaggaggagaaaacattcgataagcagcccatgtaccttctgtggcatctcctgtatagctacgaaggagactccagcgataccggcaataaggcgctgatcacgaaaattaagaaactttgcgggtttgagtctgaagagtacgcccgcatcctcacagacgttaccttccagtccgaatatggaaacctgagcaccaaggctattcggagaatcctgccttttatgaaaaagggctctgagtactccgaggcctgtcgccacgccgggtatcggcatagcgaaagatccctcacaaaggaggaactggataaaaaggtgtacaaagaccaccttgagctgctcccccgcaattctctgcggaaccctgtcgtggaaaagatcctgaatcaaatgattcacgtcgtgaacaccgttgtggatacatatggcaaacccgacgagatcagaattgagcttgctcgggaactcaaaaagagcgccaaagagagagatgaaatgacggcgtccatcaataagaccgctgccgagcataaaaagtactgcgaggtcctgcagaaagagttcggatttacacacgtgtctcgcaacgacattatccggtataagctgtacctcgaactggaaaacaatggctacaaaaccctttatagcgatacatacatcccgagagagaagctgttctccaaggagttcgacattgaacatatcattcctcagagcaaactctttgatgactctttctccaacaagaccctggagtgtcgcagcgttaatatcgaaaaatctaacgacacggcctatgattacgtgctgaataagtatggggagcaaggcattcttgactacaaaaacagaatcgaaaatctctataaggattccaagatcagccggaccaaataccagaagctgatgatgaaaaactctgacattagcggaaattttatcgagcgcgaactgagagattcccagtacattgctaagaaagcccgggagatcctcgaggaactggtcaagttcgtggtgcccacaaccgggagcgttacagctcgccttagagaggactggcagctggtcgatgtgatgcaagaactcaactggaagaaatatgacaagctgggactgaccgatgtgcggtacgacaaagatggccgcgagattagatatatcaaggactggtctaaacggaatgatcaccgccaccatgccatggacgcgcttacgatcgcctttacaaagagatccattatccagtacctgaacaatctcaacgctaagagcgacaaatccgggtctatttatgccatcgaacagaaggagctgttccgggataaaagaggcaagctcaaatttattcctcccatgccctgcaatatcttccgcgctgaggccaagcggcacctggaaaacgtccttgtgagcgttaaggcgaaaaacaaggtggtcacccctaatattaacagatccaaaggaaagaatggcatcaacaaaaagatccagctgacaccgcgcgggcaactccataatgagaccatttacggatctatgaaacggtatgaaaccaagtgggagaagatcggcagcgggtttgacgagagacagattgccaaagtggctaacaagaaattccgcgaagccctgctgtcccggcttgctgagtttggaaatgatccccagaaggccttcacaggcaaaaactctctggaaaagaatcctctctacgttgacgagctgcacacgcagaaggtgcccgaaaaagtcaagatcgtgaccctcgagaacctgtacacaattagaaaagagatcacccctgatcttaagatcgacaaagttgtggatgccggggtccgccgggtgctgcaagaaagactcgacgagtttgatgacgatagcaagaaggctttctccaatctggacgaaaaccccatttggctgaatggcaaaaagatgaaacgggtgacaatcatgggagtcagcaacgcggttccgcttcatgacaagaaagattataagggcaatctggtgttcgactctaaggggcgcaaacagcctgtggattttgtcaacaccggatccaaccaccacgtggccatttacagagacgagagcggcgaactccaggatatcgttgtgtctttctatgaggctacgacacggtccaccctggggattcccgtcatcgacaaggagtacaaaaaggccgaaggatggaattttctcttcagcatgaaacaaaacgagtattttgtgttccctaatgaagagaccggctttaaccccaaggaaatcgatctgatgaatcctgacaactacacaaccatttctcccaatctttatcgcgttcagaaattctccaagtgcatgtacgggaacagctccgtgagagagtacgtctttcggcatcacctggagacaagcgtgaatgattctaagggcctgaaaaacatcgcctataagaatgttaaaagcctcgtgtacctggaaggaattgtcaaggtgagaatcaaccatattggccagatcgtgtccgtcggggagtattga

SEQ ID NO: 4359 - RNA, 4140 nt, synthetic construct
  misc_feature 1..4140: note = Cas9 variant
  source 1..4140: mol_type = other RNA
atgagaatcgacaacggcctggaggaactcaaggtgaataaccggatttacaatatcgggctggatattggaaccagctccgtcggcttcgccgttacagacgctcaggataaacttgtgcgcgtgaaggggaaaacggccatcggagtcagactgtttgaggaaggccacaccgcggctgagcggcgcgggttcagaacaacccggcgcagactctctcggcgcaagtggagaattaacctgcttaatcaaatctttgaaccctatatcagcgagattgaccctacattctttgcccggctgaaaaactcctctctcgccggaaaggataagaaattcgagggcagcctgctgtttccggaccgcaccgattaccagttctataaggacaatcccacaatgtaccatctcagaaaacacctgatggaaaaggatcggcagtttgaccttcgcgagatctatctggctatgcatcacattatcaaatacagaggcaacttcctcaataccacgcctatgaaccattttaagaatgaagagattgatttctccgccctgttttctcggcttaacgagctgtatcaggaaatcgacgatgagaatattttcgaactcaacatcgagaatgtggacgaaatcaagaaaattctgctgaaccacgacctcttcaagatggagaaacaaaagcaggttgctaaactgcttaacgtggataccgacgataagcagctgaaaaaggagaatacagccctcgcgagcaacttttccaaggccatcctggggtacaaattcaatcttgctctggtcaccaagattcccgaccaggataaaaaggaatggacaatcagcctcggagacgaggattttgacgatagactggacaacgtgcctgttgccctgaccgaatctcaactcgaggtggtcgaagtgctgcactccattttcaatagcatctctcttaacgagatcgtggagaatggcgaaacgctgtccagcgctatggtccgcaaatacaacgatcataagcacgacctcaagctgcttaaaaatgttatgacaaccctggaggaccggaagaaagccaagaaaattcaggggatctataacgtgtttgtgggaaaggatacagacctcatttctgataaggacaaaaataagtacaaagataaggacgagttctataaagaaatccagaagaacctggataattccagcgacgcggaagagattatcaagagaatcaaacaggatcaatttctgcccaagcagcgcacctccaaaaacggcgtcattcctcatcagctccaccaacgggagctggaccttatcattgaaaatcaggccaagtactatccgttcctgaaagaggctaaccccaacaagaaaagactcaagcaggccaagtacaaactggatgaactgatcgcttttaagattccttattacatcgggcccacctctggagccgagaatagcgacttctcctggcttaaacgcaagaaagatggccagattacaccttggaactttgacgagaaggtggaccggatcgaaagcgccaatagattcatccgccggatgacgaccaaggatacatacctcctggctgaggacgttctgcccctcgaatctctgatttatgagaaatactccgtgcttaacgaactgaataacgtcagaatcaatcgccaaaagctcagcgtgaacgataaacaggacatttataatgagctgtttaagaactctaaaaccgttacactgaagcagcttcagaagtacttcgaggtgaccaaaaagctcaaaacggtcgtggtcgaaggcctggcggatccgaagaaattcctgagcaatctcgggacatatcacgactttaagctgatcttcggagatattgtggacgatcctgagtaccaaaccgaccttgaaaacatcatcgagtggtccaccatttttgaagatcggggcatcttcaattctaagctgaacgagattacatggctcaccgacgagcagagaaagaaggttctgagcaaacggtatcaggggtggggacgcttttccaagaaactgcttgtgggcctcaagaatagccaggggaactctatcctggatgaactgtggaacacaaatctcaacttcatgcaactgcagtcccaggacgactttgccgagcttattcatgctgaaaatgccaaacagttcaaggccaacgatcccgacaatccttggaacggaatcgatgctatcctgaatgacgcctacacgagcccccaaaacaagaaagcgattagacaggtcgtgaaggttgtgcaggatatcgagaaagctatgggcaataagccccagaaaattgccatcgaatttacccggtctgccgacaagaaccctagacgcacagattcccggattaagagactcagcgacatctacaaagaggctgccgagaaggtcgtgggcgaatccctgaaactggagcttaatgaatatctcacctctaagaaaaagatgacagataagatgtacctgtatttcacccaactggggacggacatctacaccggcaaaaagattgatatcgaccagctcaacaattatgacattgatcacgtgctgccgcagagctttcttaaagacgattccctggacaaccgcgttctcacaaatagatctgataacagcgagaagtccgacaccgtccccctgcataaattcggagctaagatggggaacttttggcggcaactggccgatgagggacttatcacaaagcgcaaatacaagaatctgaccacggaccctgcgacaattgataaatataccatccagggcttcattagacggcagctcgtggaaacaagccaggtgatcaagctgaccgccaacatcctcgggggcctgtaccccgaggaaaccgagattcttgaaatccctgctaaactgaatcaccaattccgcgacatgtttgatctcgtcaaggtgagagaggttaacgactaccatcacgccttcgatgcttatattacagtgtttgtcggaaatttcctgtaccggcgctatcccaagctgagatcttactttgtgtatggcgacttcaaaaagctgaacaaaacggacgatgacatccggaagtttaatttccttaacctctttaataaagataaggttgaggacaacgaaaccgatgagattctgtggtccaaagccgaaagcatccgcgacatcaagaatatttacaactataagttcatgctcgtgtctagagaggtctacacacggcacggggcgatgtttaatcagaccatctacccggcctccaaaaacgatagcaagaaactgattcctatcaagaaaggaaaggacacagctatttatggcgggtactctggaaataccgatgcctatatggctatcgtggccgttgaagacaagaaaggcgagaagttcaaagtggtcggggtgcccacgagagccgtgagccgccttgagcagctggctgcggatgaccatgatcagtacctcacagccctgcacgacgtcctgaagcctaacttcaccaaaatcaagaccaatcggaagacaaaagctaaggaagaggttaccacaccctttcgcattcttgtgggcaaagtgggatatagacaactgatccaggacggccaggtcaagatgatgctcgggtccagcgcctacaaatataacgccaagcaactggtgctctctgaaaagtccctgaaagttattaagaacaataaaaagtacaaccctgatgacgagaatcaggatcttatcgacgtgtacgatgaaattctgggagtcgtgaaccgggctttcaatctgtatgacacgaacggctttcgcaaaaagctcaatgataacagagttaaattcgtggagctgcccatcaataacatttttgacgggaccaaacttgtccagatgggaaagcgggccgtgctgacacagatcctcaatggcctgcatgcgaacgctgccctcggggatctgaaagcccttggcatcagcaccccgttcggaaagatgcaatccaaatctggcattcctctgagcatggacgcttccctggtttaccagtctcccacagggctctttgagagaaagctgaatcttagcgatctgtga

SEQ ID NO: 4360 - RNA, 4140 nt, synthetic construct
  misc_feature 1..4140: note = Cas9 variant
  source 1..4140: mol_type = other RNA
atgaccaagaaaaactacagcatcggcctggacattgggacaaattccgtgggatgggccgtcatcacggatgactataaggttcccgctaaaaagatgaaagtgctcggcaacaccgataagaagtacattaaaaagaatctgcttggggcccttctcttcgactctggagagacagcggaagctaccagactgaaacggacagcccgcagacggtatacccgcagaaagaaccggcttcgctacctgcaggagatctttgccgatgaaatggctaaagtggacgagagcttctttcaaagactcgatgaatccttcctgcggtgggacgatgacaataagaagctgggccgctatcctatttttgggaacaaagccgatgtcgtgaagtaccaccaggagttcccgacaatctatcatctcagaaaacacctggctgactctagcgagaaggccgatcttcggctggtttacctcgcgctggcccatatgatcaaatttcgcggacacttccttattgaaggcgagctgaatgctgaaaacaccgacgtgcagaagatcttttccgacttcgtcagagtgtacgatcggacgtttgacgattctcatctcagcgagattaccgttgacgccgcttccatcctgacagagaaaattagcaagtctcgcagactggaaaatctcatcaagtattaccccaccgagaaaaagaacacactgttcggcaatcttattgccctggcgctcgggctgcagcctaactttaaaatgaatttcaagctgtccgaagatgccaaactgcaattcagcaaggactcttataacgaggatctcgaggaactgctgggaaagatcggcgacgattacgctgacctctttacctccgccaaaaatctgtatgatgctatccttctgagcgggattctcacggtggacgacaactctacaaaggctcccctgtccgccagcatgatcaaacggtacgccgagcaccacgaagatcttgagaagctgaaagaatttattaaggcgaacaagtccgagctctatcatgacatctttaaagatgaaaccaagaatggatacgccggctacattgagaacggggtcaaacaggacgagttctataagtacctgaaaaatacactgtctaagatcgctggaagcgattattttctcgacaagatcgaaagagaggatttcctgcgcaaacagcggacctttgacaacggctccattcctcaccagatccatcttcaagaaatgcacgccattctgagacgccagggcgattactatcccttcctcaaggagaatcaggaccggatcgaaaagattctgacctttagaatcccttactatgtggggccgctggcccgcaaggatagccggttctcttgggctgagtaccactccgacgagaaaatcacaccctggaactttgataaggtgattgacaaagaaaagagcgccgagaagttcatcacgagaatgacccttaatgacctctacctgcctgaagagaaagtcctgcccaagcattctcacgtttatgagacatacgcggtgtataacgaactcaccaaaattaagtacgtgaatgagcagggaaaagatagctttttcgactccaacatgaagcaagaaatcttcgatcatgtctttaaggagaatcgcaaagtgacaaaggaaaaactgcttaactatctgaataaggagttccctgagtaccggattaaagacctcatcggcctggataaggaaaacaagtcttttaatgctagcctggggacctatcacgaccttaaaaagattctcgataaagccttcctggacgataaggttaacgaggaagtgatcgaggacatcattaaaacgctgacactctttgaagataaggacatgatccatgagagactgcagaagtactccgatattttcaccgccgaccagcttaaaaagctggagcgccggcactacaccggatggggcagactcagctataaactgatcaacgggattcggaataaggaaaacaataaaacaatcctggactaccttatcgatgacggatctgctaaccgcaattttatgcaactcattaacgatgacaccctgcccttcaagcagatcattcagaaatcccaggtcgtgggcgatgttgacgatatcgaggccgtggtccacgacctgccgggcagccctgctattaagaaggggatcctccaatctgtgaaaatcgtcgatgaactggtgaaggttatgggagacaatcccgataacattgtgatcgagatggccagagaaaatcagacaacgaaccggggcagatcccagagccagcaacgccttaaaaagctgcaaaattccctcaaagagctggggtctaacattctgaatgaggaaaagcctagctatatcgaggacaaggtcgaaaactcccatcttcagaatgaccagctctttctgtactatattcagaacggaaaagatatgtacaccggcgacgagctggatatcgaccacctctctgattatgacatcgatcatattatcccccaggcgttcattaaggacgatagcatcgacaaccgggtgctgacatccagcgccaaaaatagagggaagtctgatgacgttccctcccttgatattgtgcgcgctagaaaagccgagtgggtccggctgtacaagagcggcctcatctctaagcgcaaatttgacaacctgaccaaggctgaaagaggaggcctgacagaggccgacaaagcggggttcattaagcggcagcttgtggaaacccgccagatcacgaaacacgtggcccaaatcctggatgctagatttaataccgagtccgacgaaaacgataaggttattcgggacgtcaaggtgatcacactcaaaagcaatctggtgtctcagttccgcaaggatttcgagttttacaaagtcagagagattaacgactatcaccatgcccacgatgcttacctcaatgccgtggttggaaccgccctgcttaagaaatatcctaagctggctagcgagttcgtgtacggcgaatataagaaatacgacgtccataagctcatcgcgaaatccagcgatgaccactctgaaatggggaaggccacagctaaatatttcttctactccaacctgatgaactttttcaagcgggtgattcgctacagcaatggaaaagttatcgtgagaccggtcgtggagtattccaaggataccgaagacatcgcctgggataagaaatctaattttcggacgatttgcaaggttctgagctacccccaggtgaacatcgtcaaaaaggtggagacacaaaccggcgggttctccaaagagtctattcttcctaagggcgacagcgacaagctgatccccagaaaaacaaagaaagcctattgggataccaagaaatacggaggctttgactcccctaccgtggcttattctgtcttcgttgtggccgatgtggaaaaggggaaggcgaaaaagctcaaaacagtcaaggagctggtgggaattagcatcatggaacgctcctttttcgaggaaaatcccgttgagttcctcgagaacaaaggctaccataatatccgggaagacaagctgattaaacttccgaaatatagcctgtttgagttcgaagggggaaagagacgcctcctggcttctgcctccgagctgcagaaaggcaacgagatggtgatccctgggcaccttgtcaagctgctctaccacgcccagcggattaacagctttaattctacgaaatacctggattatgtgtccgctcataagaaagagttcgaaaaggttctcagctgtgtggaagactttgccaacctgtacgtcgatgtggagaagaatctttctaaaatcagagcggttgctgactccatggataacttcagcattgaagagatctccaatagctttattaacctgctgaccctcacagccctgggcgcccccgctgacttcaattttcttggagagaagatccctcgcaaacggtatacctctacaaaggaatgcctgaacgccaccctcatccaccagagcattacgggcctgtacgagacaagaatcgatctctccaaaattggggaagagtga

SEQ ID NO: 4361 - RNA, 4143 nt, synthetic construct
  misc_feature 1..4143: note = Cas9 variant
  source 1..4143: mol_type = other RNA
atgggcaagtacaacctggggctcgacatcggaaccaatagcgtgggctgggccgtcgttgatgagaacaatcagattgtgaaaaagggagggaaagctctgtggggcgtgagaatgttcgacgaagcccaatccgcgaaggagacacggatctatcgcaactctagacggcgcattgtcagacggaatcagcgccttctgctcctgcagaaagaattttacgatgagatcattaaggtggaccagacgttctttcaaagacttaaggatagcttctttaaaaaggaagacaaactgaacaagaataactataccttctttgatgacgatatcacagaccgggagtacttcaaaaagtttcccaccatctatcacctccgctcccatctgctgtacaatgatgagaagattgacatcagaatgctctatctggcccttcaccatattgttaaataccgggggcacttcctggattctggagaagtgaacgagagcaatttttccaagatcaaagacgtcctcgacacattcaacaataagatgtctgaaatgagcctggagtttgaggataacgaagactacttctgcaaaattgagttcgatgaaaattttgagaacaaacttaaggacatcatgctgtcccagctcagcaagaaggaaaaacgccaggagctgattgatctgttcaaggtggacaaaaagtctctcgttaacgagctgcttatcgaactgctcgtgaataaaaaggtcaagctgaactcccttagcatcaccaatggcaaaaagtatgaggtgtgtgaaattgattttgagaaagaggaactgttcgagaagctcgaagacgctaaaaagatcattacagagctgtttgatatcctggacgaaattgtgaacatcaagaaaatcgtcgattactattacgttctcaagattatcggcgacaatgagtatctgtctgaagccatggtgaaaaagtacgacaaacatgataaggaccttagagagctgaagtccttcattaaaacctattgccctaacaagtactacgagtgttttcggaaaacgagcaatccgaacctctgcaattatcccaagtacgtggggatcaactctgtcaataaaaagattgaacgcttcgctcactgtaaaaaggaggaattttataagtacctgaaatcccttttcaacaccatcaaggatgagaatgccaaactgaagatcgacctctttcagaaagatatggagaacgacgatttcctgaatagacaaaacagcaaccacaattcctctattcctatgcagctgaacttttgcgaactcaagaagatcctggagaatcagagcaaatattaccccttccttatgctgaagaactccgacggatatagcacatctgatcggattatcgctattttcaaatacaagatcccttactatgtgggccccctcaataaaaactccaagtacagctggctggttaagaaatctaatgaaaacattaccccttggaattatgagaaggtgatcgacctggatgccagcgcgaaagaatttatccagagaatgcaaaacaagtgtacataccttaaaggggagaatgactattgcctcccgaagaagtccattctgttctctgagtacaactgtctgcagtatctcaatcgcctgatcattaacggagcccttatcgaaaataaactgaagaacgagatttacgaaaacatctttctctgctacaaaaagcccaccaaaaagagcatcgtcgagtatctgaaaacgaattacaactatgatgaaacaaccctgaagtccaatattcttgaggtgaactgtgacatgagctcttacatccagttcaaggagatttatggcgaagactttgagcaaaatctcaacatcgttgaagatattatcaaagacatcacaattttcgaggataagaaaatcctggaaaagcggctgagagagatttaccatctctccgaggacaaagtgcagaagatcaaggggctgaattataaaggatacgctacccttagcaagcactttctgaacaatttctactctgtcaacgaagagaccggcgaaatttatggccctatcatccagattatgcgcgatacaaattacaacctccagcaagtgatctataatgaccggtacaactttatgaaagccattgataagtataataaaaagaacctggacacggagaagaaactgaacgtctccgatttcatcgacgagtacatttatgtgagccccatcatgaagagatcccttattcagtcttacaatatcatccaggaactcgagaaaattctgggggaaagcatctccaagtactatattgagtgcgctcgcgttcggtctaacagcaaagatgtgatcaattccagataccgccagctgagcgaactctataaggactgcgagcatcaagtctctgatatttccaagaactacatcaatatcaacaaactgaagaaacagcttgaggacaataagaacgaactgcgggccgacaaactctatctgtactttacccagttcggaaagtgtatgtatacactgaaggatattgaccttgatgacgtgtttctcggcaaatacgatatcgaccacatttaccctcagagcctgatcaaggatgactctctgaataacagagttctcgcgtccaaagagaagaatgggaaaaaggataaccaattcattttcaatatccccgaatttctgccgaaaaacgccgagcttttctataagaagctgctcgaatgcaaactgatcaccaaggagaaataccgccggctgacaatgaagaaaattgacgatgacgagcttgacatctttgtgaatagacagctggtcgctaccaaccagagcgtgaagggactcgtggatgttctgaagatttataaaggcgtcaagcctacgaatatcgtgtactctaaagccgtgaacattagcgacttccggaacaattataacctctacaagtcccgcacagctaataactatcaccatgcccacgatgcctacctgaatgtcgtgatcgggaaagctcttgacgtttactatcagtgtaactactttcaaaattataaggatgtgattaagctgaaagacagaaacatcaccatcaatcccgaaattatcctcagcaagaaccggtacgtcaatagaaacggagagaaaaaggtgatttgggatctggacaataccctgaaacttatcaagaacaatctgtataaccgcttcgatattacagaaaccatcatgacacggaagtctaacaaaatgttttccaagagctccatctctcctgcgaaaaatagcaagaacctcattcccatcaaaacgtccgaccccagatgcaatgttctgaagtacggcggcattaaatctaacagctataatttctactgtatcgtggagctctacgataagaaggggaaaaagtcctatattctggaagccatccctaaaacccattctgacaaacttgaggagtacatcaagaacagcattgatgaaaagaatgtctccaactttaagatcattaataaaaacatcaagagcaatattatcattgagtataaaaagctgcgctacgtgatcacaggaaaatctggcaagtattacctcatcaagaacttcaaagacagaaatttttcctataacgctattaagaccatcaaatacattgaaaagtacaattatcagaaaaagtacgagatcccgttcgaggaaacaaaggagaaaattatcctggcccccaagaaaaaggacaccaaagaaatcagcctgacgcttgataactgccaggccctgctcgacgagattatctctctgttcaagaaagatatttataactacgacatcatttataagatcacctccaagctcgaagagaataaacaaaacctgacacttaccaatctgatcaaggttctgacagagattctcatcctgcttaaaaccaacgaacgggggacggctgatctgacactcattgacatgagcaaggataccggaacactgtgtatctctaaaaccctcaagcctggcatgaagtttatttccgagagccccaccgggtactatcgcaaaatcattttcgaagtgcctaatggcatctga

SEQ ID NO: 4362 - RNA, 4143 nt, synthetic construct
  misc_feature 1..4143: note = Cas9 variant
  source 1..4143: mol_type = other RNA
atgaagagaatcctgggcctcgacctggggaccacaagcattggatgggcccttgtgaacgaggctgaaaataacaatgaggcctcctctatcgtccggctgggcgttcgcgtgaaccccctcacggtggatgaaaaatctaatttcgagaaggggaaagcgattaccacaaacgctgacagacagctgcggcacggagcccgcatcaatcttcaaagatacaagctgcggcgccagaacctccatgattgcctgcagaaacagggctggctggggaccgaagccatgtatgaggagggaaaggcttccacatttgaaacctacaagctcagagccaaagctgccgaggaagagatttctctgcacgagttcgcgcgggtcctttttatgctgaataagaaacgcggctataagagcaacagaaaagccaataacaaggaagacggccaactcttcgatgggatgacaatcgctaagaaactgtacgaggaacatcttacccctgccgagtattccctgcagctcctgaataagggaaagaagtttacgcagggctactatcggtctgacctgaacgctgaactcgagcgcatctgggatgagcagaaaaagtactacccggaaattctgaccgacgagttcaaacaacagcttgaagggaagacaaagaccaatacaagcaaaatctttctggccaagtatggaatttactccgcggatctcaaaggcctggacagaaagttccagccccttaaatggcgggtggaggccctgcagcaacaggttgataaggaagtgctcgcttttgtcatcagcgacctgaaggggcagattgccaacacctctggactgctcggcgctatctccgatcgcagcaaagagctgtatttcaacaagcaaacggtgggccagtacctttgggcctctctggaggaaaatcctcacatttccatcaaaaacaagcccttttatagacaggactacctcgacgagttcgagaaaatctgggagacacaggccgcttttcataagcaactgacccctgaacttaagcaggagattcgggatatcattatcttctatcagagacccctgaaaagcaagaaatctctcatttccgtttgtgagctggaacagcgcaaggtgaaagcgacaatcgacgggaaggagaaggaaatcaccattggacctaaagtcgccccgaaaagctcccccgtgttccaagagtttcggatctggcagaatctgaacaatgtgctcctgattgataacgacaccaatgagaaaagacctcttgatgaagtcgagcgcaacctgctctacaaggaactgtctatcaaagctaagctgagcaaaacagaggcccttaagattctcaataagaaaggcaagcagtgggacctgaactaccgggaactggaggggaatagaacgcaggccatcctcttcgattgctataaccgcatcattaccctgacaggacacgaggaatgtgactttaaaaagatcaaggcttccgagattcggcactacgttagcaccatcttcaagaatcttggcttttctacagaaattctggatttcgacccctccctcaagaaacatgagctggaaaagcaacctatgtatcagctgtggcaccttctctacagctatgagtctgataacagcagaaccgggaatgagtccctgctgcgcaaactcgaaacgacatttggattccccgaggaatacgccaccgtgctgtgcgacgtggtctttgaggaagactatggcaacctttctgtgaaggcgatgcgggagatcctgccgtacctccaggctggcaacgattacagccaggcctgtgcctatgctgggtacaatcattccagacacagcctgaccaaagaggaactggaccaaaaggtttataaggagcgccttgaactcctgcctaaaaactctctgcggaatcccgtggtcgagaagattctcaaccagatgatcaatgtgatcaacgccattatcgatgagtacggaaaacctgacgaaattagaatcgagatggctcgggaactgaagtccagcgccgcggatcgcaaaaagacaacccacgccatttctcagggcaatgctgagaaccaaagaatccgggaaatccttgagaaggagttctccctgagctatatttccagaaatgacatcattaaatacaagctctatgaggaactggaacccaactactacaaaacactgtattctgatacgtacatcaccaaggacaaactttttagcaaggatttcgacattgagcatatcatccccaaagcccgcctctttgatgactccttctctaataagacactggaagctcggaacattaatctggaaaagagcaacaaaaccgccttcgattttatcaaggagaaatatggggaagacggagcggaggcctacaagaaaaagctcgacatgctgcttgaaaatgatgctatttccagacctaagtataacaacctgctccgcgccgaggctgacatcccgagcgatttcattaatagagacctgcggaacacacagtacatcgccaaaaaggcctgcgaaatcctgggcgagcttgttaaaaccgtgacgcccaccacagggaagattaccaatcgcctgagagaggattggcagctcgtcgacgtgatgaaagaactgaactttgagaagtatgaaaagctcggcctgacagagatcgtcgaggatcgggacggacgcaaaattaagagaatcaaagattggaccaagcggaatgaccaccgccatcacgctatggatgcgcttgccattgctttcacgaaaccttcttttatccagtacctgaacaatctcaacgccagatccaataagggcgacagcatttacgccatcgaaaacaaggagctgcattatgaagaggggaaactgcggttcaatgctcccatccctgtgaacgaatttcgcgccgaggcgaagagacacctttctgctattctggtttccatcaaagccaagaataaagtgatgacacaaaacgtcaataagattaagaccaaacacggaatcattaagaaaatccagctcacaccccggggcccgctgcataacgagaccatctacgggaccaagatgagacctattatcaaaatggtgaaggttggagccgctctcgatgaagccacaattaacaaagtgagctctcccgcgatccgcgaggctctgcttaagcggctgaatgaatatagcggcaacgccaagaaagccttcacggggaagaataccctcgagaaaaaccctatttacctgaatgctggcagaacaaagaccgtcccctccctggtgaaaacagtggaatgggagagctttcaccctacccgcaaacttatcgacaaggacctgaacgttgataaagtcgtggacaagggaatccgggagattctcaaagccagactggaagagttcaatggcgatgctaagaaagccttttctaacctcgaagagaatcccatctatctggacgaagcgaagaagattgcccttaaacgcgtgtccatcgagggggtcctgagcgctattccgctgcatacgctcaagaaccaggccggaaaacctatcacaggcaaggatgggaaacccgtgctgggaaattacgttcagacctccaacaatcaccacattgctttctattacgacgaggatggcaaccttcaagacaatgccgtgagctttttcgaagccgctgagagaaagagccaggggatccccgtcatcgataaggactacaaccgggataaaggctggcgcttcctgtttaccatgaagcagaatgaatatttcgtgtttcctaacgaggcgacaggattcattccgtccgaggttgacctcaccgacgaagccaactacggcatcatttctcccaatctgtatcgggtgcagaaagtcagcagaatcgataaggggacatccgcttctcgggactactggtttcgccatcacctcgagacgattctgaacgatgacgccaaacttaagaatctggccttcaaaagaatccggggactgctcgaactgaaggatatcattaaggtgcgcatcaacagcaccggcaaaattgttgctgtgggggagtatgactga

SEQ ID NO: 4363 - RNA, 4143 nt, synthetic construct
  misc_feature 1..4143: note = Cas9 variant
  source 1..4143: mol_type = other RNA
atgaagaaaatcctgggcctcgacctggggaccacaagcattggatgggcccttgtgaacgaggctgaaacggagtccgaaaagtctagcatcattagactgggcgtccgggttaatcccctcaccatcgatgagaaagggaacttcgaaaagggaaaagccattacaaccaattccgaccgccagcaaagacactctgcgcggatcaacctgcagcgctacaaacttagacggcagaatctgtgcgattgtctccagatcggcgggctgctgggaagcgagtccatgtatgaggaaggcaaggagtctacatttgaaacctacaagctccgcgctaaggccgccacagagaaagtggctctgcatgagttcgcccggattctttttatgctgaacaagaaaagaggctataagagcaatcgcaaggctaactccaaagaagacgggcaagccttcgatggaatgaccatcgcgaagaaactctacgaggaaaatctgacgcctgccgagtatagccttcagctgctcaacaagggcaaaaagttttctccgtcctactatagaagcgacctggaatctgagctgaatcggatttgggaggaacagaaaaagtactaccccgagatcctcaccgatgacttctatcagcaactggaagggaagacaaaagtgaacaccacaaagatttttcttgctaaatacggaatctataccgccgatctgaagggcctcgacaaaaagatgcagcctctgaagtggcgcattgaggctcttaataaacaggtcgataaggaagtgctgacgttcgttgtgtccgacctcaaagggcagatcgagaagacaagcggactgctgggcgagatctctgatagatccaaagaactctactttaacaagcaaaccgtcggccagtatgtgtgggccagcctgaaggagaatccccacgtttccattaaaaacaagcctttctaccggcaggactatcttgacgaatttgagaaaatctgggaaacacaagcggccttccataaggagctgacccccgagctcaaaaaggaaattcgcgatatcattatcttttaccagagacctctgaagtctaaaaaggggcttatcagcatttgcgagctggaacagaaaaaggagaaagtgatcattgagggaaaggaaaaagagatcctcattggctccaaggtcgctcccaagagctctccgatgtaccaggagttccggatctggcaaaacctgaataacgtgctgctcatcgacaccgaaattaatgaatccagacctctggatgaggaggaaaaagcccttctgtataacgagctcagcgtgcgcgctaagctgtctgaaacagaggccctgaaaacgatcaataagaaagggaagcactgggaccttaacttcaaggaactcgagggaaatcggacccaggccgtcctgtttgagtgttacaacagaattatcacacagaccggccatgaagagtgcaatttcaaaaagattagcgctgaagatatccgccactatgttgcgacaatttttaaaaacctggggttcaataccgacatcctcgattttaacccctccctggagaagcacgaacttgagaaacagcctatgtaccaactgtggcatctcctgtattcttacgagagcgacaagtcccggacgggaaatgaaagcctgcttaacaagctcgaggccaatttcggctttccccaggaatatgcttctgtgctggccgatgccacattcgaggacgattacggcaacatctccgtgaaagctattagaaagatcctgccgcacctccatgacgggtacgactatagcgaggcctgtgaacgcgcgggatacaaccactctgtccggtccctgaccaaagaggaacttgctcagaaggtgtataaagatagactggacctcctgcctaagaatagcctgcgcaaccccgttgtggagaagattcttaatcagatgatcaacgtcattaatgccatcatcgtggaatacggcaaacctgatgagattcggatcgagatggccagagaactcaagtcctctgctgccaaacgcgaggaacggaccaagagcattaaccaaaatgctgccgagaacaaaagaatcacagaaattctgcagaccgagtttgggctgtcctatatctctcggaatgacatcgttaagtacaaactctatcaggagctggaagcgaacggattcaagacactttacagcaatacgtacattcccaaggagaaactgttttccaaggatttcgacatcgaacacattgtgcccaaagcccgcctctttgatgacagcttcggcaacaagaccatcgaggctagagatgtcaatctggccaaatctaacaagacagctttcgactttgtgaaggaaaaatatggggagcagggcattgaggaatacaagaaaaagctggatacccttctcaaagagaatgccatctccagcggaaagtataagaaactgatgatgtctgaagcggacatcccttccgatttcattaaccgggacctgagaaacacacaatacatcgcccgcaaggcttatgagattctcggcgagctggtcaaaaccatcacgccgaccacagggaagattaccgaccggcttagagaagattggcagctgatcgacgtgatgaaagagctcaattttgaaaagtacgatcgcctgggactgacagaggttattgaagacagagatggccggaagatcaaacgcatcaaggactggaccaaaagaaacgatcatcggcaccatgccatggacgctcttacgattgccttcacaaagcccagctatatccagtacctgaataacctcaatgcccgctctgataaaagcgggtccatttacgctatcgagaccaaggagctgcacagagaaaacaatacactccggtttaacgcgcctatgcccctgaatgagttccgcaaggaagccaaaagacatcttagcgctattctggtgtctatcaaggccaaaaacaaggtcatgacccaaaatgtgaacaaaatcaagaccaaaaatggaattatcaagaaggttcagctcacacctcggggcgccctgcacaacgagacgatttatgggaccaaaatgcgccccatcattaagatggtgaaaatcggcgctgccctggacgaagcgacaatcaataaggtctccagcccgaccattagagaggcccttctgaaacggctcaacgagtactccggagatgctaagaaggcctttgctggcaaaaacgccatcacaaagaatcctatttatctgaacgcggaacacaccaaaacggctcccgccatggtgaagatcgtggagtgggaaatgtactatcctattagaaaactcatcacacccgacctgaagattgagaaggttatcgataatgggatcaaagaaattcttaagaaacgcctgaaggagttcggaggcgacgccaaaaaggctttttctaacctcgacgagtgccctatctacctggatgaagagaagaatattaccctgaaacgggtcagcatcgaaggggtgctttccgccattcccgtgcataccctgaagaaccacgctggaaaagagatcaaggacgaggatggcaaagccgtcctcggggactatgtgcagacatctaataaccatcacgttgcgatctaccaggatgccaagggcaatctgcaagacaacgtgattagcttctttgaagctgccgagagaaaatcccagaatgtcccgatcgtggataagaacctcaatcgcgacaagggatggcacttcctgtacaccatgaaacagaacgaatattttgttttccctaatgaggaaacaggcttcgtgccctctgagattgatcttatggacgagaacaattacgaaatgatcagccccaacctgtttcgggtccagacgatgtccagagtggattatgggaagaccattatccgcgagtacgttttccggaaccatctggaaacaatcctcaatgacaacctgaaacttaagggactggtgtttaaaaagattaagagcctcaaagctctggagggcatcgtcaaggtgagagtgaatgccattgggaaaatcgtcgccgttggagaatatgactga

SEQ ID NO: 4364 - RNA, 4143 nt, synthetic construct
  misc_feature 1..4143: note = Cas9 variant
  source 1..4143: mol_type = other RNA
atgaagaaaaagtacgccatcggcattgacatcgggaccaacagcgtgggatggtccgtcgttacagatgactataaagtgccctctaagaaaatgaaggtgttcggcaatacggagaagagatacattaaaaagaacctgctcgggaccctgctttttgatgaaggaaatacagctgagaaccggcgcctgaaaagaaccgcccggcgcagatatacacggcgcagaaatcggatcctctacctgcaggaaattttcgcggaggaaatcaacaagatcgacgatagctttttccaacgccttgacgattcctttctgattgtcgaggacaaacagggctctaagcaccctatcttcgggaccctccaggaggaaaaggagtatcataaacagtttccgacaatttaccacctgagaaagcaactggctgatagctcccagaaagccgacatccggctcatttatctggcccttgctcatatcattaagtaccgcggacacttcctgtttgaaggcgatctcaaatctgagaataaggacgtgcagcatctgttcaacgattttgttgagatgttcgacaaaaccgtggaaggcagctacctttccgagaatctgcccaacgtcgccgacgtgctcgttgaaaaggtgagcaagtctagacacctggagaatatcctgcactattttcctaacgagaaaaagaatggactcttcggaaacttcctggctcttgccctgggcctccagcccaattttaaaacgaacttcgaactggcggaggatgccaagatccaattttccaaagaaacctacgaggaagaccttgaggaactgctcgggaagattggagatgactatgctgatctgttcatcgccacaaagagcctgtacgacggcattctcctggctgggatcctttctaccacaaactccaccacgaaagcccctctgtctagctccatggtcaatcggtatgaggagcatcagaaggatctcgcgctgcttaaaaactttattcaccagaatctgagcgactcctacaaggaagtgttcaacgataaactcaaggacggatatgccggctacatcgagggcaagacaacccaggaaaatttttaccgcttcatcaaaaaggctattgagaaaatcgatgggtctaactattttattgaaaagatcgagagagaggacttcctgcggaaacaaagaacatttgacaatggaagcattccccatcagatccatctgcgcgaaatgcaggccatcattcggagacaagctaagttctacccttttctcgaggaaaaccaggataagatcgagaaaattctgaccttccgcatcccgtattacgtgggcccccttgcccgggggaagtccgagttcgcctggctgaatagaaaaagcgacgaaaagattcgcccttggaactttgatgagatggtcgacaaagaaacctctgctgagaatttcatcacacggatgacgaactatgatcagtacctccccgaccagaaggttctgcctaaacactccctgctttatgaaaagtttgcggtgtacaatgagctcaccaaggtgagatacgtcacagagcaaggaaagagcttctttttcgatgccaacatgaaacaggaaatttttgaccgcaccttcaaagtgtatcggaaggttacaaaagagaagctgatggattttctgtctaaggaatttgacgagtttagaatcgtggatctcctgggccttgacaaagataataagagcttcaacgcttccctggggacctaccacgacctcaaaaagatcgtctctgaagactttctggataacagcgagaatgaggacattctggaaaacgtggttcttacgctcacactgttcgaggatcgcgaaatgatccggaaaagactggagaagtataaggacgtgctcaccgaggaacagcggaaaaagctggagcgcagacactacaccggatggggccggctttccgccaaactgattaatggcatcagagataaggtcacacgcaaaaccattctcgactatctgatcgatgacgggacaagcaaccggaatttcatgcagctgatcaacgatgacacgctttcttttgtggatgaaattagactcgcccaaggatccggcaaggctgaggactaccgcgccgaagtccagaatctggcggggagccccgctatcaagaaagggattctgcagtctctcaagatcgtggatgagctgattgaggttatgggctatgacccggaacatatcgtggtcgagatggccagagaaaaccagttcaccaatcaagggcggcgcaactcccagcagagatacaaaaagatcgagaatgccattaaaaaccttgacagcaatctgaactccaagatcctcaaagaataccctacaaataaccaggctctgcaaaacgatcggctgtttctttattacctccagaatggcaaggacatgtataccgatgaggagctggacattgatcagctgtctcaatacgacatcgatcacattatcccccaggccttcatcaaggacgatagcctcgacaacaaagtgctgacaaagtccgctaaaaatcgcggaaagtctgatgacgttcctagccttgaaattgtgtataaaaagaagaacttttggaaacagctgctcgactcccagctgatcagccaaagaaagttcgataatctgaccaaagccgagcggggcgggcttacgaacgaagacaaggcgcgctttattcagagacagctggtcgagacccggcagatcacaaaacatgtggcccgcattctcgataccagattcaatacaaagctggacgaagctggaaaccggatcagagatcccaaggtgaatattatgaccctcaaatcttccctggttagccaatttcgcaaggactaccagctttataaagtccgggagatcaacaattaccaccacgcccatgatgcttacctgaacgccgtggtggcgacggccctcctgaagaaatatccccagctggctcctgagttcgtctacggcgactatccgaagtacaattcttataagtccagaaaaagcgccacagaaaaggtgcttttctactctaacatcatgaatttcttcaaacgcgttctggtgtatagcaagaccggggaggtccggattagacccgtgatcgaagttaacaaagagacaggagaaattgtgtgggataagaagtccgactttcgcaccgtccggaaagtgctcagctaccctcaggttaacgtggtcaagaaaaccgaggtgcaaaatcacggcctggatagagggaagcccaaaggcttctacaacgctaatctctctcctcgccccaaggagggatccgtggaaaacctggtcccggccaaacagagctttgacacaaagcggtatggcgggtacgccggaatctccaattcttatgctgttcttgtgaacggcattatcgagaaggggaaaaagaaaagcaaggcggaagtgacggagttccagggaatctccattctggccagaaaagattttgacaagaatcctaagcaatacctcctgaacctgggctataaagacatcaagtctattatcaaacttcccaagtacagcctgttcgagctcgaaaatgggtcccggcgcatgctggcttctattctcagcaccaacaataaaagaggcgagatccataagggaaacgaaatgtatctgcctgataagtttgtcacacttctgtaccacgccatgcgggtgaatcgcaccctggagcccggccacaaaaagtacgttgaagcccatagacacgtgttcgacgagctcctgacatatatccttgagtacaacgagaaaattgtcggggctaaggccaatggaaaacggatcgtggaagcgtattccgctagaaaggataccgacaacctggaggaactctgcaatagctttattaacctgctcaacctgacggcccttggctctgccgttgatttcgaatttctggggacaaagatccctcgctaccgggactataccccctccagcctgctcaaagctaccctgattcatcagtctgtgacaggactttacgagaccagaatcgatctgtccaagctcggcggggactga

SEQ ID NO: 4365 - RNA, 4143 nt, synthetic construct
  misc_feature 1..4143: note = Cas9 variant
  source 1..4143: mol_type = other RNA
atgaagaaaatcctgggcctcgacctggggaccacaagcattggatgggcccttgtgtacgagtccgaaaacgctgatgagaagtctagcatcgtcagactgggcgttcgggtgaatcccctctccgtggacgaaaaagggaacttcgagaagggaaaatctattacgaccaatgccgatcgccagcaaacacacggcgcgagaatcaacctgcagcggtataaacttcgcagagaaaatctgaaggactgcctccagaaacaggggtggattggaaccgaggctctgtacgaggaaggcaagacaagcacctttgagacatatatgctgcgggccaaagccgctgaagaggagatctccctccatgaactgtgtcgcgtccttttcatgctgaacaagaaaagaggctacaagtctaatcggaaggccaacaataaagaggatgggaagctctttgacggaatgaccgtggctaaaaagctgtatgaggaacaccttacgcctgccgaatacagcctgaaactcctgtccagcggcaagaaattcaagcaagagtattaccgctctgatctgaaggaggaatttgacagaatctggaacgagcagcagaaatactatccggaaattctcaccgatgacttcaagcagcaactgcaggggaaatccaagggaaatacaagcaaaatctttcttggcaagtacgggatttattctgcggatctgaagggactcgaccggaaactgcagccccttaagtggcgcgttgaggccctgaaacagaaggtggataaagaagtcctcgctttcgtgatctccgacctgaacggccaaattgccagcacctctggcctgctcggggctatctccgacagaagcaaggagctgtactttaataagcagacagttggacagtatctttggacctccctgaaagagtctcctcatgtgagcattaagaacaaacccttctaccggcaagattatctcgacgaatttgagaagatctgggaaacgcaggccacataccacaaagagctgacccctgaacttaagcaggagatccgcgatattatcattttctaccagagacccctgaagtccaaaaagggcctcatcagcgtctgcgagctggaacaacggaaagtgaaggtgacaattgacgggaaagagaaggaaatctctatcggacctaaagtcgcgccgaagtccagccccatgtttcaggagttcagaatttggcagaatctgaacaacatcctcctgattgataagggcaataactctaatcgccctctttatgaggaggaacggaacctgctctacgaggaactgagcgttaaagaaaagctgtccaaagccgaggctcttaaggtgctcaataaaaacgggaagcagtgggacctgaattataaggagatcgaaggaaacagaacccaagccgtgctgtacgattgttataatcgcattatcggcatgaccggccatgaggaatgcaacttcaaaaagctcaaggcttctgacatccggtacaatgtcaagacaatttttaaaaacctggggttcagcacggatatccttgactttgattccagcctgcagggacacgagctcgaaagacagccctcttatcagctgtggcatctgctttactcctacgagagcgacaattctcgcaccggcaacgacgccctcctgcggaagctggagacagccttctccattcctaaggaatatgctgcggtgctcagcgatgttgtgtttgaggactcctacgggaatctgtctgtcaaagccatgagaaacatccttccccatctgcaagctggactcgattatagccaggcctgtgaaaaggccggctacaaacactcccgccggtctctgaccaagaacgagctggacaaaaaggaatataaggagaaacttgagctcctgcctaagagctccctgcacaatccggtggttgagaaaattctcaaccagatgatcaatgtgattaacgctgtcatcgatgaatacgggaagcccgacgaaatcagaattgagctggcccgcgagcttaaaatcggcgcggctgaacgggagaatatgacaagaagcattaaccagggaaatgccgaaaacaagcggatccgcgagattctggaaaaagagttcgccctctcttatatctccagaaatgatatcattaagtacaagctgtacgaggaactgaaaagcaacggctttaagaccctttattctgacacgtacatctccaaagataaactcttcagcaaagactttgatattgagcacatcattcctaaggctcggctgttcgacgattctctgagcaataagacaatcgaagccagagacgtgaacatcgctaaatccaataagaccgcctttgacttcattagcgagaaatatgatcaacaggggatcgaagcgtacaagaaaaagctcgacattctgcttcaggatggatctatctccaaggccaaatataaccgcctgctcatgaaggaggctgacattcccagcggctttatcgatcgggacctgagagatacccaatacatcgccaaaaaggcttatgagattctgtccgaccttgtccgcaatgtgacacccaccacaggggccgttacgtctagactgcgggaagattggcagctcgtggacgtcatgaaagagctgaacttcgaaaagtaccagaagctcggactggtggaggttatcgaagatcgcgacggcagaaaaattaagcggatcaaagattggaccaagcgcaacgaccacagacatcacgcgatggacgcccttacaattgctttcaccaaacctagctacatccagtatctgaataacctcaatgcccggtccgataagaactctagcatttacgggatcgagaataaggagctgcatcgcgaagacaacaaactgagatttaatgctccgcttcccatcaacgagttccgggccgaagcccgcagacacctgaagtccattctcgtgtctgtcaaagctaagaataaagtgatgacacaaaacgtgaatgttatcaagaccaaacatggcgtcattaagaaggtgcagctgacgcctcggggagagctccacaacgcgaccttttatggcaccaaaaagagacccatcattaaaatggtgaaggtcggggccgctctggatgaggtgacaatcaaaaaggttagctccagcttcatccgcgaagcccttctggaccggctccacgagtacaatggagatgccaagaaggcttttacaggcagaaactctattgacaagaatcctatctatattgatgaggaacataaaaagaccgtgcccgccctggtcaaaacgatcgaatgggagatgtaccacccgacacgcaagatgatttcccctgacctgaagatcgataaagtgatcgacaaggggattcgggagatccttagaacccgcctggcgaaattcaacggagatgctcagaaggcctttagcaacctcgacgaaaatcccatttataaagacgaggccaagaagatcacactgaaacgggtttctctcgaaggcgtgtccagcgtcattcctctgcataaacttaaggatatgggcgggaagcccgtggttggaaaagacggcaagcctgtgtggggagattacgtccagacctctaacaatcaccacatcgctttctacatggacgagaacgggaatctgcaagatgacgtggtgacctttttcaaagccgcgagacgcaagtcccagggcgtccccgttattgataagaactataatcatgacaaagggtggcactttctgttcacaatgaagcagaacgaatactttgtgttcccgaatgaggctacgggattcatccctaccgaggtggatctcatggacgaagccaactatgatatgatcagccccaatctgtaccgggtccagaaaatgtccaagacaaaacaaggcattaccgacaagagagattattggtttcggcatcaccttgagacagtgctgaacaatgacctcaaggttcgcaacagcatcttcaaacagattaattctctgaagcccctcgaagggatcgtgaaagtcagaattaacgccatcggcaagatcgtggctattggagagtacgactga

SEQ ID NO: 4366 - RNA, 4143 nt, synthetic construct
  misc_feature 1..4143: note = Cas9 variant
  source 1..4143: mol_type = other RNA
atgaagagaatcctgggcctcgacctggggaccacaagcattggatgggcccttgtgaacgaggctgaatccaataacgaggcctctagcatcgtccggctgggcgttcgcgtgaatcccctcacggtggatgaaaaatccaacttcgagaaggggaaagcgattaccacaaatgctgacagacaactgcggcacggagcccgcatcaaccttcaaagatacaagctgcggcgccagaatctccatgattgcctgcagaaacagggctggctggggaccgaagccatgtatgaggagggaaaggcttctacatttgaaacctacaagctcagagccaaagctgccgaggaagagattagcctgcacgagttcgcgcgggtcctttttatgctgaacaagaaacgcggctataagtccaatagaaaagccaacaataaggaagacggccaactcttcgatgggatgacaatcgctaagaaactgtacgaggaacatcttacccctgccgagtattctctgcagctcctgaacaagggaaagaagtttacgcagggctactatcggagcgacctgaatgctgaactcgagcgcatctgggatgagcagaaaaagtactacccggaaattctgaccgacgagttcaaacaacagcttgaagggaagacaaagaccaacacatccaaaatctttctggccaagtatggaatttacagcgcggatctcaaaggcctggacagaaaacttcagcccctgaaatggcgggtggaggccctcaagcagcaagttgataaggaagtgctggctttcgtcatctctgacctgaaagggcagattgccaatacctccggactcctgggcgctatcagcgatcgctctaaggagctttattttaacaaacagacggtgggccaatacctgtgggcctccctcgaggaaaaccctcacattagcatcaagaataaacccttctatagacaggactacctggacgagtttgaaaagatctgggagacacaggccaccttccataagcagcttacacctgaactgaaacaagagattcgggatatcattatcttttatcagagacccctcaagtctaaaaagtccctgattagcgtttgtgagctggaacagcgcaaagtgaaggctaccatcgacgggaaggagaaagaaatcaccattggacctaaggtcgcgccgaaatcctctcccgtgttccaggagttccggatctggcaaaacctcaataacgtgctgcttattgataatgacacaaacgagaagagacctctggatgaagacgagcgctacctcctgtacaaagaactgagcatcaaggccaaactttccaagacggaggctctcaagattctgaataaaaagggcaaacagtgggatctgaactataaggaactcgaggggaatcggacccaggccatcctgtttgactgctacaacagaatcattacacttaccggacacgaggaatgtgatttcaaaaagatcaaggccagcgagattcgccactatgtctctacaatctttaaaaatctgggcttctccaccgaaattctcgactttgatcccagcctggagaagcatgaactggagaaacagcctatgtaccaactttggcacctcctgtattcttacgagagcgacaactcccggacggggaatgaatctctgctcagaaagctggagacaaccttcggatttcccgaagagtatgctaccgttctttgcgacgtggtgttcgaagaggattacggcaacctgagcgtcaaagccatgcgcaagatcctcccgtacctgcaggcgggcaatgactattcccaggcttgtgcctacgccgggtataaccatagccggcactctctgacaaaggaggaacttgatcagaaagtgtacaaggagagactcgaactgctgcctaaaaactccctccgcaatcccgttgtggagaagattctgaaccaaatgatcaatgtcatcaacgctattatcgacgagtatggaaaacctgatgaaattcggatcgagatggccagagaacttaagagctctgctgccgaccggaagaaaaccacacacgcgattaatcagggcaacgatgagaatcagtgcatccgcgaaatcctggagaaggagtttgccctctcctacattagcagaaacgacatcattaaatataagctgtacgaggaactgaaacccaatgggttcaagacgctttactccgatacctatatccccaaagacaagctcttttctaaggatttcgacattgaacatatcatccctaaagctcggctgtttgatgacagctactccaacaagacactggaggccagagacattaatctcgctaaatctaacaagaccgccttcgatttcgtgaaagaaaagtatggagagcaaggcgcggaggcctacaagaaaaagctggacatgcttctggggaataacgttatcagcaaaccgaagtataataaactcctgatgacagaagctgatattccctccgactttatcaaccgcgatctgcggaacacccagtacattgccagaaaggcttgtgagatccttggcgaactggtgcgcacggtcacccctacaaccggaaagatcacaaatagactccgggaggactggcagctggtggatgtcatgaaagaactcaacttcgagaagtatgagaaactgggccttaccgaaattgtggaggaccgcgatgggagaaagatcaaacggattaaggactggacgaagcgcaatgatcacagacatcacgccatggacgccctggctatcgcgtttacaaaacccagctacattcagtacctcaacaatctgaacgcccggtctaataagggagattccatctatgctattgaaaacaaagagctgcattacgaggaaggcaaacttcgcttcaatgcccctatccccgttaacgtgtttagagccgaggctaaacggcacctgagcgccatcctcgtctctattaaggcgaagaataaagtgatgacccaaaacgttaataagatcaaaacaaagcacgggattatcaaaaagattcagctgaccccgcgcggacctctccataacgaaaccatctatggcacaaaaatgagacccatcattaagaaggtgaaagtcggggctgccctggacgaggccacgatcaataaggtgtccagccctgctattcgggaagtgcttctgaaaagactcaacgagtactctggcaacgccaagaaagcgttcaccggaaagaatacactggacaagaaccccatctatctgaatgctgagcgcaccaaaacagttcctgccagcgtcaagaccgtggaatgggagaactaccaccccattcggaaaccgatcacgcctgatcttaaggtggacaaagtcatcgataagggcattggggaaatcctgaaggccagactcgaggaatttaatggagacgctaaaaaggccttctccaacctggaggagaatcccatttatctcgatcagacaaagaagatcgctctgaaacgcgtgagcattgaaggcgttctttctaccatccccctgcataccctgaagaaccaggccgggaagcctattatgggaaaagacggcaagccggtgctcgggaattacgtccaaacatccaacaatcaccacatcgcgttttactatgatgaggacggcaacctgcaggataatgccgtgagcttctttgaagctgccgagcggaaatcccagggaatctctgttattgacaaggattacaacagagacaaaggctggcgcttcctttttaccatgaagcagaatgaatatttcgtgttccccaacgaggctacagggtttatccctagcgaggtcgacctgacggatgaagccaattacggaattatctcccccaacctctatcgggtgcagaaaatgtctagaattgagaagggcaccagcgtttcccgcgactactggttccggcatcacctggaaacaatcctcaacgatgactctagactgaagaatagcgcctttaaacggatcaactcccttaagcctctggaggggattatcaaagtgcgcattaatagcatcggaaagattgtcgctgtgggcgagtatgattga

SEQ ID NO: 4367 - RNA, 4143 nt, synthetic construct
  misc_feature 1..4143: note = Cas9 variant
  source 1..4143: mol_type = other RNA
atgaagaaaggctacagcatcgggctggacattggaaccaactccgtgggcttcgccgtcatcacagatgactataaggttccctctaaaaagatgaaagtgctcgggaatacggataagagatttattaagaaaaacctgatcggagcccttctgttcgacgagggcaccacagccgaagcgcggcgcctcaagagaaccgctcggcgcagatacacacggcgcaaaaatagactgcggtatcttcaggagatttttagcgaagagatgtccaaggtggattctagcttctttcaccgcctggacgattccttcctcatccctgaagacaaaagagagtctaagtacccgatctttgccaccctggaggaagagaaggaatatcataaaaagttccccacaatttaccatctgcggaaacacctcgccgatagcaaggagaaagctgacctgcgccttatctatctggccctcgctcacatgattaagtacagagggcattttctgtacgaggataccttcgacatcaaaaacaatgatattcaaaagatctttaacgagttcatttccatctatgacaatgcctttgaaggaagctctctttccggccagaacgcgcaggtcgaagccatcttcacggacaagattagcaaatctgctaagcgggagcgcgtgctgaaactcttccctgatgaaaagtccaccggcctgtttagcgagttcctgaaactcatcgttgggaatcaggccgactttaagaagcacttcgatctggaggacaaagctccccttcaattttctaaggatacatacgacgaagatctggagaacctcctgggacagattggcgacgatttcgccgacctttttgtggcggccaaaaagctgtatgatgctatcctcctgtccgggattctgaccgtcacagaccctagcaccaaagctcccctctccgcttctatgatcgaaagatacgagaatcaccagaacgacctggtggttcttaagcagttcatcaagaataacctgcctgaaaattatgtggaggtctttagcgatgactccaaaaacggatacgccggctatgtgggggtggatagcaagattcggaaaagaaacgccaagctcgctacggaggaagagttctacaaatacctgaagaatatccttaacaatgtcaagggagcggactattttctggataaaattgaacgcgaggacttcctccggaagcaaagaacatttgataacggctctatcccgcatcagattcatctgcaggaaatgaatgccatcctgcgccggcagggcgagcactaccccttcctcaaagagaacagagaaaagatcgagaaaattctgaccttccgcatcccttattacgttgggccccttgctcggggaaatagagactttgcctggctgacacgcaactccgatcaagccattcggccttggaatttcgaagagatcgtggacaaggctagctctgccgaggattttattaacaaaatgaccaattatgacctctacctgcccgaagagaaggtgctgccgaagcacagccttctctatgaaaaattcgcggtctacaacgagctgaccaaggtgaaatttatcgctgaaggcctgagagattaccagttcctcgactccgggcagaagaaacaaattgttaatcagctgtttaaggagaagcgcaaagtgacagagaaggacatcatccactatcttcatacggtcgatggatacgacggcattgaactgaaagggatcgagaagcagttcaacgcctctctcagcacctatcacgatctgctgaaaattatcaaggacaaggaatttatggatgaccctaaaaatgaggaaattcttgagaacatcgtgcatacactcaccatcttcgaggatcgggaaatgattaagcagagactggcccaatacgactccctgtttgatgagaaagttatcaagagcctcacacggcgccactataccggatggggcaaactgtctgctatgcttattaacggcatcagagacaagcagacggggaagacaattctggattacctcatcgacgatgcctattacaatcggaacttcatgcagctgatcaatgacgacggactgtcctttaaagaaattatccagaaggctcaagtggtcggcaaaaccgatgacgtgaagcaggtcgtgcaggagcttcccgggagccctgccattaaaaagggaatcctccagtctattaaaatcgttgatgaactggtgaagatcatgagacataaccccgagtccattgtcatcgagatggcgcgcgaaaatcaaaccacagcccggggcaagaaaaacagccagcagagatacaagcgcattgaggacgctctgaaaaatctcgcccccgggctggattccaacatccttaaggaacaccctaccgacaatgtgcagctgcaaaacgatagactcttcctgtattacctgcagaatggcaaagacatgtatacaggagaggctcttgatattaaccagctctctagctacgacatcgatcacattatcccgcaagccttcatcaaggacgactcctttgataatcgggttctgacgtctagcaaggacaaccgcggcaaatccgataatgtgcccagcattgaggtcgtgcagaagagaaaagcgttctggcagcagctgctcgactctaagctgatctccgaacggaaatttaacaaccttaccaaggccgagcgcgggggactggatgaaagagacaaggtgggcttcattaaacggcaactcgttgagacacgccagatcaccaagcatgtcgctcagattctggatgccagatataatacagaagtgaacgagaaagacaagaaaaatcggaccgtgaagatcatcacgcttaagagcaacctggtctctaattttcgcaaagagttcagactgtacaaggtgcgggaaattaacgattatcaccatgctcacgacgcctacctcaatgccgttgtggctaaagcgatcctgaagaaataccctaagctcgagcccgaatttgtctatggggagtaccagaagtatgatctgaaaagatacatttcccgcagcaaggaccctaaagaagtggagaaggccaccgagaaatatttcttttactctaaccttctgaatttctttaaggaagaggttcactatgctgatggaacaatcgtgaaacgggaaaacattgagtacagcaaggacaccggcgaaatcgcctggaataaggagaaagacttcgccatcattaagaaagtcctctccctgccccaagtgaacatcgttaagaaaagagaggtgcagacagggggcttcagcaaggaatctattctgccgaagggaaattccgataaacttatccctcgcaagaccaaagacattctgtgggatacgacaaagtacggcgggtttgacagccccgtcatcgcttattccattctcctgatcgccgatatcgagaaaggaaaggcgaagaaactcaagaccgtgaaaacactggtgggcattaccatcatggaaaaggctgccttcgaggacaaccctattacctttcttgagaataaagggtaccataacgtccggaaggaaaacatcctgtgcctccccaagtattctctgttcgagctggaaaatggaagacgccggcttctggccagcgctaaagagctccagaagggcaacgaaattgttctgcctgtgtacctcacaacgctgctttatcactccaaaaatgtgcataagctggatgagcccgggcacctggagtacatccagaaacatagaaacgaatttaaggacctcctgaatcttgtctctgagttcagccaaaaatatgtgctggccgatgcgaacctcgaaaagatcaagtccctgtacgctgacaatgagcaggccgatattgaaatcctcgccaactcttttattaatctgcttaccttcacagctctgggcgccccggctgcctttaaattctttggaaaggacatcgatcgcaaacggtacaccacagttagcgagattctgaacgcgaccctcatccaccagtccatcacgggcctgtatgagacaagaattgaccttagcaagctgggggaagactga

SEQ ID NO: 4368 - RNA, 4143 nt, synthetic construct
  misc_feature 1..4143: note = Cas9 variant
  source 1..4143: mol_type = other RNA
atgaacctgagacacgtgggcaattacaacatcgggctcgacatgggaaccgccagcgtcggctgggctgccattgatgagcagggggaactgcttcatttcaagggaaaacccacatggggctcccggctgtttgactctgcgaatacggctgccaccgcccgcatgcctagagggcaacggcgcagatatatccggcgcagatggcggctcgatctgcttcagaagttctttagcgaggaaatggctgagaaagacccggagttctttattcgcctgagacagtcctctctctggcccgaagatcgggagggaggccacacagcctaccattggcctctgttcaacgacagcgattttaatgaaaaggagtattacgaaaaattccccaccatctttcatctgcgccagtggctcatggagacagacgagaaggctgatattagactgatctatcttgccttccacaacatcgttaagcaccggggcaattttctgcaagaaaacaatgactccctctctgcgcagaacgccaatatgcgcgagagcctggaatccttctgcattgctcttgaggaatggtgtgatgagaaagagctgacctgcagctgtgaccctcagaagctcgaacacctgtttaaagaggtgaagtacagatctgatatccgggacgggttcgccgctctgctcggactggcctgctccggcgaaaacgaggtggacgtcaaagcgatggccaaggaaatggggaaggctattgtgggatataaagccgatttcagcaagatctttacagagtgtgacaaagagggcagctccttcagacttagcgatgacgaagggcccgaggcttttctggatatttgccctgacgatggaatcgccctcttcgaagccattcagatggtttactcttcctttatcctgaccggcatgcttacggagaagggcctgagcctctccaaaatctctgcttacaatcaatatgggcaggacctggaaagcctgaaggcgctcgtgaaagagtacgtcccgaacgagtattccagcttctttcgcggacccacctactctggctccacagaatatgatcctagcaaggcccaggggtacacccggtataatctgggaccctctaagaaaggcagcggggctaagcctatggcctacgaggacttcaaaaagtccgtggaacagctttttgccaacacaaacgctattaatgatgagagatacaaagagatgatgggacgcttcgccgaagagaagtttctgcggagactccgcacctctgacaacggccggatccccttccaactgaatcttgaagagatgacggcgattatcattaaccagggcaagtattacccgtttctgctcgaacagcaagagaaactggagagcctggttagattccgcatcccttattacgtggggcccctcacacggatcaatgctagactggactccaagggaaacgcctgtttcgcctggagcaaacgcaaggatggcatggactctgcttccattaaaccttggaattgggatgaagtcatcgacaagcatgccagcgctcaggcctttattgagcggatgaccgggacatgcacctatcttagaggagaacccgtgctgccccggtgttctctcctgtacgaggaatattgcgtgctgaacgagcttaatggcgcgcgctggacccaggatggggacaagttcatcagatttgattacaaagaccggtccgatattatcgaggaactcttcaagaaaagacgcggccggatccagtacgccgctgtcgccgactggatgaagcaagagagaagccacgctaacgttcatgtgtccggaggccagggggaaaatgcctttgagtctcgcctgagctcctatcacttcttttgtaacgatgtgttcggagtcgacgaactgcctggctcttacgtggatatggttgaggagattatcctctggagcacactgtttgaagacagatccattcttcgggaggaaatccagcgcaaatatggggacgtgctgaatgaggagcagattaagacgatctgcaagaaaagattcagcggatggggccggctctctcgcaagctgctgtgctcccttaaagcgcaaaccgataacgggccgaagtctattatggacatcctccaggaaggcgatcagaataacggaagagtcggccgggccatggtgtttcaggagatcctgcacgacgaacaactggggttcgagcagaaaattgaagaggagaacacacagtctatgctcgaaggagagaatctgcttatcgaagatctgcccggctcccctgctattcgcagaagcatcaaccaggccgttcggattgtggacgagatcgtcgggatcgctggacatgcccccgataatatttttatcgaagtgacccgcgaggacgatacaaagaaaaagggcaagagaaccacgacacggtactctaacattcaaaaagccctcgaggctctgaaggaagagggggcggaagccctgagagagcttaaaacctataagcacaatgaactcgacaaacgcctgagcctgtacttcatgcagaacggcaagtccctctatagcggaatccctctggatattcggagactttctgagtaccagatcgaccatatcattccccaatcctacatcaaggatgacagctatgagaatatggctctggtcctcccgggcgaaaaccagtccaaagccgacaatctgctgatttctcaggatatccgcattaagatgaaagccacctggacagcccttcacaaggccgggctcatgggagacaaaaagtacaacaatctgatgaacagctccatctctgatgcgaagatgaaaggcttcatcaatcggcagctggtggagaccagccaatccgttaagctcacacagatgatgctgtctcagaaatatcctggggctaaggtgagacccattaaagccagcatctccagccagcttcgcgacgcctgtgatctggtcaagtgccgggaagctaacgactaccatcacgcccacgatgcgtatctcgcttgtcaagtgggaagatttgttctgaagcgccattcttccatgttcgacaatcctattggcatgacgaaagtgatccgggattttgtcaagagacaggggcaggagttcaaacggaacggcaagctgcccgcctacgccagccgctctggatttattgtgcagtccttcatgagaagcggctttgacgctgagaccggggaacttctgcgggatgactggaacgcccctttcgagatcgctcgcattaaaagatgcctcaattatcgggactgttacatctctagaatgcccatggaagattccggagccttttgggacgcgacaatctacagcccgaaggccggcaaaaagggggctctgcctgtgaagcaaggactccccgttgagaaatatggctcctacagccgcgaacagttcgcctactttttcgtctataaggcttataaccccaaaaagaaagcctaccggctggagttcgaggccgtgcctgtgagagtcgcttctgcggtggaaacccgcgagaatgcccttgaagagtatgctaagagcgttgccaagcaggccggcctggaatttgtggaggtcgctcggccgaaagtgtacaagtaccaactcattgagctgggggaagatagactgtatatcacaggaaaacgcgaggttcggaacgcctcccagcttgcgttctctctggacgaaattgatctcctgaagagactcgctgagggcgaagagaccagctccgaggaacgcgagagactgtttgacgtgcttatcgaaaaatacgcccggtatgctccccgcctggctagacagctctctgtcgatagcatgtccgccacgttcgagaccctgaatgcggaggaacagctggggattcttctgtctctcgtggagatcgctaacggaaagcggaatatgatcgacctgagctccgccggcgggagcaagaacgccggatgcatgaatcctacattttcttccgaactcagctctcccggctccaacttcacctttattgatcaaagcgttacaggcatgttcgagcgcagacagcggctggaactttga

SEQ ID NO: 4369 - RNA, 4146 nt, synthetic construct
  misc_feature 1..4146: note = Cas9 variant
  source 1..4146: mol_type = other RNA
atggtgaagaaaaagtacgccatcggcattgacatcgggaccaacagcgtcggatggtccattgttacagatgactataaagtgccctctaagaaaatgaaggtgttcggcaatacggagaagagatacatcaaaaagaacctgctcgggaccctgctttttgatgaaggaaatacagctgagaaccggcgcctgaaaagaaccgcccggcgcagatatacacggcgcagaaatcggattctctacctgcaggaaatcttcgcggaggaaatcaacaagattgacgatagctttttccaacgccttgacgattcctttctgatcgtcgaggacaaacagggctctaagcaccctattttcgggaccctccaggaggaaaaggagtatcataaacagtttccgacaatctaccacctgagaaagcaactggctgatagctcccagaaagccgacattcggctcatctatctggcccttgctcatattatcaagtaccgcggacacttcctgtttgaaggcgatctcaaatctgagaataaggacgtgcagcatctgttcaacgattttgttgagatgttcgacaaaaccgtggaaggcagctacctttccgagaatctgcccaacgtcgccgacgtgctcgttgaaaaggtgagcaagtctagacggctggagaatatcctgcactattttcctaacgagaaaaagaatggactcttcggaaacttcctggctcttgccctgggcctccagcccaattttaaaacgaacttcgagctggcggaggatgccaagattcaattttccaaagaaacctacgaggaagaccttgaggaactgctcgggaagatcggagatgactatgctgatctgttcattgccacaaagagcctgtacgacggcatcctcctggctgggattctttctaccacagattccaccacgaaagcccctctgtctagctccatggtcaaccgctatgaggagcaccagaaggacctcgcgctgcttaaaaattttatccatcagaacctgagcgattcctacaaggaagtgttcaatgacaaactcaaggatggatatgccggctacatcgagggcaagacaacccaggaaaacttttacagattcattaaaaaggctatcgagaaaattgaagggtctaattattttatcgacaagattgaccgggaggatttcctgagaaaacaacgcacatttgacaacggaagcatcccccaccagatccatctgcaggagatgcacgccattatccggagacaagctgaattttacccttttctcgtggagaatcaggataagattgaaaagatcctgaccttccgcattccgtattacgtcggcccccttgcccgggggaaatccgagttcgcctggctgaacagaaagagcgacgagaaaatccgcccttggaattttgatgaaatggttgacaaggagacctctgctgaaaacttcattacacggatgacgaattatgatagatacctccccgaccagaaagtgctgcctaagcactccctgctttatgagaaatttgcggtgtacaacgaactcaccaaggtcaagttcatcgccgagggaatgcgcgattaccagtttctggacagcggccagaaaaaggatatcgtgaaaacactgttcaagaccaaacggaaggttacagctaaggacattaaagcctatctcgaaaattctaacgggtacgccggagtggaactgaagggccttgaggaacaatttaatgctagcctgcccacctatcatgatctcctgaaaatcctgagagacaaggccttcattgacgcggaggaaaaccaggagatccttgaggatattgtcctcacgctgacactgtttgaagaccgcgagatgatccggaaaagactcgaaaagtacaaggatatcctgaccgaggaacagcggaaaaagctggagcgcagacactataccggctgggggcggctttccgctaaactcattaacggaatcctggacaaggtgacaagaaaaaccattctgggctaccttatcgatgacgggacatctaatcgcaacttcatgcaactcattaatgatgacacgctgagctttgttgatgagatccggctggcccagggatccggcgaagccgaggactatagagctgaagtgcagaacctcgccgggagcccggctatcaagaagggcattctgcagtctcttaaaatcgtcgatgagctgattgaggtgatgggatacgaacctgagcatatcgtcgtggaaatggcccgcgagaatcaattcaccaaccagggcagaagaaattcccagcagcgcattaacagactcgaaaatgcgctgaaggactttgggagcaaaatcctggaggagcaaaagccctacggagtttctaaagtgaacaatatccaccttcagtccgatcgcctcttcctgtattacctgcagaacggcaaggacatgtatacagacgaggaactcgatattgaccatctgagcgaatacgatatcgaccacattatccctcaagccttcattaaagatgactcccttgataataaggtcctgaccaagtctgctaaaaaccggggaaagagcgacgatgtgccctccatggagatcgttcacaatcggaaaaacttttggcggcagctcctgaagtctaaactgattagccagcgcaagttcgacaaccttacaaaggccgaaagagggggcctgaccaatgaggataaagctcggtttatccagcgccaactcgtggagacgagacagatcaccaagcatgtcgcccggatgctggacacaagattcaacaccaaactcgacgaagcggggaatcgcattcgggatcccaaggtgaacatcattacactgaaatccaatcttgtgagccagtttagaaaggactatcagctgtacaagatccgcgagattaacaattatcaccatgcccacgatgcttacatcaacgccgttgtcgctaccgccctcctgaaaaagtaccctcaactggccccggagttcgtgtatggcgaataccccacgtataattcttacaactcccggaaaagcgctacagaaaaggtgcttttctattctaatatcatgaacttctttaaaagaattgtcgtgcactccaagaccggagaggttcgcatccggcctgtgattgaggtcaataaggaaacaggcgagatcgtgtgggacaaaaagagcgatttcagaaccgttcgcaaagtgctgtcttacccccaggtcaacgtggttaagaaaaccgaagtgcagaatcatgggctcgaccggggaaagcctaagggcttttataacgcgaacctgagccccagaccgaaagaggggtccgtcgagaatctcgtgcctgccaagcagagcttcgatacaaaacggtacggaggctacgctgggatttctaactcctatgccgtgctggtcaatggcatcatcgaaaaggggaaaaagaaaagcaaggccgaggttacggagttccaaggcatttccatccttgctcgcaaggactttgataaaaaccccaagcagtacctgctcaatctggggtataaagacattaagtctatcattaaactgcctaagtacagccttttcgaactggaaaacggatccagacggatgctcgcctctatcctgagcaccaataacaagcgcggcgagattcacaaagggaatgagatgtatctccccgataagtttgtgacactgctttaccatgcgatgagagtgaaccggaccctggaacctggacacaaaaagtatgtcgagacacatagacacgtgttcgacgaactgctcatctacatcctggagtacaatgagaaaattgttggcgctaaggccaacgggaagcgcatcgtggaagcctattccgctcggaaagataccgacaatcttgaggaactgtgcaactcttttattaatctcctgaacctcacggccctgggcagcgcggtcgacttcgagtttcttggaacaaagatccccagataccgcgattataccccgtccagcctgctgaaagctaccctcattcaccagtctgtgacaggcctgtacgaaacccggatcgacctttccaagctgggaggggattga

SEQ ID NO: 4370 - RNA, 4146 nt, synthetic construct
  misc_feature 1..4146: note = Cas9 variant
  source 1..4146: mol_type = other RNA
atgaactacgtgaaggagtatcacatcggcctggacattgggaccagctccatcggatgggccgtcacagattctcagttcaaactcatgagaattaagggcaaaacggctatcggggttcggctgtttgaagagggaaagaccgccgcggaacgcagaacattccggaccacacgcagacggcttaaacgcagaaagtggcggctgcattacctcgacgagatttttgctccccatctgcaagaagtggatgagaatttccttcgcagactgaagcagagcaacatccaccctgaggacccggccaaaaatcaggcctttatcggcaagctcctgttccccgatctgctcaaaaagaacgaacgggggtatcctaccctgattaaaatgcgcgacgagcttcccgtggaacagagagctcactaccctgtcacaaatatctataagctgcgggaggccatgattaacgaggatcgccaatttgacctcagagaagtgtacctggctgttcatcacatcgtgaagtatcggggacacttccttaataacgcctccgtcgataaatttaaggtgggcagaattgacttcgataaatcttttaatgttctgaacgaggcgtacgaagaactccagaatggcgaagggagcttcaccatcgagccctccaaggtggagaaaattggacagctgctgctcgacacgaagatgcgcaaactggatcggcagaaggccgtcgctaagtttcttgaagtgaaagtggccgacaaggaggaaaccaaaagaaacaagcaaatcgctacagccatctctaaactggtcctcggctacaaggcggacttcgccaccgttgctatggccaatgggaacgagtggaagattgatctgagctccgaaacaagcgaggacgagatcgaaaaattccgcgaggaactttctgatgctcagaatgacattctgaccgagatcacgtccctctttagccagattatgctgaacgaaatcgtgcctaacggaatgtctatctccgagagcatgatggatcggtattggacacatgagagacagctggccgaagtgaaggagtacctcgccacccaaccggcttctgcgcgcaaagagttcgaccaggtctataataagtacattggccaggcccccaaagagaaggggtttgatctggagaagggacttaaaaagatcctgtccaaaaaggaaaactggaaagagattgacgaactcctgaaggctggcgatttccttcctaagcaacggacaagcgccaatgtggttatcccccaccagatgcatcagcaggagctggacagaattatcgaaaaacaagccaagtattacccttggctcgctaccgagaaccccgccaccggcgagcgcgatcggcaccaggcgaaatatgaactggaccagctggtgtcctttagaatcccgtactacgtcgggcctctcgtgacacccgaggttcagaaggctacgtctggagccaaattcgcctgggctaagcgcaaagaagacggcgagattaccccttggaatctgtgggataagatcgaccgggccgaaagcgctgaggcctttattaagagaatgacagtgaaagatacctatcttctgaacgaggacgtcctccccgccaattccctgctgtaccaaaagtataacgtgcttaatgaactcaacaatgtccgggtgaacgggcgcagactgagcgttggaatcaaacaggatatttactctgagctgttcaagaaaaagaagacagtgaaagcgtccgacgtcgctagcctcgtgatggccaagacccggggcgttaataaaccctctgtggaagggctgagcgatcctaagaaatttaactccaatcttgctacgtatctggacctcaagtctatcgtcggagataaggtggacgataactgctaccagacagacctggagaacattatcgaatggagaagcgtgttcgaggatggcgagatctttgccgacaaactgaccgaagttgagtggcttaccgacgaacagcgctccgcgctcgtcaagaaacggtataagggctgggggagactgagcaaaaagctgctcacaggaattgtggatgagaatggccaacgcatcattgacctgatgtggaacaccgatcagaatttcatgcagatcgtgaaccagccggtctttaaggagcaaattgaccagcttaatcagaacgccatcacaaatgatgggatgacgctgagagaacgggtggagtctgttctcgacgatgcttacaccagcccccaaaacaaaaaggccatctggcaagtggtccgcgtggttgaagacattgtgaaagctgtcggaaatgcccctaagtccatctctattgagttcgccagaaacgaaggcaataaaggggagatcacacggtcccgcagaacccagctgcagaagctgttcgaggatcaggctcacgaacttgtgaaagacacaagcctcaccgaggaactggagaaggcgctggatctctccgaccggtactatctgtactttacgcagggcggaaaggatatgtataccggcgaccccattaacttcgacgaaatctctacaaaatacgatatcgaccatattcttcctcagagctttgttaaggatgactccctggataatcgcgtgctcgtctctagagccgagaacaataaaaagagcgaccgggtgcccgctaaactgtatgccgccaagatgaagccgtactggaaccagctgcttaaacaagggctcatcacccagcgcaagttcgagaacctgacaatggatgtggaccagaatattaaatatagatccctgggatttgtcaagcggcagctcgttgaaaccagacaagtgatcaaactgacggctaacattcttggcagcatgtaccaggaggccgggacagatatcatcgaaacccgcgcgggactgacaaagcagctccgggaggagttcgacctgcctaaggtgagagaagtcaatgattaccaccatgctgtggacgcctatctgaccacctttgccggccaataccttaaccgccggtatcccaaactgagatctttctttgtttacggggagtatatgaagttcaaacgcggctccgacctcaagctgcggaattttaacttctttcacgaactcatggagggagataaaagccagggcaaggtggtcgaccagcagacaggggaactgattacgaccagagatgaggtggctaagtctttcgaccgccttctgaatatgaaatacatgctcgtttccaaggaggtgcatgatcggagcgaccaactgtatggagccacaatcgtcaccgcgaaagaatctggcaagctgacaagccctattgagatcaaaaagaacagacccgtggatctttacggggcttacaccaatggaacgtccgccttcatgacaattatcaagtttaccggcaacaaacctaagtataaagttattggggtgcccaccacaagcgccgtcggcctgaagcgggtgggaaaaccgggctctgaatcctacaatcaggagctccaccgcatcatcaagagcaaccctaaagtgaagaaggacttcgaaattgtcgttccccacgtgtcctattctcagctgatcgtggatggggactgtaaatttaccctcgctagcgatacataccagcatcccgccacgcaactggtcctttccaaggagtctatggagattatcgctgacgatttcaaatttgtgaaggaaaatcctgccaccgcggacgagcagctggttagagtgttcgacgaaattgtcaaccagatgaatcactattttacaatcttcgatcagcggagcaaccgccaaaaagtgaccaaggccagagacaagtttgtttccctcccgacagagtctgaatacgagggagctaaaaagacccaggtgggcaaaacggaggtcatcaccaacctgctgatggggcttcatgccaatgctgcccagggagatctgaaggtgctcggcctgagcacattcgggtttttccagtccagcggcggactcaacctgtctgaagacgccatgattgtctatcaatcccccaccggccttttcgagcggagaatctgcctgaaagatatttga

SEQ ID NO: 4371 - RNA, 4146 nt, synthetic construct
  misc_feature 1..4146: note = Cas9 variant
  source 1..4146: mol_type = other RNA
atgaagcagatcctgaaaaaggtgcaaggctacaacattgggctcgacatcggaaccaatagcgtcggctgggttgtgacagatgagaacgccaatctgcttcagttcagaaagaagaacatgtggggagctcggctgtttgaaaaaggagacacggcccagggccgcagactctcccggtctacccgcagacggtatgatcgcagacggcagcgcattcactacctgcaagagatgcttgcgacaatggtgctgcccatcgacgagagcttctttattagactcaatgaggctttcctgtggaaggaagataagtccgtccagcgggactatatcctgtttgccgataaacagttcaccgaccgcgatttttacaagcagttcaaaacaatctatcatctcagaaagtttctgcttgacaccaaagagaaggccgatcctcggttcatttacctggctctccaccatatgatcaagtatcgcgggaactttctgtaccaaggacagtctttcgacgtggttgagaatgtgcaggagagctttagagtccttctggaagaaatgtacgagcagctcggcaaagagtgggaatatggcgagcacttcgatgacattcaacggatcctggaaaacacaaccattgggaagaaatccaagcaggagcagatcgccgctattctgacggaacaatacggaaataaaaagctcgccaacgaggtgaccagagcgtgcctgggctattctttcgaccttacagttgtgatggagaatgaaaacctgctcgatgagagcgggaaaaagatcaagatctcctttagcgactctaaatacgaggaacaggaactggagcttcagaatcgcctggaggaaaagttcgccgtcattgaggctctcaaacggatctataactggctggtgctgaaggataccctcagagggaaaaagtacatttccgaagccatggtgaataagtatgaggctcatcacgaagacctggtcaaacttaagcgcctgtttcggacatacctcagcaccgaggagtactcttgtttctttagaaaagaaaagcagaaagataagtatatctccaactacgttaactatcgcaagggcgccgagcggtgcagcaaagaaaagctgtacaaagcgattcacgagcttttcgacacggtggccaaggatgacgtggtctatcaagagatcgtggaaaagatggatcagggggagtttctgacaaagcagaatgaagtttctaacgcttacatcccgtatcagtgtaatgaggtggaaatgaagagaatcctcaaacaacagggagagttctaccccgagctgaaggaaaacgccgacaaaattctgcagctcctgctttttcgcattccttactatgtcggccccctggtggatgagaagcagtccaaattcgcttggatgaagcggagaaccggcatggaacaagttaaaatctacccttggaattttgaacaggtggtcgacattgaccagacagccgaagccttcatcacccgcatgaccaactattgcacatacctccccgaggagaaggtgctgcctaagcagagcctgctttattccgaatacgagctcctgcaagaactgaataaaatcaagattaacgggaaattttctctcgagacgcggaataagatcattgaacagctgttcaaaaagcagaagaaagtcaccgagaagcaacttaaaaagtggctggtgagagagcagtattgtacaaccaaagttacagaaaagatggtgaagctcgatgagaacgcttactacatcaccggattccagaaagaaaatgagtttgcgagctccctgacgagctatattgacttcacaaagatcctgggcgagattaccgaacggaaccgcaaaatgatcgaggaaatcatttactggcttaccgtctttgaggaaaagtctatcgtgaaaagaaagattcagaagaaatatgggaatgagatcaacgataagcaactcgcccagattctgaaactgaattactccggatggggccggttcagcgagaagtttctcaacgggatcaaaggattcgacagacagggccagaagaaaacaatcatggaactgcttcgcgaggattctcggctgctcaacattatgcaaatcattaataacgaagagatgggcttttgcaagatcattgaagctaatcagaagaaactgtatgggaacgagaatctgcttgacgttgtgcaggagctccatggaagcccggccatcaagagaggcatctggcagtccctgaaaattgtcgaagagatcatttctatcatgggaggagtgccccaaaacattttcatcgaatttgcccgcgaggatgacgatagagtgcggaccaatagccgcgttaagcagatcgaaagactgtacaaaaagttcaaggaggaggtcaacgactttaatgaacacgctgccaacgagctcaaagaaaagcggtatcagaatcgcattgatgaggagaaagtgttcctgtactttatgcaaaacggcaagtccctttacagcggggtgacactggacatcgatagactcaatgaatatgaggtcgaccatattatccctcggacgctggtgaaagacgattctctggaaaacaaggcgcttgttctcaagggcgagaatcagcgcaaaggagaaggcctgattccccacgagtggcagaacagacagaaggaggtgtggaaaaagctgctctcctgtgggctgatggggaaaaagaagtacgctaacctttgcaaagagagcttcggcaatgaaaaggaacaaaaacacttcatcgcccggcagattgtcgagacccgccagatcatcaaacaggtggccaacattctggctcaatattaccagggggttaatgtggccgctgtcaaagcctctctcggatccgaactgagagagaactatacaatcgagaagaaggacgataatggctttttcatggaaaacaaaagctacaccatgctgaagtcccggaaaattaatgactttcatcacgcgcaggatgcctatcttgcttgtgccgtggggctgtacatcaaggctgccttccctaaatacgagaaggaaattgactatgagggctacagaaaatattaccagaagaagaaccaacagaaagatggagttcgcaatgaaaagcggcagtttttctcttatgtgatgagcagattttccgagcagatcgtcgacaaagagacaggcgaaatcctctgggatgggacccaaaagctggcgtacattaaaaagatcttcggatatcgcgactgcctcattacgaagaaactggaggaaaacaccggcgagttttacaagcagacaatcaatgccaaacccgagaaggggaaagaaaacaataccaaacttctgccgattaagaaaggactctctgtggagaagtacggcgggtatcagggcggagaagctgcctacagctgtctggtgcggtatcaacagggcagaaaaacaaagctgtcccttgagaaaatcagcgtcatcattgctaagaagatcgccgaaaaagaggtttctctggatcgctacctcaaggagaaactgggggtggaagagattgtgatcctccggaagaaagtcatgaagaaccagctgattgaagactccgatggaaatagattctatcttaccgccgctacggaggtggttaacgcgaaacagtttatcctggacggcaagcatcaacacctcctgcgcacaattgccatcatggaaaagggggagtactatggataccggctggacgagcttgaaaacagcatggatgagctgtacgcttattacagaatgaaaatccagcagcagtatcctgcctacgaatctattgtgaagaaaatcgtcgagtcccatgtgtatgaaagcctccacgttgaggagaagattaaagccgtgcaagaaaagggcaagttcctgatccagctcctgcggcttaccgaggctaatgccgaatgcattgacctgaaaacaatctctgatgggcgcctggcggacagaatcggccggaagaaccactacaccattaaagagggaatcaagttcattgatcagagcatcaccggcctctatgagcgctacatgacagtctga

SEQ ID NO: 4372 - RNA, 4146 nt, synthetic construct
  misc_feature 1..4146: note = Cas9 variant
  source 1..4146: mol_type = other RNA
atggactacgtgaaggagtatcacatcggcctggatattgggaccagctccatcggatgggccgtcacagactctcagttcaaactcatgagaattaagggcaaaacggctatcggggttcggctgtttgaagagggaaagaccgccgcggaacgcagaacattccggaccacacgcagacggcttaaacgcagaaagtggcggctgcattacctcgataagatttttgctccccaccttcaagaggtggacgaaaacttccttcgcagactgaaacagagcaatatccatcctgaggatccggccaagaaccaggcctttatcggcaaactcctgttccccgacctgctcaagaaaaatgagcgggggtatcctaccctgattaagatgcgcgatgaacttcccgtggagcagagagctcactaccctgtcacaaacatctataagctgcgggaagccatgattaatgaggaccgccaatttgatctcagagaggtgtacctggctgttcatcacatcgtgaaatatcggggacacttccttaacaatgcctccgtcgacaagtttaaagtgggcagaattgatttcgacaagtcttttaacgttctgaatgaagcgtacgaggaactccagaacggcgaggggagcttcaccatcgaaccctccaaagtggagaagattggacagctgctgctcgatacgaaaatgcgcaagctggaccggcagaaggccgtcgctaaacttctggaggtgaaggtggccgacaaagaagagaccaagagaaataaacaaatcgctacagccatgtctaagctcgtcctgggctacaaggcggattttgccaccgttgctatggccaacgggaatgaatggaaaatcgaccttagctccgagacaagcgaagatgagattgagaagttccgcgaagaactgtctgacgctcagaacgatatcctcaccgaaattacgtccctgttcagccagatcatgctgaatgccattgtgcctaacggaatgtctatctccgagagcatgatggaccggtattggacacatgaaagacagctcgccgaggtgaaagagtacctggctacccaaccggcgtctgcccgcaaggaatttgatcaggtctataacaaatacatcggccaggtgcccaaggagaaggggttcgaccttgaaaaaggactgaagaaaattctctccaagaaagagaattggaaggagatcgatgaactgcttaaggctggcgactttctgcctaaacaacggacaagcgccaacggcgttattccccaccagatgcatcagcaggagctcgatagaatcattgaaaagcaagccaaatattacccttggctggctaccgagaatcccgccaccggggaacgcgaccggcaccaggcgaagtatgagctggaccagctcgtgtccttcagaatcccgtactacgtcggacctctggtgacacccgaggttcagaaagctacgtctggcgccaagtttgcctgggctaaacgcaaggaagatggggagatcaccccttggaacctttgggacaagattgatcgggccgaaagcgctgaggccttcatcaaaagaatgacagtgaaggacacctatctgctcaatgaagatgtcctgcccgcgaactccctgctttaccaaaaatataatgtgctcaacgagctgaataacgtccgggtgaatggacgcagactgagcgttggcattaagcaggacatctacacagagctctttaaaaagaagaaaaccgtgaaggccggggatgtcgcttctctggtgatggccaaaacgcggggagttaacaagccctccgtggaaggccttagcgaccctaaaaagttcaattctaacctggctacatatctcgatcttaagagcattatgggcgacaaagtcgatgacaatagataccagatggatctggagaacatcattgaatggcgctccgtgtttgaggacggggaaatcttcgccgacaagctgaccgaggtggagtggctcaccgatgaacagcggtctgcgctggttaaaaagagatataaaggatggggccgcctgagcaagaagctcctgacagggatcgtcgacgagaacggacaaagaattatcgatcttatgtggaataccgaccagaactttatgcagattgtgaatcagccggtgttcaaagaacaaatcgatcagctgaaccagaaggccattacaaatgacggcatgacgctccgggagcgcgtcgagtccgtgctggatgacgcttacaccagcccccaaaacaaaaaggccatctggcaggttgtgagagtcgtggaagatatcgttaaagctgtggggaatgcccctaagtctatttccatcgagtttgcccggaacgaaggcaataaaggagagattacacgcagcagacggacccagctgcagaagctgttcgaagaccaagctcacgagctcgtcaaggatacatctctgaccgaggaactggagaaagcgcccgacctctccgatcgctactatttctactttacgcagggcgggaaggacatgtataccggagaccctatcaacttcgatgaaattagcacaaaatacgacatcgatcatatcctgccccagtcctttgtgaaggacgattctcttgacaatagagttctggtgagccgggccgagaacaataaaaagtccgatcgcgtcccggctaagctctatgccgccaaaatgaagccttactggaaccagctgctgaaacaaggccttattacccagagaaagttcgaaaatctcacaatggacgtggatcagaacatcaaatatcggtctctggggtttgtgaagagacagctggtcgagacccgccaagttattaagctcacggctaacatcctgggaagcatgtaccaggaggccggcacagacattatcgaaacccgggcggggcttacaaaacagctgagagaggagttcgatctccccaaggtgcgcgaggtgaatgactaccaccatgctgtcgacgcctatctgaccacctttgccggccaatacctgaaccggagatatcctaaacttcgctccttctttgtgtacggagaatatatgaagttcaaacacggcagcgatctgaagctccggaattttaacttctttcatgagctgatggagggggacaagtctcagggaaaagttgtggatcagcagacaggcgaactcatcacgaccagagacgaggtcgctaagtccttcgatcgcctgcttaatatgaaatacatgctggtgagcaaggaagttcacgaccggtctgatcaactctatggggccacaattgtgaccgcgaaagagtccggaaagctgacaagccccatcgagattaagaaaaacagacctgtcgacctgtacggcgcttacaccaatgggacgtctgccttcatgacaatcattaagtttaccggcaacaaacccaagtataaagtgatcggagttccgaccacaagcgccgtgggccttaagcgggtcgggaaacctggatccgaaagctacaatcaggagctgcaccgcattatcaagtctaaccccaaggtgaaaaaggatttcgaaatcgtggtcccccatgtttcctatagccagctcattgtggacggcgattgcaaatttaccctggcttccgacacataccagcaccctgccacgcaactcgtgctgtctaaggagagcatggaaatcattgctgatgacttcaaatttgtcaaggagaatccggccaccgcggacgagcagcttgtgagagttttcgatgaaatcgtgaaccagatgaatcattattttacaattttcgaccagcggtccaaccgccaaaaggtcaccaaagccagagataagtttgtgtctctgcccacagagagcgaatacgagggggctaaaaagacccaggttggaaaaacggaagtgatcaccaatctcctgatgggcctgcacgccaacgctgcccagggggaccttaaggtcctgggcctctccacattcggatttttccagtctagcggcgggctgaacctctccgaggatgccatgatcgtgtatcaaagccctaccggactgttcgagcggagaatttgtcttaaggacatctga

SEQ ID NO: 4373 - RNA, 4146 nt, synthetic construct
  misc_feature 1..4146: note = Cas9 variant
  source 1..4146: mol_type = other RNA
atgaagaaaagctacgccatcggcattgacatcgggaccaactccgtgggacactgcgtcatgtatacagagaattacaaggttccctctaaaaagatgaaagtgttcggcaacacggaaaagagatatattaagaaaaatctgctcgggaccctgctttttgatgagggaaacacagctgaaaatcggcgcctgaagagaaccgcccggcgcagatacacacggcgcagaaaccggatcctctatctgcaggagattttcgcggaagagatcaataaaatcgacgatagctttttccaacgccttgacgattcctttctgattgtggaggacaagcagggctctaaacatcctatcttcgggaccctccaggaagagaaggaataccacaagcagtttccgacaatttatcatctgagaaaacaactggctgatagctcccagaaggccgacatccggctcatttacctggcccttgctcacatcattaaataccgcggacatttcctgtttgagggcgatctcaagtctgagaacaaagacgtccagcacctgttcaatgattttgtggaaatgttcgacaagaccgttgagggcagctatctttccgaaaacctgcccaatgtggccgatgtcctcgtggagaaagttagcaagtctagacggctggaaaacatcctgcactactttcctaatgagaagaaaaacggactcttcgggaatttcctggctcttgccctgggcctccagcccaactttaagacgaacttcgagctggcggaagacgccaaaatccaattttccaaggagacctatgaagaggaccttgaagaactgctcgggaaaattggagatgactacgctgatctgttcatcgccacaaagagcctgtatgacggcattctcctggctgggatcctttctaccacagattccaccacgaaggcccctctgtctagctccatggtgaatcgctacgaggaacatcagaaagacctcgcgctgcttaaggattttattagacagaacctgagcgactcctataaagagttctttaatgatacactcaaggacggatacgccggctacatcgaaggcaaaaccacacaggagaacttctatcggtttatcaagaaggctattgagaaaatcgaggggtctaattacttcattgataagatcgacagagaggactttctgcgcaaacaacggaccttcgataacggaagcattccccaccagatccatctgcaggaaatgcacgccatcattagacgccaagctgagttttatcctttcctcgtcgaaaatcaggacaagatcgagaaaattctgaccttccggatcccgtactatgtgggcccccttgccagagggaagtccgagtttgcctggctgaagcgcaaaagcgatgaaaagattcggccttggaacttcgacgagatggtggataaagaaacatctgctgagaattttatcacgagaatgaccaactacgaccagtatctccccgatcagaaggtcctgcctaaacactccctgctttacgaaaagttcgcggtttacaatgagctcacaaaagtgcgctatgtgaccgagcaaggaaagagctttttctttgacgccaacatgaagcaggaaattttcgatggcgtctttaaagtgtaccggaaggttacaaaagagaagctgatggacttcctggggaaagaatttgatgagttcagaatcgtggacctcatgggactggataaggacaataagtcttttaacgctagccttggcacctatcatgacctgaaaaagatcgtctccaaagatctcctggacaatcccgaaaacgaggatattctggagaacgtggttcttacgctcacactgttcgaagaccgcgagatgatccggaagagactggaaaaatacaaggatgtgctcaccgaggaacagcggaagaaactggagcgcagacactataccggctgggggcggctttctgccaagctgattaatggaatcagaaacaaaacaacccgcaagacaattctcgactacctgatcgatgacggcacgagcaatcggaacttcatgcagctgatccatgatgacaccctttcctttgtcgatgagattagactcgcccaagggagcggagaagctgaggactatcgcacagaagtgcagaatctggccggctctccggcgatcaaaaaggggattctgcagtccctcaagatcgtcgatgagctgattggcgtgatgggatacaaccctgagcacgttgtggtcgaaatggctagagagaatcagttcaccaaccaaggccggcgcagctctcagcagagatacaaaaagatcgaaaatgccatcaaaaaccttgactccaatctgaacagcaagattctcaaagagtatcccacaaataaccaggccctgcaaaatgaccggctgtttctttactatctccagaacgggaaggatatgtacaccgacgaggaactggatatcgaccagctgtcccaatatgatattgaccatatcattcctcaggctttcatcaaagatgactctctcgataacaaggtgctgaccaagagcgccaaaaatcgcggaaagtccgacgatgttccctctcttgagatcgtgcacaaaaagaaaaacttttggaagcagctgctcgacagccagctgatttcccaaagaaagttcgacaatctgacgaaagctgaacggggcgggcttacaaacgaggataaggcccgctttatccagagacagctggtcgaaacccggcagattacaaaacacgtggcgcgcatcctcgacaccagattcaatacgaagctggatgacgccggaaaccggattagagatcccaaagtgaatatcattacactcaagagctctctggtttcccaatttcgcaaggactaccagctttataaagtccgggagatcaacaattaccatcacgctcatgatgcctacctgaacgctgtggtggccaccgcgctcctgaagaaatatcctcagctggccccggagttcgtctacggcgactatcccaagtacaatagctataaatctagaaagtccgctacagaacgcgtgcttttctacagcaacatcatgaatttcttcaagcgggttgtgaaatctagcaagaccgggaccgtcaaaattagacctatcattgaggtgaacaaggaaacaggcgagatcgtttgggataaaaagtccgactttcgcacggtgcggaaggtcctgagctatccccaggtgaatgttgtgaaaaagaccgaagtccaaaaccacggactcgatagaggcaaacctaaggggttctacaacgccaatctgtctccccgcccgaaagagggatccgtggaaaacctcgtgcctgctaagcagagctttgacacaaaacggtacggcgggtatgccggaatttccaattcttacgccgtcctggttaacggcatcatcgagaaggggaagaaaaagagcaaagctgaggtgaccgaatttcagggcatttccatccttgcgagaaaggattttgagaaaaatcccaagcaatatctgctcaacctgggatacaaggacattaaatctatcattaagctgcctaaatatagccttttcgaactggagaatggctcccggcgcatgctcgcctctatcctgagcacaaacaataagagaggggagatccacaaaggaaacgaaatgtacctccccgacaagtttgtgaccctgctttatcatgctatgcgggtcaatcgcacgctggagcctggccacaagaaatacgtggaaacacatagacacgttttcgatgagctgctcacctacattctggaatataacgagaagatcgtgggggccaaagccaatggaaagcggattgtcgaggcttactccgccagaaaagacaccgataaccttgaggaactgtgtaatagctttatcaacctcctgaatctcacagcgctgggctctgctgtggacttcgaatttcttgggaccaagattccccgctatcgggattacacaccgtccagcctgctgaaggccacgctcatccatcagtctgttaccggcctgtatgagacaagaattgacctttccaaactgggaggcgattga

SEQ ID NO: 4374 - RNA, 4146 nt, synthetic construct
  misc_feature 1..4146: note = Cas9 variant
  source 1..4146: mol_type = other RNA
atgaagaaaatcattggcctggacctcgggaccacaagcatcggatgggcctacgtgcacgaggctgaatccgcccaggagagatctgaaattgtccggctgggcgcgcgcgttgtgccccttacgaccgatgagcaagacgagttcaagaaaggaaagagcatcacaaccaacgctgccagactgtccaaacggtctctccgcagaaatgccgatcggtttcagctgcgcagagacgagcttgctggagtgatgaaggaggccggctggattgatgaaacaaccgtcctggctgagcaggggcctcggagcacattcgaaaccctccgcctgagagccaaggcggcctccgaggaggtgacgctggctgaatttgcccggatcctcctgcagatcaaccgcaaaagaggatataagtctaatcggaaaaccgacggcgatgaggaaggcgctcttattgacgggatggatgttagcaagcaactgaacgcctccggacagacaccgggcgagtgggtgctcgcgcgcatgcaggaagggaatgccgtcatccccgctttctactgcagcgacctgtctgaggagcttgatagaatttggcggaaacagcaagcctcccatcaggcttggatgaccgaagaactgcacacagtgctcagacatgccgacggacgcagcgccatccggctgatggataaggctggcgttgtgcctgactctgtcaacgtgaaggaaagacgccgggtgatgtatgagtggagagcggccgctgtccgcgactgtctgcccgccgggcgggttgccgctgccctcatgcaagtgtccaaagaaattgggagagcggatagctacctgggccgcatcggcgaccggtctaaggagctttattttcacagacagaccgtggggcagtacctgtggcgcctcatttgcgataatcctaaccagtccctgaaaaatcttgtcttctatcggcaggactaccaacatgagtttgaaacgctgtggagcatccagacaaagtaccacgtggagctcaccgaagatctgagaaaacgggttggacgcatcattttctttcagagacccctgaagtccaaaaagggcctcgtgaaccggtgtgagctggtccactattctgtgtgcgaaaatagcggggacgatcttacagagaaggttgacgtgggacctaaagtctgtccgaagtccagccccctgttccaggagtttaaagtgtggcaagtcctcaacaatgtggaagttatccatccttctacccaggaggctagacgcctggaaatggaggagaaggaacttctggcctccgagctcctgttccgggatagaatgaaaaagattgacgtgctgaagctcctgtttagcaactggcgcgatcttgacctgaattacaaagaactcgagggcaacagaaccatggccgctttctatcgggtctacgaacaggtgatcgcccagacagggcacggagactatgatttcgctaagatgcgcgccgcgaaagttaaggagctggccgagggcgtgtttgctggcctggggttcgaagtcggacttctcacgtttgacgccgagctggattctcccgcttacgaacaacagccttgctatagactgtggcatctcctgtacagctacgagggcgacaaatccgccaccgggaacaagtgtcttctgaagaaactctgccggctgacaggaatgaatgcggaactggtgggccttttcatgcagattcgcttttctggggattatggcagcctctccaccaaggccatgagacggatcctgccctacctgaaagctggaaacacatatgacgtggcctgtgagtacgctggcttccgccacagcgccagatctctcacccgggaggaactggcccagaaggagtataaagattaccttgacctgctcccgcgcaattccctgagaaaccctgttgtcgaaaagatcctgaatcaaatgattcacgtggtgaacgggcttagctctacgtatggaaagcccgatgagatccgggtcgaaatggctagagagctcaaaaagtccgcgcgcgagcgggaagagatgacaagcgccatttccaaaaccaccaaggaaaatgctgagatcacagccattctgcagagagactttggcctgcgctacgtgtctcggaacgatatcctcagatacaaactgtattgcgagcttcgcatcaaggggaatggatgtcggaccctgtacagcaacacatatattaatcctaacgaactcttctccagagagtttgacatcgaacatattatcccccagtctcgcctgttcgatgacagcttttccaataaaacgctggagagccggaccgccaaccttgaaaagggcgacagaacagcttgggattacgttaatgagaagtatggggccgagcgggcggacgaataccgcgctcaggtggaggccctctatagagatggcaccatttctaaagccaagcgggacaaactgctgatgcccggagataagatccctgaagacttcattgatcgcgacatcagaaacacacaatacatcgctaaaaaggccctcgagatttttgaagatttcgtcccgtccgtggttgcgaccagcggcaacgtgacggctcggctgagagaggactgggggcttgtcgatgtgatgaaggagctgaattggtctaaatacgaatcccagggaatggttcacatcgagtatgaccgcgatggccggcccattagacgcatcgtggactggaccaagcggaacgaccatagacaccatgccatggatgccctcgctgtcgccttcacaaaacgcagctacattcagtatctgaatcacctgaacgctcggaaggaagccacctctgtggcgtacgccatccaacacaaagagatggaacttgacgggagcaatagatggcgctttaagtgccctttcggagatagatccgcttttcggcgcgaggccaaggctcagctggagagaatcctcgtgagcattaaatctaagaacaaagtcctgacaccctccgttaatcggaccaagaaacgcggcgggttcaacaagaaggtggaatggacgcctagaggcgccctccataatgagacagtgtatggacggatcagacgctacgacgtcaaagaactgcgggtgggcagctcctttaccgccgaggttattgggaaggtggctgattctagatatcgcgcggcccttatgcaccggctggctgagttcggaggcgaccccaaaaaggcctttacagggaaaaacagcctcgaaaagaatccgctgtacaccgatgaggcccataccgcttgcgtcccttcctctgtgaaagttgtgagcttcgtcgaaatcggaacaattagaaagggcgtggaccccaacctgaatgttgataaggtggtcgacacgcacatcaaaaacatccttctggcccggctctccgcgtacgggggcgatgctaagaaagccttttctaatctggacgccgaccctatttggctcaacaaggagaaaggaatcgctattaagcgcgtgaccatcagcgatgactccgaagtgagacccattcacgtcaagcgggatatgcgcggcagactggtttgtgacgagcatgggcggcctgtgcccagcgattatgtgcagcttcgcaacaatcaccatgtcgccatcttcagagacgcgaacggagagctgaaagaacgggtggttacatttttcgaggctgtggaacgcgtcagacagctccggtctgagggcagagccgtggaagttatcgataagaattacaaatgcgaggaggggtggacctttctgttctccatgaagattaacgaatatttcgtgtttccggacgccgctagcggattcgatcctcgcgagatcgacctgacagatcccgccaattacgctcttatttctccccacctgtttcgggtccaaaaactctccagcaaggactattacttcagacatcacctggaaaccacggtgaacgatgtcaagcagctccgcgacatcacatggaaacggatttcttccctgcaggaccttgccggcaccgtgaaggttagagtgaatcacatcggccagattgtcgcggtgggggagtattga

SEQ ID NO: 4375 - RNA, 4146 nt, synthetic construct
  misc_feature 1..4146: note = Cas9 variant
  source 1..4146: mol_type = other RNA
atggtgaagaaaaagtacgccatcggcattgacatcgggaccaacagcgtcggatggtccattgttacagatgactataaagtgccctctaagaaaatgaaggtgttcggcaatacggagaagagatacatcaaaaagaacctgctcgggaccctgctttttgatgaaggaaatacagctgagaaccggcgcctgaaaagaaccgcccggcgcagatatacacggcgcagaaatcggattctctacctgcaggaaatcttcgcggaggaaatcaacaagattgacgatagctttttccaacgccttgacgattcctttctgatcgtcgaggacaaacagggctctaagcaccctattttcgggaccctccaggaggaaaaggagtatcataaacagtttccgacaatctaccacctgagaaagcaactggctgatagctcccagaaagccgacattcggctcatctatctggcccttgctcatattatcaagtaccgcggacacttcctgtttgaaggcgatctcaaatctgagaataaggacgtgcagcatctgttcaacgattttgttgagatgttcgacaaaaccgtggaaggcagctacctttccgagaatctgcccaacgtcgccgacgtgctcgttgaaaaggtgagcaagtctagacggctggagaatatcctgcactattttcctaacgagaaaaagaatgggctgttcggaaacttcctggctcttgccctgggcctccagcccaattttaaaacgaacttcgaactggcggaggatgccaagattcaattttccaaagaaacctacgaggaagaccttgaggaactgctcgggaagatcggagatgactatgctgatctgttcattgccacaaagagcctgtacgacggcatcctcctggctgggattctttctaccacagattccaccacgaaagcccctctgagcagctccatggtcaaccgctatgaggagcaccagaaggacctcgcgctgcttaaaaattttatccatcagaacctgagcgattcctacaaggaagtgttcaatgacaaactcaaggatggatatgccggctacatcgagggcaagacaacccaggaaaacttttacagattcattaaaaaggctatcgagaaaattgaagggtctaattattttatcgacaagattgaccgggaggatttcctgagaaaacaacgcacatttgacaacggaagcatcccccaccagatccatctgcaggagatgcacgccattatccggagacaagctgaattttacccttttctcgtggagaatcaggataagattgaaaagatcctgaccttccgcattccgtattacgtcggcccccttgcccgggggaaatccgagttcgcctggctgaacagaaagagcgacgagaaaatccgcccttggaattttgatgaaatggttgacaaggagacctctgctgaaaacttcattacacggatgacgaattatgatcagtacctccccgaccagaaagtgctgcctaagcactccctgctttatgagaaatttgcggtgtacaacgaactcaccaaggtcagatacgtgacagagcaaggaaagagcttctttttcgatgccaatatgaaacaggagatctttgaccgcaccttcaaggtttatcggaaagtgacaaaggaaaaactgatggattttctgtctaaggagttcgacgaatttagaatcgtcgatctcctgggccttgacaaggacaacaaatctttcaatgcttccctggggacctaccatgatctcaagaaaattgtgtctgaggactttctggataacagcgaaaacgaggacatcctggagaatgttgtgcttacgctcacactgttcgaagatcgcgagatgattcggaagagactggaaaaatataaggacgtcctcaccgaggaacagcggaagaaactggagcgcagacactacaccggatggggccggctttccgccaagctgatcaacggcattagagataaagtgacacgcaagaccatcctcgactatctgatcgatgacgggacaagcaatcggaacttcatgcagctgattaatgatgacacgctttcttttgtcgatgagatcagactcgcccaaggatccggcaaagctgaagactaccgcgccgaggtgcagaacctggcggggagccccgctattaagaagggaatcctgcagtctctcaaaattgttgacgaactgatcgaggtgatgggctatgatccggagcatatcgtcgtggaaatggccagagagaatcagttcaccaaccaagggcggcgcaattcccagcagagatacaagaaaattgaaaacgccatcaagaatcttgacagcaacctcaattccaaaattctcaaggagtaccctacaaacaatcaggctctgcaaaacgatcggctgtttctttattacctccagaacggcaaagacatgtataccgatgaggaactggacatcgatcagctgtctcaatacgacattgatcacatcatcccccaggccttcattaaggacgatagcctcgacaataaggttctgacaaaatccgctaagaaccgcggaaaatctgacgatgtgcctagccttgagatcgtctataagaaaaagaatttttggcagcagctgctcgactcccaactgattagccagagaaagttcgataacctgaccaaagccgaacggggcgggcttacgaatgaggacaaggcgcgctttatccagagacagctggtggaaacccggcaaattacaaaacatgtggcccgcatcctcgataccagattcaacacaaagctggacgaggctggaaatcggattagagatcccaaagttaacatcatcattctcaagtctaatctggtctcccagtttcgcaaggactaccagctttataaagtgcgggaaatcaacaattaccaccacgcccatgatgcttacctgaacgccgtggtcgcgaccgccctcctgaagaaatatccccagctggctcctgagttcgtgtacggcgagtatccgacgtacaatagctataactctagaaagtccgccacagaaaaagttcttttctacagcaatattatgaacttcttcaagcgcatcgtggtccactctaagaccggggaggtgcggattagacccgttatcgaagtgaacaaagagacaggagaaatcgtctgggacaagaaaagcaattttcgcaccgtgcggaaggttctgtcctatcctcaagtgaacgtcgtgaaaaagaccgaggtgcagaatcatggcctcgatagagggaagcccaaaggcttctacaacgctaatctgagccctcgccccaaggagggatctgtcgaaaacctcgttccggccaaacagtcctttgacacaaagcggtacggcgggtatgccggaattagcaattcctacgctgtgctggtgaacggcatcattgagaaagggaagaaaaagtctaaggcggaagtcacggagttccaaggaatcagcattcttgccagaaaagattttgacaagaatcctaaacagtatctgctcaacctgggctacaaggacatcaaatccatcattaagctgcccaagtattctcttttcgagctggaaaatgggagccggcgcatgctcgcttccatcctgtctaccaacaataaaagaggcgagattcacaagggaaacgaaatgtacctccctgataaatttgtgacactgctttatcacgccatgcgggttaatcgcaccctggagcccggccataagaaatacgtggaagcccacagacatgtcttcgacgagctgctcacatacatcctggagtataacgaaaagattgtgggggctaaggccaatggaaaacggatcgttgaggcgtacagcgctagaaaggataccgacaaccttgaggaactgtgcaactcctttattaatctcctgaacctcacggccctgggcagcgccgtggatttcgaatttcttgggacaaaaatccctcgctatcgggactacaccccctcttccctgctgaaggctaccctcatccaccagagcgtcacaggactgtatgagaccagaattgatctttctaaactgggcggggactga

SEQ ID NO: 4376 - RNA, 4146 nt, synthetic construct
  misc_feature 1..4146: note = Cas9 variant
  source 1..4146: mol_type = other RNA
atggtgaagaaaaagtacgccatcggcattgacatcgggaccaacagcgtcggatggtccgttgtgacagatgactataaagtgccctctaagaaaatgaaggtcttcggcaatacggagaagagatacattaaaaagaacctgctcgggaccctgctttttgatgaaggaaatacagctgagaaccggcgcctgaaaagaaccgcccggcgcagatatacacggcgcagaaatcggatcctctacctgcaggaaattttcgcggaggaaatcaacaagatcgacgatagctttttccaacgccttgacgattcctttctgattgtggaggacaaacagggctctaagcaccctatcttcgggaccctccaggaggaaaaggagtatcataaacagtttccgacaatttaccacctgagaaagcaactggctgatagctcccagaaagccgacatccggctcatttatctggcccttgctcatatcattaagtaccgcggacacttcctgtttgaaggcgatctcaaatctgacaataaggatgttcagcatctgttcaacgagtttgtggagatgttcgacaaaaccgtcgaaggcagctacctttccgagaatatccccgacgtggccgatatcctggttgaaaaggtgagcaagtctagacggctcgagaacgtcctgcagtattttcctaatgagaaaaagaacgggctgctcggaaatttcctgtcccttgctctgggcctccaacccaacttcaaaacgaattttgagctggccgaggacgcgaagattcagttcagcaaagaaacctacgaggaagatcttgaggaactgctcgggaagatcggagacgattatgccgacctgtttattgctacaaagtctctgtacgatggcatcctcctggccgggattctttccaccacagacagcaccacgaaagctcctctgtcttccagcatggtgaaccgctatgaggagcaccagaaggatctcgccctgcttaaagacttcatcagacagaacctgtccgattcttacaaggaagtgtttaatgacgcgctcaaagacggatatgccggctacatcgagggcaagacaacccaagaagatttctacaagtttgtcaaaaagacaattgagaaaatcgaagggagcgactatttcattgataagatcgaccgggaggattttctgagaaaacagcgcaccttcgacaacggatccattccccaccagatccatctgaaggagatgcaagctatcattatccggcaggccaagttttaccctttcctcgaagagaatcaggataaaattgaaaagatcctgacctttcgcattccgtattacgttggcccccttgctagagggaacagcgagttcgcctggctgaatcggaaatctgacgagaagatcagaccttggaacttcgatgaaattgtggacaaagagacatccgccgaaaattttatcacgcgcatgaccaactatgatcagtacctccccgaccaaaaggtgctgcctaaacacagcctgctttatgagaagttcgctgtctacaatgaactcacaaaggtgcggtacgttaccgagcagggaaaatctttcttctttgatgcgaacatgaagcaggagatcttcgacggcgtgtttaaagtctatagaaaggtgacaaaagaaaagctgatggacttcctggggaaggagtttgatgaatttcgcattgttgacctcctgggacttgataaagacaataagagctttaacgcctccctgggcacctaccatgatctcaaaaagatcgtgtctaaagacctgctggataatcccgagaacgaagacattcttgagaatgtcgtgctcacgctgacactgttcgaggatcgggaaatgatcagaaagcgcctcgagaagtataaagaagtcctgaccgaggaacagcggaagaaacttgagagacggcactacaccggctgggggcgcctgagcgctaagctcattaacggaatcagagacaaagtgacacggaagaccatcctggattatctgattgacgatggcacatccaacagaaattttatgcaacttatcaacgacgacacgctcagcttcgttgatgagattcgcctggcccaggggtctggagaagccgaggactaccgggctgaagtgcagaatctggccggctccccggcgatcaagaaagggattctccagagcctgaagatcgtcgatgagcttatcgaggtgatgggctatgaacctgagcacattgttgtggaaatggctagagagaaccaattcaccaatcagggacgcagaaactctcagcagcggtacaaaaagatcgaaaatgccattaaaaacctggactccaatctcaacagcaagatcctgaaagagtaccccacaaataaccaagccctgcagaatgatcgcctttttctctattacctgcagaacggcaaggacatgtataccgatgaggaactggacattgatcaactctcccagtacgacatcgatcatatcattcctcaggctttcatcaaggacgactctctggataataaagtccttacaaagagcgccaaaaacagagggaagtccgacgatgtgccctctctggagattgtgtataaaaagaagtccttttggaaacagctcctggacagccaactgatcagccagcggaagttcgataaccttaccaaagctgaacgcggaggcctgacgaatgaggacaaggccagatttattcagcggcagctcgttgaaacccgccaaatcacaaaacacgtcgcgagaatgctggatacccggttcaacacaaagctcgacgaggccgggaatcgcattagagatcccaaggtgaacatcatcaccctgaaatctaatcttgtgtcccagtttcggaaggactaccagctgtataaagtcagagagattaacaattaccatcacgctcatgatgcctacctcaacgctgtggttgccacggcgctgctgaagaaatatcctcagcttgccccggagttcgtgtacggagaatatcccacatacaatagctataactctcgcaagtccgctaccgaaaaggtcctgttttacagcaatatcatgaacttctttaaacggattgtggttcactctaagacaggcgaggtgagaatccgccctgtcattgaagtgaataaagagaccggggagatcgtttgggacaagaaaagcgatttccggaccgtgagaaaggtcctctcctatccccaagtgaacgtggtcaagaaaacagaagttcagaatcacggcctggaccgcggaaagcataaaggcttctacaacgccaacctcagccctcggcccaaggaggggtctgtggaaaatctggtgccggctaaacagtcctttgacacgaagagatacggaggctatgccgggatcagcaactcctacgccgtccttgtgaatggaattatcgagaaaggcaagaagaaatctaaggctgaggttaccgagttccaagggattagcatcctggcgcgcaaagattttgacaagaaccctaaacagtatctcctgaatctgggctacaaggatattaagtccatcatcaaacttcccaagtattctctgttcgaactcgaaaacggaagccggagaatgctggcctccattctctctacaaataacaaacggggcgagatccacaaggggaatgaaatgtacctgcctgacaaatttgtgacccttctgtatcatgctatgcgcgtcaacagaacactggagcccggacacaagaagtacgtggagacccaccggcatgttttcgatgaactcctgatttacatccttgagtataatgaaaagattgtgggcgccaaagccaacgggaaacgcatcgtcgaggcttacagcgccagaaaggacacggataatctggaagaactctgcaactcctttattaatctgctcaacctgacagcgcttggaagcgctgtggacttcgagtttctgggcaccaaaatccctcggtatagagattacaccccctcttccctgctcaaggccacactgatccaccagagcgttaccgggctttatgaaacacgcattgacctgtctaagctcggcggagattga

SEQ ID NO: 4377 - RNA, 4146 nt, synthetic construct
  misc_feature 1..4146: note = Cas9 variant
  source 1..4146: mol_type = other RNA
atggtgaagaaaaagtacgccatcggcattgacatcgggaccaacagcgtcggatggtccgttgtgacagatgactataaagtgccctctaagaaaatgaaggtcttcggcaatacggagaagagatacattaaaaagaacctgctcgggaccctgctttttgatgaaggaaatacagctgagaaccggcgcctgaaaagaaccgcccggcgcagatatacacggcgcagaaatcggatcctctacctgcaggaaattttcgcggaggaaatcaacaagatcgacgatagctttttccaacgccttgacgattcctttctgattgtggaggacaaacagggctctaagcaccctatcttcgggaccctccaggaggaaaaggagtatcataaacagtttccgacaatttaccacctgagaaagcaactggctgatagctcccagaaagccgacatccggctcatttatctggcccttgctcatatcattaagtaccgcggacacttcctgtttgaaggcgatctcaaatctgagaataaggacgttcagcatctgttcaacgattttgtggagatgttcgacaaaaccgtcgaaggcagctacctttccgagaatctgcccaacgtggccgacgttctcgtggaaaaggtcagcaagtctagacacctggagaatatcctgcactattttcctaacgagaaaaagaatgggcttttcggaaacttcctggctcttgccctgggcctccagcccaattttaaaacgaacttcgaactggcggaggatgccaagatccaattttccaaagaaacctacgaggaagaccttgaggaactgctcgggaagattggagatgactatgctgatctgttcatcgccacaaagagcctgtacgacggcattctcctggctgggatcctttctaccacaaactccaccacgaaagcccctctgagcagctccatggtgaatcggtatgaggagcatcagaaggatctcgcgctgcttaaaaactttattcaccagaatctgagcgactcctacaaggaagtgttcaacgataaactcaaggacggatatgccggctacatcgagggcaagacaacccaggaaaatttttaccgcttcatcaaaaaggctattgagaaaatcgatgggtctaactattttattgaaaagatcgagagagaggacttcctgcggaaacaaagaacatttgacaatggaagcattccccatcagatccatctgcaggaaatgcaagccatcattcgccggcaggctaagttctacccttttctcgaggaaaaccaggataagatcgagaaaattctgaccttcagaatcccgtattacgtcggcccccttgcccgcgggaagtccgagttcgcctggctgaatcggaaaagcgacgaaaagattagaccttggaactttgatgagatggttgacaaagaaacctctgctaagaatttcatcacacgcatgacgaactatgatcagtacctccccgaccaaaaagtgctgcctaagcactccctgctttatgagaagtttgcggtgtacaatgaactcaccaaagtccggtacgtgacagagcagggaaagagcttctttttcgatgccaacatgaaacaggagatttttgacggcgttttcaaggtgtatagaaaagtcaccaaggaaaagctgatggattttctggggaaagagttcgacgaatttcgcatcgtggatctcctgggacttgacaaggagaataaatctttcaacgctagcctgggcacataccacgatctcaagaaaatcgtttccaaggactttctggacaactctgaaaatgaggatattctggagaacgtggtccttaccctcacgctgttcgaagaccgggagatgatcagaaagcgcctggaaaaatataaggatattctcacagaggaacagcggaaaaagctggagagacggcactacaccggctgggggcgccttagcgccaaactgatcaatggaattagagacaaggtgacccggaagacaatcctcgattatctgatcgacgatggcacctccaactgcaatttcatgcaactgattaacgacgatacacttagctttgtcgacgagatcagactcgcccaggggtctggagaagctgaggattaccgcgccgaagtgcagaatctggcgggctcccccgctattaaaaaggggatcctgcagagcctcaaaattgttgacgagctgatcgaggtgatgggctatgatccggaacatatcgtcgtggagatggcccgggaaaaccaattcacgaatcagggaagacgcaactctcagcagagatacaagaaaattgagaatgccatcaagaaccttgactccaatctgaacagcaaaattctcaaggaataccctaccaataaccaagctctgcagaacgaccggctgtttctttattacctccagaatggcaaggatatgtatacagacgaggagctggatatcgaccaactgtcccagtacgatattgaccacatcatcccccaggccttcattaaagatgactctctcgataacaaggttctgaccaaaagcgctaagaatcgcgggaaatccgacgatgtgccttctcttgaaatcgtctataagaagaaatctttttggaagcagctgctcgactcccaactgattagccagagaaaattcgacaacctgacaaaggccgagcggggaggccttaccaatgaagataaagcgcgctttatccagagacagctggtggagacgcggcaaattaccaagcatgtggcccgcatgctcgacacaagattcaacaccaagctggatgaagctgggaatcggatccgcgaccccaaagttaacattatcacactcaagtctaatctggtctcccagtttagaaaagattaccagctttataaggtgcgggagatcaacaattaccaccacgcccatgacgcttacctgaacgccgtggtcgcgaccgccctcctgaaaaagtatccccagctggctcctgagttcgtgtacggagaatatccgacgtacaatagctataactctagaaagtccgccacagagaaagttctcttttacagcaatattatgaacttcttcaagcgcatcgtggtccactctaaaaccggcgaagtgcggattagacccgttatcgaggtgaacaaggaaacaggggagattgtctgggataaaaagagcgactttcgcaccgtgcggaaggttctgtcctatcctcaagtgaatgtcgtgaaaaagaccgaggtgcagaaccatggcctcgatagaggaaaacccaagggcttctacaatgctaacctgagccctcgccccaaagaagggtctgtcgagaatctcgttccggccaagcagtcctttgacacaaaacggtacggaggctatgccgggatcagcaactcctacgctgtgctggtgaatggaatcattgaaaagggcaagaaaaagtctaaagcggaggtcacggagttccaagggatcagcattcttgccagaaaggattttgacaaaaaccctaagcagtatctgctcaatctgggctacaaggatatcaaatccattatcaagctgcccaaatattctcttttcgaactggagaacggaagccgccggatgctcgcttccatcctgtctaccaataacaagagaggcgaaattcacaaagggaatgagatgtacctccctgacaagtttgtgacactgctttatcacgccatgcgggttaaccgcaccctggaacccggacataagaaatacgtggagacacacagacatgtcttcgacgagctgctcatctacattctggaatataatgagaagatcgtgggcgccaaagctaacgggaagcggattgttgaagcctacagcgcgcgcaaagataccgacaatcttgaggaactgtgtaactcctttatcaacctcctgaatctcacggctctgggaagcgccgtggatttcgagtttcttggcacaaagattcctagatatcgggactacaccccctcttccctgctgaaggccaccctcatccaccagagcgtcacagggctgtatgagaccagaatcgatctttctaaactgggcggagactga

SEQ ID NO: 4378 - RNA, 4149 nt, synthetic construct
  misc_feature 1..4149: note = Cas9 variant
  source 1..4149: mol_type = other RNA
atgaagaaaatcgtgaactacaatctgggcctcgacattgggaccagctccatcggatatgccgctattgatgaccagggcagacccgtccggcaccaaaacaagacagttatgggggtgcgcctgttcaaagagggaaagacggccgaatctaccagaatctttcggggcacacgcagacggcttagccatcgccactggagactggggtacctcgatcggattttcgacaatgagatcgcgaaagtggatgaaaactttctgcctcgccttaaggcttccaagagagcccggtctgacgagaaacgcagcttcagaggatccctgctctttccggaaaccggcgatgacgcctattaccagaagtatcccacaatctaccatctgcggtatgctctgattacccagaaaaagcagttcgatatccgcctcatttacctggcccttcaccatatgatcaaatacagaggcaattttctggacacaacccctgtctctgctttcaacattcacgatatcgacctcacggatcaatttgccagcctgaatgactgctatcagcttctggacatggatttcgagtttcagttcgacctcaacaatattgaacaggtgcaaaagctgctgctcgatgaaaccctgtccaagacaaaacggcaggcggccgttagcaaggtgcttgtcatgtctaccgggaacaaagcctttgacgatcagcagaatggaatcgcctccgagttcatcaaggctctgctcggcgggcccttcgacctgagcaaaattcttaacctgtctgtggccgatgttaagtcctggaaactccacatgacagacaaggatgtggacgataccctgaatagcctggtcgaggagctcgacgagaaccataagcaaatcgtgaatctgcttcagatgatttactctcaggtgatgatgctgggactcctgaacggccaacagtccatcagcgcgtccatgattgaaagatatgacgatcacgccaaacattgggctgcccttaagaaactgctccctgctctgggggagcaggaacagtctacgatcatccacgcctacacagcctataccggacacagccgcacaaagcaactgtcccgggctgagttttacaccaaagtcaacagcattctcaagaagcatgaaaatatcgcggaggccaccggcctgattgagcttatcgacagaaacgagttcatgcccaaacagcgcgatgctgttaatggcgtgattcctcaccagctgcatcagcgggaactccaactgatcatccagaaccagcagaagtattacccgtttctggccgccaaggcttaccccgacgccgatgaaacaatgattgagcaacttctctctttcagagtgccttattacgcggggcccctggtcgaccgcgattttatcaatgaatccagcgaccaggagcaggctatgcagaacacgaagttctcttggctgaaacggagagaggccggagaaattaccccttggaattttgagcaaaaggtggatgttcaggaaacagccaaccgcttcatcaagcggctcaccacaaaagacacctatctgatgacggaggatgtgcttcccaaggaaagcctgatttaccagagatttgaggtcctcaatgagctgaacgctatccgcattaatgaccggagactgacagccgaaaacaaacaacttgctttccagcagctctttatggccggcaataccaagaacgtgtccatcaaaaagttccggaattttgttttcgattctctgaagttcccggagaaagtgaagatcaccgggtttgcgggacagcacaacttcctggccaaactcagcacatatcatgactttaagaaaattttcggcgaacgcgtcgaccacaccgatctgcaacctgactttgagagaatcgtggagtggtgtacaattttcgaagatcggcacatctacagagagaaacttaaagaaattcagtggctgtcccagagcgagatcgaccagctcgtcctgatccgcaaccatgggtggggacggctgtctaagagacttctcacgggcattcgcgattccgacggcagaaccgtgatggatcaactgtggtttgggacagacaatttcatgcggatcattagccagtctgattttgctgccgctatcgccaacgaaaatcgcacccagctgaaccagcacggactcgaggacgttctggattccgcgttcatgagcccccaaaataagaaagccattagacaggtgcttaaggtcgtggacgatatcgagcagacactgggctgccctcccaaaaaggttatgatcgaatttacccggtcccccgacaaaaagaagcaacgcacggtgaccagactcgagaaagtccagcaggcttataaggccgtggctgaccagctggccgggcaatctattgtgagcgaactggatcagtacgccaacacacattccaaactttctgacacctactatctctacttcatgcagctgggacgggatctgtatagcggcaagcctatcgacattgattccccgatgctcgacgatgaccacatcctgccccgcgcttttatgaaagataatagccttgacaacagagcgctgacagagaagcctattaataacaccaaggccgctaaattcccctctaaggttttcgggcagcaaaaagaagtcacggatttttggaagctcctgcggcgctgtggcctgatgtccaatatcaaagagaagcacctttacctggaccctgacaacgtggataagtggacaagacggggattcatccatagacagctcgtggagaccagccaggtcattaaaatcgtggccaatattctgaacgaccgctatcagcaatctcagacagaagttctcgaggtgcccgcccggctgggcaccgaacttagagagtgctttgggtggtacaaggtccgcgaagtgaatgattatcaccatgttttcgacgcttacctggccgcgtttatcggaaactacctctatcggagatacccgaaactgcagccttatttcgtgtacggcaactttgctgagctgaataaggcccagcttaaaaacattaagtccttcaattttctgtataacatcaccgataataaacgcgtcgtgaaggacattgagacagggcaaacgctctgggatgaccagatccggcagcaaatccagcacatttacgaatataagtacatgctgaccagccatgaggccttcacacagcacaaagaactctacggacagaccatctatcccagacgcgagtttaagcctggcacactgaaagctattaagcaagatcagccccaggagctttacgggggctataaaaacctgaccgccgcgtacatgtgtatcgttaagattcaggctcggaagagacgggccgccgaatatcgcgtggtcagagtggctacggagtctctcagcgccctgcaacaggctaaacggctgggagtgcaggcctacgaacgctgccttagacaggagctggtccggaataacgaaatcctcagaacaaatgcggaccctaactccgctccccgcgagttcgaggttctgctcgatcgggtgctgtgtcaccaaatgatcattagcgacggccagaagtatcttctggggtctcatgcttacaaaatcaattgcatgcagctggtgctctccaacaatagcatgaagattctgtccacctctatcgtcaaacttaagcaaatgaccaacgaaccgctggtgcaggtttacagagagattctcgatgtggtcaataagtatttcacactgtacgacgtgaacagctttcgcgaaaacctcaatcagttctttgacaaattccggaccctgcctatcacaaacgagtatgaatcctctaagagcggaaagaaacttatccacagaggccagctggagacgctgaccctcattctgcgcgggcttcatgccaattccgataaagttcaatacggagaccagtctacactgctcggcgggtttcagaccaaggatggcatcaagctgagcaaagactccgtgattcagtatacaagccccgctggactcaacgtccggaccgtgaagctgagagatcttgagcaaaaagaagcccagaagtga

SEQ ID NO: 4379 - RNA, 4149 nt, synthetic construct
  misc_feature 1..4149: note = Cas9 variant
  source 1..4149: mol_type = other RNA
atggtggacgagaagatcttctggggcctggatattgggaccgacagcgtcggatgggccgttacaaactccgaatacaaactcaagaaatataagaataacctgatgtggggcgtgcacctttttgatgaggctaaacagtctgccgaaagacggagcttccgcacggcgagacggcgcctggacagacggaagcaacgcatcattctcctgcaggagtttttcgtgagagctgtctgcgaaaaggatgagaactttttccggcgccttaaagagtccgccctgctccccgaagacgccgagcatagaaccaacaatatctttttcgatgaccctgattacacagacaaggattattttgaagagtacccgaccattcaccatctgatctgtgagctgatggaatctaaagagccccacgacgtgcggctcgtttatctggcttgcgtgtaccttctggcccatcgcgggcacttcctcctgcctgtcagcgaagatgacatctccaaggtgacagagtttgaacccctttatgagtctttctacaaagctctggaggaaaagctcgacgatgagcctccctttgacagaagcgccgatgacttcgcggaaattctgaagtcccacaaaaccgttagcgccaagaacaaagatttcgacaagctgctctttggaggcaaagtgaagacatacgataatgagaacatctcttattccgctctgattaaacttctgagcgggggaaccgaaaagctctctaagttctttgccaatgaggagtacacggacctggaaaaagattccgtctgtgtgcggaacgctgacttcggcgatacccttgagatgctggaaggccagatcgacgagctcgactttgccctgctcaagagcgtgaaatctctctatgattggtccctgcttgtcgacattctggaaggcaagagcctcatctccgaggcgaaaaaggataagtacgacgagcatggatatgatctggacgcccttaaatacctgttccgcgaatatctcacaaaggatgactacaatgagatgtttaaagaagtttctggcaagcagaactacgctagctatgtgtacaatgcctccagcgataaaaccagagactctaagtataagaaatgctcccaaaaggatttctgtaaatttacaaagaaattcctgagcaagattaagcctaacgagaaagacaagccgtgcctggataaactcctggagaagtgtgaacaaaattctctttgccccaaacaggtgaccacggacaaccgggtcatcccttaccagctgtattacgtggagctcaagaaaatcctggaaaacgcttgtgggtatctgccctttcttaatgagagagacgaatacggaacagttgccgataagattctgagcatcatgaagttcagagtgccttactatgtcgggcccctggtggactccaaaaagtctccgaatgcctggctggttcggaaactcgatgggaagattaccccttggaattttacagacatggtgaacgaggatgagagcgaaaatgctttcatcagacgcatgacctgcaaatgtacctacgtcgcgggacaggacgtgctgcccaagtattcccttctgtacagcaagttctctgtcctcaacgagattaataacatcaaactgaatggcgaacctatctccgtgcagacaaagcaggagatttatacggaactgtttgagcggaacaaaagcagagtttctaagaaaaagatccgcgattgccttatttcccacggctacgccgctgacagcgatgaggtgaccgggatcgacgatattgccaagtccgccctccggtcttatcatgacttcaaaaagatgctgagcaatggaatcctgacagaacagcaagtcgaggaaatcattgagcacatcaccgtgacaaccgataacattagactcaaaaagtggctgaaaacgcagtttcccatgcttgctgacgaagacgttaagtacatcacaaagctgaaatacaaggattatggccgcctctcccggtgcttcctggaggacgtgctgcccgtcgataccaaaaccggggaggccgaatctgacaagaatattatcacaatgctttgggagaccaacgaaaatattatgcagctcctgagctccaaatacagatatagcgagaacatcgagcacatgaaccgccaatactatgcgctgcctgaaaatcataagtctatgtccgagcggctcaaagatatgtacgtgccgacagctgtgagacgggccgttacgcgcacctttgacatcgtcaaggaactgaagaaaattcagggaagagatcccgacaagatcttcattgagatggcccggggcacaggggaaacccctaaaggaaagagaacaaacagccgcaaagatcagatccttgagcactggcatggcctggacaataaggatattaacgacctcaagaaatctggcatctgggagcacctggacaccatcgatgacgctaagctgcggtccgataaatattttctttacttcatgcagctcgggagatgtatgtacacggaaaagcccattccttttgaggaagtggagaatgaacataaatggaacatcgaccacatttggccccaagccaagatcaaggatgacagcctggataataaagtgctggtctctagcaacgagaatggaaagaaatccgacagctatccgatttctgatgacatccgccactccatggctggcctctggcatagcctgtacaagaaagggcttatctccgagaagaagtatcagagactgacccggtctacacctttcaccgatgacgaactcagcggatttattgcccgccagctggtggagacaagacagtccaccaaagcggttgccacgctgcttaaggaacaattccccaacacagagatcgtgtacgtcaaagctggcctggtgtctgattttcggcaggaaatggggatgctcaagtgccgcgaggttaatgacctgcaccatgccaaagacgcttatctcaacattgtgctgggcaatgtctacaacaccagattcacaaaggatcctcttaatttcgtgaagaacaacgagaaatatagcatcaagatttttcagaaaaattccgacggaaagaaaaccggcgttatcacccggaaggtggaacgcgggggagaggtcgcctgggatcccgaaacatctttcgcgatcgtgagaaaaatgatgagcaagaactccattcggtacgtgcgctacgcctatatgagaaagagcggccagaatgggggatttttcgaccaaaaccctctgcggaaaggcaaggggatggtctctatcaaacacaatctctccattgagaagtacggcggatatgataacgctacgatcagctttttctctctggtttccattaaagactttggcgtgatcctgcttgccgtggagctgctcagcgctaataagttcctgaagaacatttctgaagccaaagagtacgccgctgataagctctccaaagaactgaatgtcaagatcgtgcccaacgacgttgcgtttccgcttaataacagatataatgtggtcaaaatcaacgccgtgctggagctcgatgggtaccgcgttatgattgctgccaagcagaatagctccatcaagttcgtgagcaacgaatctctgattctgagctcccagcacatggcctatgtcaaaaagatcaccaaatttattgagaagcggaaacaggacaaggtgtgtatgatcaacgctttctctggaatcagcattgaggataatatcgaactttacgacgttctggtgtccaagtgcaacattaaacctttcaatatcatgtacgagaacctcggcattaagctgtctgataatagagacaactttatcaaaaagagcgtcgaaaatcaagtgctcatcctgtccgagatggtgcgccttttcaaaacagggcggaaggccggagtcaacctggaagaggttggcgggcgcaaaaattctggcgtgaagaccctgaacacatgtctctataaggtgaaagactacagcaatatttttctggtcgatcagtcccccaccggacttatcgagcataagagccccaacctgctcgacctgtga

SEQ ID NO: 4380 - RNA, 4155 nt, synthetic construct
  misc_feature 1..4155: note = Cas9 variant
  source 1..4155: mol_type = other RNA
atgaacaagccctacagcatcggcctggacattgggaccaattccgtgggatggtctatcattacagatgactataaagtccctgccaagaaaatgagagttctcggcaacacggataaggagtacatcaaaaagaatctgattggggcccttctgttcgacggaggcaacaccgccgcggatcggcgcctcaagagaacagctcggcgcagatatacccggcgcagaaatcggatcctgtaccttcaggaaatctttgccgaggaaatgagcaaagtggacgattccttctttcaccgcctggaggactctttcctcgtggaagaggataagagagggagcaaatatccgatttttgccacactgcaagaggaaaaggactaccatgagaaattctccaccatctatcatctgcggaaggaactcgctgataagaaagagaaggccgacctgcgccttatttacatcgctctggcccacattatcaaatttagaggacacttcctcattgaggatgactcttttgacgtccggaacacagatatcagcaagcagtaccaggacttcctggaaatctttaataccacgttcgagaacaatgatcttctgtcccagaacgtggacgttgaagcgattctcaccgataaaatcagcaagtctgccaaaaaggaccgcattctggctcaatatcccaatcagaagtccacaggcatctttgccgagttcctgaaactcattgtgggcaaccaggctgatttcaagaaatactttaatctggaagacaagacccctcttcagttcgccaaagatagctatgacgaggatctggagaacctcctggggcaaatcggagacgaatttgcggaccttttctctgccgctaagaagctgtacgattccgtcctcctgagcggcatcctgacagtgattgacctctctaccaaagctcccctgtccgctagcatgatccagagatatgatgagcatcgggaagaccttaagcagctgaaacagtttgttaaggcctccctccctgagaaataccaagaaattttcgccgattctagcaaggacgggtatgctggatacatcgagggcaagacgaatcaggaggcgttttacaaatatctgtccaaacttctgacaaagcaggaagatagcgagaacttcctcgaaaagattaaaaacgaggactttctgagaaagcaacgcaccttcgataatgggtctatcccccaccaggtgcacctgacagaactcaaggccatcattcggagacagtccgagtactatccttttctgaaagagaaccaggaccgcatcgaaaagattcttaccttccggatcccgtactatattggacccctggctagagagaaaagcgattttgcctggatgacccgcaagacagacgattctatccggccttggaatttcgaagacctcgtcgacaaagaaaagagcgccgaggctttcattcatagaatgacgaacaatgatttttacctgcccgaggagaaagtgctgcctaagcactcccttatctatgaaaagttcaccgtgtacaacgagctcacaaaagtccgctacaagaatgaacaaggcgagacctactttttcgactctaacatcaaacaggagatttttgatggcgttttcaaggaacatcggaaagtgagcaagaagaaactgctggactttctcgccaaggagtatgaagagttcagaatcgtggatgtcattgggctggacaaagaaaataaggcgtttaacgcttcccttggaacatatcacgatctggagaaaatcctcgacaaggatttcctggacaatcccgataacgagagcattctggaagacatcgtgcagacccttacgctctttgaggatcgcgaaatgatcaagaaacggctggagaattacaaggacctgttcacagaatctcagctcaaaaagctgtatagacggcactacaccggctgggggcgcctttccgccaaactgattaacggaatcagagacaaggagagccaaaagaccattctcgattatctgatcgacgatggccggtctaatagaaactttatgcagctgattaacgacgatgggcgctccaatcggaacttcatgcagcttatcaatgacgatggactcagcttcaaatccatcatttctaaggcccaggctggcagccattccgacaacctgaaagaggttgtgggcgaactggccgggtctccggctatcaagaaaggcattctccaaagcctgaagatcgtcgatgagcttgtgaaagttatgggatacgaacctgagcagattgtggtcgagatggccagagaaaatcagacaaccaaccaggggcgcagaaattcccggcaacgctacaagctgctcgacgatggagtgaagaacctggcgagcgacctgaatggcaacatccttaaagagtatcccacagacaatcaggccctccagaacgaaagactgtttctgtactatctccaaaatgggcgggatatgtacacgggcgaggctctggacatcgataacctttctcagtatgacattgatcacatcattcctcaggccttcatcaaggacgattccattgacaatcgcgtcctggtgagctctgctaaaaacagaggaaagtccgatgacgttcccagcctcgaaatcgtgaaagattgcaaggtcttttggaagaaactgctggacgccaaacttatgtctcagcggaagtacgataacctgaccaaggcggagcgcggcgggctcacaagcgacgacaaagccagattcattcaacggcagctggtggagacccgccagatcacaaagcatgttgctagaatcctcgatgaacggtttaataacgagctggactccaagggaagacgcattcggaaagtgaagatcgtcacccttaaaagcaatctggtgtctaacttcagaaaggaatttggcttctataaaattcgcgaggtgaataactaccaccatgcccacgatgcttacctcaatgccgttgtcgccaaggctatcctgacgaagtatccccagctggaacctgagtttgtgtacggggactatccgaaatacaactcctataagacccggaaaagcgcgacagagaaacttttcttttactccaatattatgaacttcttcaagaccaaggtgacactggccgatggaaccgtcgtggttaaggacgatatcgaagtgaataacgacacgggcgagatcgtctgggataaaaagaaacactttgctacagtgagaaaggttctctcttatccccaaaataacattgtgaaaaagaccgaaatccagacagggggcttcagcaaagagtccattctggcccatggaaattctgacaagctcatccctcgcaagaccaaagatatttacctggaccccaagaaatacggcgggtttgatagccctatcgtcgcctattccgtgcttgttgtggctgacatcaagaaaggaaaggcccagaagctgaaaaccgtcacagaactcctgggcattacgatcatggagcggtctagattcgagaagaaccccagcgcgtttctggaatccaaagggtaccttaacattcgcgctgacaagctgatcattctcccgaaatatagcctgttcgagctcgaaaatggacggagacggctgcttgcctctgccggcgagctgcagaaggggaacgagctggctctccctacccaatttatgaagttcctgtaccttgcctcccgctataatgaaagcaaaggcaagcccgaggaaatcgagaaaaagcaggaatttgtgaaccagcacgtgtcttacttcgatgacattctgcaactcatcaatgatttttccaaaagagtcatcctggcggacgctaacctcgagaagattaataagctgtatcaggataacaaagagaatatcagcgttgacgaacttgccaacaatattatcaacctgttcacatttacctctctgggagcccctgctgccttcaagttctttgataaaattgtggaccggaagcgctacacatccaccaaagaggtgctcaatagcacgctgatccatcagtccatcacaggcctttacgaaaccagaattgatctggggaagctcggagaggactga

SEQ ID NO: 4381 - RNA, 4155 nt, synthetic construct
  misc_feature 1..4155: note = Cas9 variant
  source 1..4155: mol_type = other RNA
atgaagctgagaggcatcgaggacgattacagcattgggctcgacatgggaacctcctctgtgggctgggccgtcacagatgaacgggggacgctggctcacttcaaacgcaagcccacctggggaagcagactttttcgggaggcccagacagcggctgttgcccgcatgcctagaggccaacggcgcagatatgtgcggcgcagatggcggctggacctcctgcagaaacttttcgaacagcagatggagcaagccgatccggactttttcatccgcctgagacagtcccggctcctgcgcgatgacagagctgaagaacatgccgattaccggtggcccctgtttaacgactgcaagttcaccgagagagattattaccagcgctttcctacaatttatcacgtgcggtcttggctcatggaaaccgacgagcaggctgatatcagactgatttaccttgccctgcataatatcgtcaaacaccgcgggaacttcctccgggaaggacaaagcctgtccgcgaagtctgccagacccgacgaggctcttaatcatctgcgcgagacactccgggtgtggagctccgaaagaggctttgagtgtagcatcgccgacaacggctctattctggctatgctgacccaccctgatctctcccccagcgaccgccggaagaaaatcgcccctctgttcgatgttaagtctgacgatgcggccgctgacaaaaagctggggattgcccttgctggagccgtgatcggcctcaaaacggaatttaagaatattttcggggattttccgtgcgaggactccagcatctatctgtctaacgatgaagccgtcgacgctgtgagatccgcgtgtcccgatgactgcgccgagcttttcgaccgcctgtgtgaggtttacagcgcttacgtgctccagggactgctgtcctatgcccctggccagaccatttctgccaatatggtcgaaaagtaccggagatatggggaggatctcgctctgcttaaaaagctggtgaaaatctacgcccccgaccagtatcggatgttctttagcggagcgacataccctggcaccggcatctatgatgctgcccaagcccgcgggtacacaaagtacaacctcggacccaaaaagtccgaatataaaccgagcgagtctatgcagtacgacgatttcagaaaggctgtggaaaagctgtttgccaaaaccgacgctcgggccgatgagagatatcgcatgatgatggaccggttcgataagcagcaatttcttagacgcctgaaaacgtccgacaatggcagcatttaccaccagctccatctggaggaactgaaggcgatcgtcgagaaccaggggagattctatccttttctcaaacgggatgccgacaagctggtttctcttgtgagcttccgcattccctactatgtgggacctctgtccacaagaaatgctcggaccgatcagcacggcgaaaaccgctttgcctggtctgagagaaagcccgggatgcaagacgaacccatcttcccttggaattgggagagcattatcgaccggtccaaaagcgctgagaagtttatcctccgcatgacaggaatgtgcacctacctgcagcaggaaccggtcctgcccaaatcttcccttctctacgaggaattttgtgtgctgaacgagctgaatggcgcccattggagcattgatggcgacgatgagcacagatttgacgcggccgatcgggaagggatcattgaggaactcttccgcagaaagcggaccgtttcttatggagacgtggctggctggatggagagagaacgcaaccagatcggggcccacgtctgcggaggccaaggggagaaaggcttcgagtccaagctgggaagctacattttcttctgtaaggatgtgtttaaagttgaacggcttgagcagtccgactatcctatgatcgaaagaatcattctgtggaacacactcttcgaggatcgcaagatcctgtctcagcggctgaaagaagagtacggcagcagactttccgctgagcagattaagacgatctgcaaaaagcgctttaccgggtggggacggctctctgaaaagttcctgacaggcattaccgtgcaagtcgacgaggatagcgtgtccatcatggacgtcctgagagaagggtgtcccgtgagcggaaaacgcggccgggccatggttatgatggagattctcagagatgaggagctggggtttcagaagaaagtggacgacttcaatcgggcctttttcgctgagaacgcgcaggcccttggcgtcaatgaactgcctggatctcccgctgtgcgcagatccctcaaccagagcatccggatcgttgatgagattgcctctatcgccggcaaggctccggccaatatttttatcgaagtgacacgcgacgaggatcctaaaaagaaagggagacggaccaagagacgctataacgacctgaaggatgcgctggaggctttcaaaaaggaagaccccgagctttggcgggaactctgcgagacggcccctaatgatatggacgaaagactgtccctgtactttatgcaacgcggaaaatgcctctatagcggccgggccattgatatccatcagctgtctaacgctgggatctacgaggtcgaccacattatccccagaacatacgtgaaggatgacagccttgagaataaagccctggtgtatcgcgaagagaaccagcggaagaccgacatgctcctgattgatcctgaaatcagacgcagaatgtccggatactggcggatgctgcatgaggcgaaacttattggcgacaagaagttccgcaatctcctgagaagccggatcgatgacaaagctctgaaggggttcatcgcccgccaactcgttgaaaccggccagatggtcaaactggtgagatctcttctggaggcccggtatcccgagacaaacattatctccgtgaaggctagcatttcccacgatctcagaaccgccgctgaactggtcaagtgtcgcgaggccaatgactttcatcacgcgcacgatgccttcctggcttgccgggtgggactttttatccagaaaagacatccgtgtgtttacgaaaaccctattggcctgtctcaggtggtccgcaattatgtgcggcaacaggccgacatcttcaagagatgccggacaatccccgggagctccggatttattgttaactctttcatgacgagcggctttgataaagagaccggggaaatcttcaaggacgattgggacgctgaggccgaggtggaaggcattcgcagatccctcaactttcggcagtgtttcatctctcgcatgccctttgaggatcacggagtcttctgggacgccacaatttacagccctagagctaaaaagaccgcggccctgccgctcaagcaggggctgaatccctcccggtatggcagcttctctcgcgaacaatttgcttacttctttatctacaaagccagaaaccctcggaaggagcagacacttttcgagtttgcccaggtgcccgttcgcctgtccgctcagattagacaagacgaaaatgccctcgagcggtatgcgagagaactggctaaagatcagggactggagttcatccgcatcgaacggagcaagattcttaaaaaccagctgatcgagattgacggcgatagactctgcatcaccgggaaggaggaagtgcgcaatgcctgtgagctggcctttgctcaagacgaaatgcgggtcattagaatgctcgtgtctgagaaacctgtgtcccgcgaatgcgtcatcagcctgttcaaccggatccttctgcatggagatcaggcctctagacgcctctccaagcagctgaagctggcgcttctgagcgaggctttttccgaggccagcgacaatgttcagcggaacgtggtgctcggcctgattgccatcttcaatgggtctacgaacatggtcaatctcagcgatattggaggctccaaatttgctggcaacgtgagaatcaagtacaaaaaggaactggcctctcccaaagttaatgtgcaccttattgaccaaagcgtcaccgggatgttcgagcgccggacaaagatcggactgtga

SEQ ID NO: 4382 - RNA, 4158 nt, synthetic construct
  misc_feature 1..4158: note = Cas9 variant
  source 1..4158: mol_type = other RNA
atgaccaagccctacagcatcggcctggacattgggacaaactccgtgggatgggccgtcatcacggatgactataaagttccttctaagaaaatgaaggtgctcggcaataccagcaaaaagtacattaagaaaaacctgcttggggctctcctgttcgattccggaatcacagccgagggcagacggctgaagcgcaccgcgagacggcgctatacaagacggcgcaatcggattctttacctgcaggaaatcttttctaccgagatggctacactcgacgatgccttctttcaaagactggacgatagcttcctggtgccggacgataaacgcgactccaagtatcccatctttgggaacctcgtcgaagagaaagtgtaccacgatgagttccctaccatttatcatctgagaaagcaccttgccgactctagcaagaaagctgatctgcggctcgtttacctggcccttgctcatatgatcaagtaccgcggacactttctgattgaaggcgacttcaattccaaaaacaatgacctccagaagaactttcaggatttcctggacacgtataatgccatctttgagagcgatctgtctctcgaaaactccaaacagctggaggaaattgtgaaggacaaaatcagcaagtctgcgaagaaagatcggattcttaagctgttccccggcgagaaaaattccgggatctttagcgagttcctcaagctgatcgtcggaaaccaagccgacttcagaaaatactttaatcttgatgaaaagacctctctgcagttctccaaggagagctatgacgaagatctcgagacactgctgggccatattggggacgattactccgacgtgtttctcaaagctaagaaactgtatgacgccatccttctgtctggcattctcaccgttacagataacggaaccgaagctcctctgagctccgccatgatcatgcgctacaaggagcacgaggaagaccttgcgctgctcaaagcctatattagaaatatcagcctggagacgtacaacgaagtgttcaaggataacacaaagaatgggtacgctggatatatcgacggcaaaacctctcaggaggatttttacgtctatctgaagcggctcctggccggccttgaaggggctgactacttcctggagaaaattgatagagaggactttctccgcaagcagcggacattcgataacggatccatcccctatcaaatttacctgcaggaaatgagagccatcctggacaaacaggccaagttttatcctttccttgctaagaataaagagcgcattgaaaagatcctcacctttcggatcccgtactacgtgggccccctggcgagagggaacagcgatttcgcctggtctattcgcaaacggaatgagaagatcaccccttggaactttgaagacgtgattgataaagagagctccgctgaggccttcatcaatagaatgacatctttcgacctgtatctccccgaagagaaggtcctgcctaaacacagccttctgtacgaaaactttacggtttataatgagctcaccaaggtgcgcttcattgccgagggaatgcgggactaccagtttctggattccaagcaaaagaaggacatcgtgagactgtatttcaaaggcaagcgcaaagtcacagataaggacattatcgaataccttcatgctatcgatgggtatgacggaattgagctcaagggcatcgaaaaacagtttaacagctctctgtccacctaccacgatctgctcaatattatcaacgacaaggagttcctggatgacagctctaatgaaacaattatcgaggagatcattcatacccttacgatgtttgaagatcgggagatgatcaaacagagactgtccaagttcgacaacatttttgataaaagcgtgctcaagaagctgtcccggcgccactacacaggctgggggaaactgtctgccaaacttatcaatggaattagagacgaaaagagcggcaacaccatcctcgactatctgatcgatgacggggtttccaaccggaatttcatgcaactgattcacgatgacgcgctctcttttaagaaaaagatcaagaaagctcagattatcggagataaggacaacattaaacaggtggtcaagagcctgcccggctccccggccatcaaaaaggggatccttcagagcattaaaatcgtggatgagctggttaaggtgatgggcagagaacctgagtctattgtcgtggagatggcccgcgaaaatcaatacaccaaccagggaaagtccaatagccagcagcggctcaaaagactggaggaatctctgaagggccttgggtccaaaatcctcaaggagaacgtccccacacgcctgagcaaaattgacaataacgctctgcaaaatgatagactctatctgtactatcttcagaacggaaaggacatgtacaccggcgaggaactggatatcgaccggctctctaattatgacattgatcatatcatccctcaggccttcctgaaggacgatagcattgacaacaaagtgctggtttccagcgcttctaatcgcgggaagtccgatgacgtgcccagccttgaggtcgtgaaaaagagaaaaacactgtggtaccagctcctgaagtccaagctcatctctcaacggaaatttgataacctgacgaaggccgaacgcggaggccttagccaggaggaaaaagcggggttcattcagagacagctggttgagacccggcaaatcacaaagcacgtggcccgcctcctggacgagagattcaataacaaaaaggatgaaaacaatcggaccctgcgcacagtcaagattatcacccttaaatcctctctggtgagccagtttagaaaggacttcgagctctacaaagtgcgggaaatcaacgattttcatcacgctcatgacgcctatctgaatgctgttgtcgcctccgcgctcctgaagaaataccccaaacttgagcctgagttcgtgtatggcgattacccgaagtataactcttttagagaacgcaaaagcgccacggagaaggtgtacttctattccaatattatgaacatctttaaaaagagcattcccctggctgacggaaccgtcatcgaccggcctctcattgaagtgaatgaggaaacaggcgagtctgtttggaacaaagtggccgatctgaataccgtcagaaaggtgctgtcctacagccaggttaacatcgtgaaaaaggtcgaggaacaaaatcacgggcttgaccgcggaaagcccaaaggcctgttcaacgctaatctctcttccaagcctaaacccaacagcaaggagaatctggtgggggccaaagaatacctcgatccgaagaagtatggaggctacgccgggatctctaactcctttgctattctggttaaaggcacaatcgagaagggagcgaaaaagaaaattaccaacgtgcttgagttccagggcatcagcattctggaccggatctattacagaaaggataagctgaattttctcctggaaaaagggtataaggacattgaacttatcatcgagctgcctaaatactccctcttcgagctgagcgatggatctcgccggatgctcgccagcattctgtccacgaacaataagagaggcgaaatccacaaagggaaccagattttcatctctcagaagtttgtcaaacttctgtatcatgctaagcgcattagctccacattcaatgagaaccaccggaagtacgtggaaaatcataaaaaggagtttgaggaactgttctactatatcctcgagtttaacgaaaattacgtgggagccaaaaagaacggcgagctgcttaaatctgccttccaaagctggcagaatcactccatcgacgaactgtgctctagctttattgggcccaccggctccgagagaaagggactcttcgagctgacaagccggggcggggctgccgattttgagttcctcggagtcaagatccctcgctatagagactacaccccctcttccctgcttaaagatgcgaccctgattcaccagagcgttacaggcctgtatgaaacgcggatcgacctcgggaagctgggagaagattga

SEQ ID NO: 4383 - RNA, 4158 nt, synthetic construct
  misc_feature 1..4158: note = Cas9 variant
  source 1..4158: mol_type = other RNA
atgcagacctacttcggcatgaagaaaatcctggggctcgacctgggaacaaacagcattggctgggcccttgtgaatgaggctaacgatgacaatgaaaagtcctctatcattaaactgggggtcagagttaaccccctcacggtggatgagcaaagcaattttgaaaagggaaaatccatcaccacaaacgccgagcggaccattaagcgctctatcagacggagcctgcagcgctataaacttagacgggaaaatctgatcgagattctcaaagagcacaacttcatcacagacgataccattctgtccgaagacggcaatgcgtctacatttgagacctaccgcctgagagctaaggccgccagcgaaaagatctccctcgaggagctggggcgggtgcttctgatgattaacaagaaacgcggatataagagctctagaaaggctaaaaatcaggaagagggccagctcatcgatggcatggaagtcgccaaggagctgtacgaaaagaacattacgcctgggcaattcgtgtttcagcttctgaagcagggaggcaaattcatcccggacttttatcggtccgatctccaggctgagttcgacaagatctgggagtttcaaaaactgttccatgccgaaattctggttgatgactttaagaagcagctcgagcgcaaagggaagctgaatagctctaaaatcttccttggaagatttggcatttacaccgcggaaaacaaggggaatgataaacggctgcaggcctatcagtggcgcgtggacgctctcacaaaggagctgaccaaggaggaacttgcctacgtcatctccgacctgaacggaattatctcctcttccagcggctacctcggctccatctctgatagaagcaaagagctgtatttcaacaatcaaacagtggggcagttcctgatggctcagctcgaccacagcccccataccagcctgaagaaccaagtgttttaccggcaggattatcttgacgagttcaatacgctgtgggaaaaccaggcccactaccataaagttctcacatctgatctgaagtccgaaattagagacgtcatcatcttttatcagcgccggcttaaaacccaaaagggactgattagcttctgcgagtttgaatctagaaagattgaggtggagatcgatggcaaaaagaaaatcaagaatgtggggagccgcgtctgtcctaaatcctctcccattttccaggaatttaagatctggcagattctcaacaatatcgagctgctggaaaagagctccaaagcgaagcggttcctcgaccaggaggagaaagaactgctttttaaggagctgagcattaaatctaagatctccaaaagcgatgccctcaagctgctgttcaagaactctagagaacttgacctcaattacaaagagattgaaggaaaccgcacacaatccgctctgtttgatgcctatagcaagatcatcgagctgtccggccacggggagtacgacttctctaaaatggaagctagcaatattatcgagctcgttcaggaagtgtttaccggactgaactacaataccgagattctttatttcgactcctctctggaaggcaaggatttcgagaaccagcctatgtaccggctctggcatctgctgtatagctttgagggcgacgattccaaaacagggaatgaaaaacttatcaacaagctcagcgagctgtacggattcgaaaagaagtattctattgtgctggccaacgtctcctttcaggaggactacggcagcctctctacgaaagccatcagaaagatccacccctatctgaaagaagggattcaatacgatgtggcttgcgagttcgcgggataccgccactccaagagctctcttaccaaggaggaaatcgagaataaaattctgaaggaccagctcgaaatcctgcctaaaaacagcctgcggaatccggttgtggagaagattcttaaccagatgatcaatgtcgtgaacgccctcaatgagtcctatggcaaacccgatgaaatcagaattgagctggctcgcgaactgaaaaagagcgccaaagagcgggaggaactcacagcctctatcggggagaccacaattaagcatgaaaaatacagagctatcctggagaacgaatttggcatttcccacgttagccggaatgacatcatccgctataaactttacctggagctcgaaaacagaggatataagaccctgtactccaatacgtatgtgtctcaggagaagctgttcagcaaagagtttgatattgaccacatcattcctcaatcctgtcttttcgatgactcttttagcaacaagacactcgaatccaagtctgtcaatatcgagaaaggcaacgataccgccttcgactacgtgtttgcgaagtacggggaagctggactgagcgactatattatccatattgaggaactgttcaaagatggcaagatctccaaaaccaagctcaataagctgaaaatgaaggggaacgagatccccagcgactttattgcccgggatatcagagacacacagtacattgcccgcatcgctaaaaacattcttgaggaaaccgtccggaatgtggtttctacatccggaagcatcacggatagactgcgcgaggactggcagctcatcgatgtgatgcaagaactgaactgggagaagtattctgccctgggccttaccgagatttacgaaaatagagaggggcacacaatccggcgcattaaagactggaccaagagaaacgatcatcggcaccatgctatggacgccctgacaatcgcgttcaccaagcgctcccacattcagtatctcaataacctgaatgccagaagcgataaatctggctccatctacggaatcgaaacgaaggagctctatcgggacgatcacggcaaactgaagttcaaacctcccattccgcttaacgaatttcgcgctgaggccaagaagcatctggagaataccctcatcagcattaaagctaagaacaaagtcgccacaatcaatattaacaccacatccaccaaggaagggaaaaataagaagagacagctgacgcctcggggacagctgcaccttgagacaatctacggcagcattcaacagtacgtgaccaaacaggaaaaggttggggcgtctttcaacgaggaacagatcagcaaagtggccaagcaaaaatatcgccaggctctgctcaatagactgcgggagtttgacaacgaccccaagaaagccttcacaggaaacaattcctttgagaagaaccctatctacctcgatgtcctgcagacccagaaggtgcccgacaaagtggaaaccgtttctaaggagattatctatacaattagaaaagatatcacgcccgaacttaagattgagaaagtcatcgacaagaagatcaaaaccattctgcaaagccgcctcaatgaatactccggcgattctaagcgggctttcagcaacctgaaagagaatcctatctggctgaaccaggagaaggggattgaaatcaaaagagtgacaatttccggcatctctaatgccgtggccatccatgacaagaaggataaaaacggaaatcttattctggacaacgagggcagcacccaggctgtcgattttgtgaatacagggaacaatcaccacgttgcgatctataaggacgaacgcggaaacctccatgagtccgtggtcagcttctttgaggcctgcacccgggtgaatctgggcgggccggttattttcaaaaactacaataagtctgatggatgggaatttctcttctccatgaaacaaaacgagtatttcgtgtttcccaacgaaaagacgggcttcaatcctaacgagatcgacctgcttgaccccgataattacagactgattagccctaacctgtttcgcgtccagaagatctcttccaaaaattacgtgttcaaccaccatctcgaaacaagcgctattaccggggagaccctgaagaataaaaagcagctttcctctgttacatatcactttatccagagcctgcccccgatcaaagacattgtgaaggtccggatcaacaatattggccaaatcgtgtgggtgggagagtactga

SEQ ID NO: 4384 - RNA, 4158 nt, synthetic construct
  misc_feature 1..4158: note = Cas9 variant
  source 1..4158: mol_type = other RNA
atggacgagctgcagaacttcgaaaagggcaaaagcatcaccacaaatgccgatagaacggctgggcggtccatgcgcagaaacctccaacggtacaagctgcgcagagagaatcttattgaagtgctgaaagagtataactttatcaccgacgaaatgattctctctgagaatggaaaccggacaaccttcgagacataccgcctgagagccaaggcggctgtcgaagagatcagccttgaacagtttgcccgggttctgctcatgattaataaaaagcgcggctataagtcctctagaaaagccaagggggctgagaacggaaccctgatcgatggcatggaggtggccaaaaagatgtacgacgaagggatcacacccggagagctgtgcctccagctgcttaccgctggcaaacggtatttccctgatttttaccgcagcgacctgcaggccgaatttgatagaatttggaattttcaaaagcagttctatccggactccctcatcgataaggtgaaagacgaggtccggggcaagaacaaatctcagacgtgggcgattctggccaagtactttgtgtggaaagaagttgagaatagctggaacgaggaagaggctcagacccgcagagtggaaaaggagtaccggcttgtcgggatcaaaagaggagtgaagcgcgaggagctgaagctcgagaatttccaatggcgggttaaagccctgtccgaaagaatgaaccccgaggaactggctattgtgctccaggagatcaatgaacagattagcaactcttccggctatctgggggccatcagcgatcgctctaaggagctttactttaaccggcagacagtcggacaatatcagatggcggtgctggacaataaccctaatatcggcctcagaaacatggtgttctaccgccaggggtatctgggagagtttaataccatttgggaaaaacaagccgagttccacaaggaacttacagaggatctgaaaaaggagatccgggacattgtcatcttctaccagagacgcctcaagtcccagaaaggcctgattaacatctgtgaatttgagcggagacagatcgaagttgagattgacggcaagaaaaagatcaaaaccattgggagccgcgtgatcccccggtcttcccctctgttccaagaatttaagatttggcagacgctcaatgatatcgaggtgagcgtcctgggagtgaagaacaaaagaaagaaacaggacgataattccacaacccttctggactctgctgagaacatcgatagcctcaagctgaatgtttcccggccccttgacgccgatgaaaagagcctgctcgctaaggagctgttcattcgcgacaagctgacaaaatctgatgtgctcaagctgctttttaacaatcctcagaacctgaatctcaacttcaaaaacatcgacggcaatagaaccgggtccgccctgtatcaagcctttagcaagattctggaaatctctggacatgagagcattaacttcaaaaagtccgctgatgaaatcgtcgaacaggtgaaaaccattttctctgcgcttggctggaatacagaggttctctgcttcgacagcgaaaaggagctggacaagcagccgtactttaaactgtggcacctcctgtactccttcgaaggggatagcacgcccaccggagacggcaaccttatccagaagatcgccgatctgtgtggctttgagaaagactatgcttctattctcgccaatatcacattccaagaagattacgggtccctgagcaccaaggccattcggaaaatcctgcctcatcttaaggacggaaaccagtatgatgtggcttgcgagtacgccggctataagcactctaaatccagcctcaagaaagaggaaattaagaataaagtcctgaaggacaagctggagctcctgcccaaaaactcccttagaaatcctgtggtcgaaaagatcctgaaccagatggtgaatgttatcaacgcgattatcacaacctacgggaaacccgatgagattcgcatcgagctcgctcgggaactgaagaaaaaggccaagaaaagagaggaactgacgaagacaattgtggacaccaccaaaacacatgagggaatccgcgccatccttcagaatgatttcggcatgtctcacgtcagcagaaacgctattatccggtataagctctacgaggaactgaaagacaatgggtacaagaccctgtattccaacacatacattccgaaagagaagctcttttctaaggatttcgacatcgaacacattatccctcaagcccgcctgtttgacgatagcttctccaacaaaacgcttgaggttaagagcatcaatattgaaaaaggctctaagaccgcttatgactttgtggaggaaaaatacggagagcagggcctgcaggagtatctcaacagatgtgaagtgctgttccgggataagaagacaaaactgcgcaaacttaaaatgcaagagtccgaaatccccgaggggtttattgacagagatctccggaatacccagtacatcgccaagaaagcgctgagcatgctgaacgaaatttgccgcagagtcgtggccacaaccggagctatcacggacgagctccgggaggattggcagctggtggacgttatgaaggaacttaattgggagaagtataaagtcctgggcctcgtggaatacttcgaggataacgacgggcgcctgattggaagaatcaaggattggaccaaacggaatgaccatagacaccatgccatggatgctctgacagtggcctttaccaaggacgtcttcatccagtactttaacaataaaaacgcgtctcttaagcctgacacaaatgaggccgctattcgcaacaagtatttccaaaatggcaaagccatccctcccatgtccctggatgaatttcgggctgaggccaagaaacacctcaacgacaccctgattagcatcaagacgaaaaataaggtggttacaattaacctcaacagaaccaagaaaaagaatgggatcaacaaaaagcagcagcagacaccccgcggccaactgcaccttgaaaccgtgtacggatctcataaacagtatgtcgtgaaggaggaaaaagttaatgccagcttcgatgctgcgaagatcgccaccgtgaacaagccggcttaccgggacgccctgctcagacgcctgcaggagaatggcaacgattccaaaaaggccttcacagggaaaaatagcctggacaagcagcccgtctggcttgatgctaaacaaaacgagtgtgtgcctgaaaaggttaagacggtgatgctggagaccgtctatacagtgcggaaacccattgacgaaaagctcaatgtggataaagtcgttgacgccagaatccgcaagctgctccaggatcggattaaagagtacggaaacgcgaagtctgcttttgccaatctggacgaaaaccctatctggcttaataaggagaaaggcattaccatcaagagagtgtccgtgagcgggatctccaaagcccagtctctgcacgagaagaaagacaaggatggaaacttcattctcgacaaggatagccggcgcatccccgtcgactttgtgaatacaggcaacaatcatcacgttgctatttatagaaaaccggtgctggataagaaagggcaagccgtcttcgacgaaaacggcgagctgaagtttgaacttgaggaagtggttgtgtccttctttgatgcggtcacccgggtgaacctgtctcagcctatcattgacaaagattacaagcgcagcgagggatggaaattcctcttttccatgaagcagaatgagtacttcgtttttcccaacgaaaagacgggcttcgaccctaaagagatcgatctgctcaatcccgaaaactatgctctgatttctcctaatcttttcagagtgcagaagatcgccagcaaagactacgtctttcggcatcacctggagacagtggtggccgatagaaaggagctgcaagaaatcacctggaaacgcatttccagcctctctatcctgaaccggattatcaaggtcagagttaatcacattgggcagatcgtgatgatcggagagtattga

SEQ ID NO: 4385 - RNA, 4158 nt, synthetic construct
  misc_feature 1..4158: note = Cas9 variant
  source 1..4158: mol_type = other RNA
atgaccaagccctacagcatcggcctggacattgggacaaactccgtgggatgggccgtcatcacggatgactataaagttccttctaagaaaatgaaggtgctcggcaataccagcaaaaagtacattaagaaaaacctgcttggggctctcctgttcgattccggaatcacagccgagggcagacggctgaagcgcaccgcgagacggcgctatacaagacggcgcaatcggattctttacctgcaggaaatcttttctaccgagatggctacactcgacgatgccttctttcaaagactggacgatagcttcctggtgccggacgataaacgcgactccaagtatcccatctttgggaacctcgtcgaagagaaagcctaccacgatgagttccctaccatttatcatctgagaaagtaccttgctgactctacgaagaaagccgatctgcggctcgtgtacctggctcttgcccacatgatcaagtatcgcggacattttctgattgaaggcgagttcaatagcaaaaacaatgacatccagaagaactttcaggacttcctcgatacctacaatgcgatttttgaatccgacctgagcctggagaactctaaacagctcgaagagatcgttaaggataaaatttccaagagcgccaagaaagacagaatcctgaaacttttccccggcgagaaaaattctgggatcttttccgagttcctgaagctcattgtgggaaaccaagctgatttcaaaaagtattttaatctggacgaaaaggcccctcttcacttcagcaaagaatcttacgatgaggacctggaaacactcctgggctatatcggggatgactactccgatgtctttctgaaggctaaaaagctctatgacgccattctgcttagcggaatcctgaccgtgacagacaacggcaccgaggcgcccctctcctctgccatgattatgcggtacaaagagcatgaagaggatctggcccttctgaaggcttacatccgcaatatcagcctcgaaacgtataacgaggttttcaaggacgatacaaagaacgggtacgctggatatattgacggcaagacctcccaggaagatttttacgtgcacctgaaaaagctgctcgtcggcctggagggggccgactatttccttgagaaaatcgatagagaagactttctgcggaagcagagaacattcgataatggaagcattccttaccagatccacctccaagagatgcgcgccattctggacaagcaggctaaattttatccgttcctggcgaagaacaaagaacggatcgagaagatccttacctttcgcattccctactacgtgggccctctcgccagagggaatagcgatttcgcttggtccatccggaaaagaaacgaaaagattaccccctggaattttgaggacgtgatcgataaagagagctctgccgaagccttcattaaccgcatgacatctttcgacctgtatctgcctgaggaaaaggtcctccccaagcattccctgctttacgagacgtttaatgtttataacgagctgaccaaagtgcggttcatcgctgaatctatgagagactaccagtttctcgatagcaagcagaaaaaggacattgtgcgcctgtatttcaaaaataagcggagagtcacagataaggacatcatcgagtacctgcacgccattgatggatatgacggcatcgaacttaaagggattgagaagcaatttaactccagcctctctacctaccatgatctgctgaatatcattaacgacaaagagttcctcgatgactccagcaatgaagcgatcatcgaggaaattatccacacactgaccatttttgaggatcgcgaaatgatcaagcagcggctttctaaattcgagaacatttttgacaagtccgtgctgaagaaactcagcagacggcactacacgggatggggcaagctgtccgctaaactgatcaatggcatccgcgatgaaaagtctgggaacacaattcttgactatctcatcgacgatggagttagcaacagaaatttcatgcagctgattcatgacgatgccctgtcctttaaaaagaagatcaaaaaggcccaaattatcggcgacaaagataacatcaaacaggtggtccaggctctcccggggcggcctgccattaagaagggaatcctgcagtctattaaaatcgtggacgagcttgttaaggtgatgggcagacgccccgagagcattgtcgtggaaatggctcgggagaatcaatacaccaaccaggggaagtccaatagccagcagagactgaaacgcctcgaagagtctctgaaggaactgggctccaaaatccttaaggagaacattcctgccaaactcagcaagatcgataataacgcgctgcaaaatgacagactgtatctctactatctgcagaacggaaaggatatgtacaccggcgaggaacttgacatcgatcggctgtctaattatgacattgaccacatcattccccaggccttcctcaaagataactccatcgacaataaggtcctggtgagctctgctagcaaccgcgggaaatccgatgacgttcccagcctggaggtggtcaagaaaagaaagacactttggtaccagctgctcaagtctaaactgatttcccaacggaagtttgataatctcaccaaagccgaacgcggaggcctgagccctgaggctaaggccgggttcatccagagacagcttgtggagacacggcagatcacgaaacatgttgcgcgcctgctcgacgaaagattcaacaacaagaaggatgaggacaataaaaccctgcggacagtgaagattatcaccctgaaatcctctcttgtcagccaatttcgcaaggatttcgaactgtacaaagtgagagagattaacgactttcaccatgcccacgatgcttatctcaatgccgtggttgcttccgccctgctcaagaagtacccgaaactggaacccgagttcgtctatggagactaccctaagtataactcttttcgggagagaaaaagcgccacagaaaaggtgtacttctattccaatatcatgaacatttttaaaaagtctatcagccttgctgatggcaccgtgatcgagcgccccctgattgaagtcaatgaggaaacgggggagtccgtgtggaacaaagttgcggacctcaataccgtgcggaaggtcctgagctactctcaggtgaacatcgttaagaaagtggaggaacagaatcacggcctggacagaggaaagcctaaaggccttttcaacgccaatctgtccagcaagcccaaaccgaactctaaggagaatctcgtcggggctaaggaatacctggatcctaaaaagtatggaggctacgccgggatttccaacagctttgccgtgctcgttaaaggaacaatcgagaagggcgctaaaaagaagattaccaacatcctggagttccaagggatttctatccttgaccgcatcacatatcggaaagataagtttaatttcctgctggaaaaaggctacaaggacattgatctcatcattgagctgcccaaatattcccttttcgaactgagcgacggatccagacgcatgctcgccagcatcctgtctaccaacaataagcggggcgagattcataaggggaaccagatctttatcagccagaaatacgtgaagctcctgtatcacgcgaaaagaatttccaatacgttcaacgataatcatcgcaagtacgtcgaaaaccacaaaaaggagtttgaggaacttttctactatatcctggagtttaatgaaaactacgtgggagctaaaaagaatggcgagctgctcaagtctgccttccagagctggcaaaaccactccattgacgaactgtgctctagctttatcgggcctacaggatccgagcggaaaggccttttcgagctgacctctagagggggcgccgctgattttgacttcctcggagtgaagattccccggtatcgcgattacacacctagctccctgctcaaagacgccaccctgatccatcagagcgtcaccggcctttatgaaacaagaatcgatctggggaagctgggagaggactga

SEQ ID NO: 4386 - RNA, 4158 nt, synthetic construct
  misc_feature 1..4158: note = Cas9 variant
  source 1..4158: mol_type = other RNA
atgaagaacaaaacctggtacctgggcctcggggtgggacccacaagcatcggctgggccgctacggactccaattataagctgcttcggaaaaacaagaaacggctgtggggagtccgcctcttcgaggaagccaagaccgcggttgatagacggacatttcgcgctgagagacggcgcctggccagacggaagtggcgcatttctcttctggaagaactcttcgccaaagaagtgagcaagaatgaccctaactttttcctgagactgaaagagtccaagtaccactttgaggataaatctctcatgaatgaatatatcctgttcaacgacaaggattacaccgacaaggattattacaaagagtatccgacaatttaccatcttcggctgagcctcaccacagaagagaatcccgacatccgcaaggtgtacctggctgtccactccatgcttaaaaacagaggacattttctgctccagggccaatctttcaatgatagcaacattgactccgtgatcaaggagctgctggaactcgagaccgttaaaatcaattttgaagtgacggatgaggtcattcacagcctgaagaaaatcgcccttgaaaagaagaacctgtctgacaaaaataacgatgtgaagaaactctatcctaaggagaaacagctgcaggagattttcaaacttgtttttgggggaaagacctccctggacaaactctacgacatcgaagagtataaggaactggataatagcgtgaaatctatttccttcaaggagaaagtctacgaagaggtgcggcccgactatgagcagatcctgagcaactacattgaactcctggatcttgctaagctggtgtatgactctatcgtcctcgccgatatcaagaaagagggcaagacaatttccgaaagcaaagttgagctgtacaacaagcataaagacgatcttgcgaatctgaagaagctcgtgaaaatcgactccaagctgtctgaagataaaaagaaagaggtgtactttaccattttcaaggaggacaaagaaaagggcacaaactatgtcaattacacccaccgcagccaagaggggaagtcctgcagctatgaagatttcaaaaagtttctgaaaaaggagctcgagaaactggaagactctcctacgaagacaaccatccttgaggaactggacctcgagacattcctgcccctgcagagaaccaaggataactccgtggttccttaccagattcacaaagaggagcttgtgaagatcctcgacaatgccgctaaatatcatagctttctggccgagaaggatgactctggatacagcacccgggaaaaagtcgtgcagctgttcgagtttagaatcccgtattacattggccccctcaacgctcaccataatacagaaaacgggggatactcctgggccatccgcaagaagggcatggagtctgttcctgtgacgccctggaatttcaaagatgtcattgacgaaagcgcgtccgccgaggcttttgtgaacaatctgaagaacaaatgtgcctatcttagcggggaggatgtcctgcctaaaaattctctcctgtactccgaatatgctctgcttaacgagctcaatgccctgcggtacgaaggaaacagaatcagcgtggaggcccgcgacgttattgtgaccaagctgttcaaggaacaaggcaagaaagtcacaaagaaaaccatcaaggagctcctgaaaacagagggctttatcgatgggaagggagaaattgtgggcatcgacaacattgttaaaaatgatcttaagtcttatcgggacttcaagaaaatcctggctgataagtttgacaaagagagagtggaaaacattatcctctggattaccctgtacggggagtcccgcaagctgatcaaagagaagatcacgaaggtctatggagacttctacacagtggatgaaattgagaaaatgagccggcttacctacaaggactggggcatcctctccagaaaactgctgaccgaactcgtgtctgagaagctgtataatgaagagacaggggagtgccttaacattatcggagcgatgcgccagggcaccattctgtttatggaactcctggccgataaattcgactacatgagccagatcaagaatcacaacaaggagaataaagatgacatcacagaaattacgcccgatatcctggagaaccttcacgcttccccggccgttaagcggtctatttggcagaccgtcagaatcgtggaggaactcaaaacaattatcggctgtgtgcctaccaagatcttcattgagacaaccaaacgcaataacgccccctataaggtccctacgctgaatcggaacgacctggtgaccaagtacaaaacaatcagagaacatgagatttttgaactcgagaaggaactgaaaaatacccttgatttcacactgaacaagaatcggctcatcaacgaggagcccagcaaactgaaggctaccaagctgtatctttactatacgcaactggggcgctgcatgtacacaggaaagaagattgacctcggcgaactgtttgataacaataacaaatacgacatcgatcacatctatccccagtccaaggttaaagacgggagcttcaataacattgtgctcgtcaccaaggcctctaatgacatgaaagcggatgtgtttcctctgaagtccaagttccagacaaaagagaacaagatcttttggagattccttaaagaaaagaaactgattaccgaggagaagtacaatcggctcgttagaaccgaagagtttagcaacggagaactgacaggcttcatcacgcgccaactggtggagacctctcaggctattaaggtcatctccaatgtgcttcgggaactgaacccggagacaaccatttgttatagcaaagccgagaatgtttctagctttagacagtccttcgggaagatcaaagaagccaaccgcaaggctgagaataacgaaaaactcatcagagtgcaggagattaatgactactataacgccaaggatgcttacctgagcatcgtcgtgggcaacgtgtatgacgtcaagtttacacggaatgttcataacttcattaaaaataacaaggatgcccgcagatactctctcaatggactgttctacaccgacgtgaaaaacgcgaatacgatcgcctgggaaatggataagacagtgcacgtcgtggagaaaaccatgaacaataacaatattcttatcacccggcgcacatccgagcaaaagggcgctctgtatgacgccaccctctacaaggctaaagttgccgaaaaggcgaaagaggggacatattaccccctgaagacgaccgatagcaaaatcaaggacgtgggaaaatatggcgggtttacaaagattaagatcgcctactattccattttcgaatacaccctggatgggaaaaagggcaaacagaagatcacaagaattgtccctatccccatctacatttctcagaacatcaaagacgacaaggcccttctggagtatgctcagacccggctccctgggaaggatctgaaaattaagtaccgcaaactctgcatcggcagcctggtgaagattaataactttaattattacatcggaggcaaaacgaacaataacttcacctttgactccgctgttcaagtgattcttgataaggactctgaaagctatatcaaggagctggccaaatacctgaactggaagaaagagaataaggatgggaaactctgggaatccatcacagaggacaagaacattcagctgtatgattctcttgtcaagaaaatgaataccggaatcttcattagaaagacacccaacaaatacaccgaactgctcacactggaggtgaagaataaatttatcaacattgacatcgatgagcaggttaagctcctgcttgaaatcctgaatctgctcaccaacaaaaagttcacgagcaagctgaatgagattggcatcacagcctccagaggggtgtgtagctttaacctttctaatcagtcccaattcagcattatcgaacagtctgtcaccggagtgtacgagaaagaaaagctgattatcgagaaaaagaaagagggcatcctctga

SEQ ID NO: 4387 - RNA, 4161 nt, synthetic construct
  misc_feature 1..4161: note = Cas9 variant
  source 1..4161: mol_type = other RNA
atgaaccagaagtacagcatcggcctggacattgggaccaattccgtgggatgggccgtcatcacagatgactataaagttcccgctaagaaaatgaaggtgctcggcaacacggataaacaatctattaagaagaatctgcttggggccctcctcttcgacagcggagagaccgcggaagctacaagactgaaacggaccgcccgcagacggtacacacgcagacggaaccgccttagatatctgcaggagatctttgccgaagagatgatgcaagtggatgaatccttctttcagcggctcgacgattctttcctggtcgacgaggataagcgcggcgagagacaccctatttttgggaatatcgctgccgaagtgaaataccatgacgagttcccgaccatctatcatctgcggaagcacctcgctgatattagccagaaagccgacctgcgccttgtttacctggcgctcgcccacatgatcaagtttagaggacatttcctgattgaaggccagcttaaggctgagaacacaaatgtgcaggccctgtttaaagatttcgtcgaggtgtatgacaagaccgttgaagagtcccacctctctgaaatcacggtggacgctctgagcattctgaccgagaaagtctccaagagccggcgcctcgaaaacctgatcgcccactaccccgcggagaaaaagaatacactttttggcaacctgattgccctcttcctggggcttcagcctaattttaaaaccaacttccaactgtctgaggatgctaagctccagttctccaaggacacatacgaagaggatctggaaggactgctcggcgaggtgggggacgaatatgccgatctgtttgctagcgccaaaaatctttacgacgccatcctgctctctggaatcctgaccgtggatgacaactccacgaaggctccccttagcgcgtctatggtcaaaagatatgaggagcatcagaaggatctgaaaaagttcgaagactttattaaggttaatgccctcgatcagtacaacgctatcttcaaagacaagaacaaaaagggctatgccgggtacattgagtccggagtgaaacaagacgaattttataagtacctgaagggcatcctgctccagattaatggcagcggggatttcctggacaaaatcgatcgggaggactttcttagaaagcagcgcacattcgataacggatccatccctcaccaaattcatctgcaggaaatgcacgccatcctccggagacagggcgagcactacccctttctgaaagagaatcaggacaagattgagaaaatcctgaccttccgcattccttattacgtggggccgcttgctcggaagggatctagatttgcctgggcggaatataaggctgatgaaaagatcacaccctggaacttcgacgatatcctcgacaaggagaaaagcgccgagaagtttattacccgcatgaccctgaatgatctgtacctccctgaagagaaagtcctgcccaagcattcccttctgtatgaaacattcacggtgtacaacgagctcaccaaagttaagtatgtgaatgaacaaggcgaggccaagttctttgacgctaacatgaaacaggagatcttcgatcacgtctttaaggaaaatcggaaagtgacaaaggacaaactgctgaactaccttaataaggagttcgaagagtttagaattgttaacctcaccgggctggacaaggaaaataaagtgttcaacagctctctgggaacataccatgatctccgcaagatcctgaataaatcctttcttgacaacaaggagaacgcccagattatcgaggatattatccagaccctgacgctgttcgaagaccgggagatgatcagacaacgcctgcagaaatatagcgatatttttacaaaggctcagctgaagaaacttgaacggagacactacaccggctggggccggctctcttataagctgatcaatgggattcgcaacaaagagaataagaaaaccatcctggactacctcattgatgacggatatgccaacagaaatttcatgcagctgatcaacgatgacgcgcttagctttaaggaagagatcgccaaggctcaaattatcggcgatgtcgacgatattgccaatgtggtccatgacctgcctgggtcccccgctatcaaaaaggggattctccagtctgtgaaaatcgttgacgagctggtgaaggtcatgggccacaacccggccaatatcattatcgaaatggcgcgggagaaccagacaaccgatagagggcgccggaatagccagcaaagactgaaacttctccaggactccctgaagaacctggataatcctgtgaacattaaaaatgttgaaaaccagcaactccagaacgaccgcctgttcctttactatatccagaatggcaaggatatgtacacaggagagacgctggacattaacaatctcagccagtacgatatcgaccacatcattccccaagcctatatcaaggatgactcttttgataacagagtgctgacctccagctctgagaatcggggcaaatccgacaacgtccctagcattgaagtggtgtgcgctcgcaaggccgactggatgagactgcggaaagctgggcttatctcccagcgcaagttcgataatctgacaaaagccgagagaggaggcctcaccgaaaacgacaaggccgggttcattaagcggcagctggttgagacacgccagatcaccaaacatgtcgctcaagtgctcgatgcgagatttaatgccaagcacgacgaaaacaaaaaggtgattcgggatgtcaaaatcatcacgctgaagtctaatcttgtgagccagttccgcaaggactttaaattctacaaggttagagagattaacgattatcatcacgctcacgacgcctacctgaatgccgtgatcggaaccgctctcctgaaaaagtatcccaaactggcctccgagtttgtctacggcgagttcaagaagtatgatgtgcggaaatttattgcgaagtctgacaaagaaatcgggaaggctacagccaaatacttcttttacagcaaccttatgaatttctttaagaaggaagttaaattcgccgatggcaccgtggtcgagagacccgacattgaaacatccgaggatggagagatcgcttggaacaagcagaccgacttcaaaatcgtgcgcaaggttctgagctatcctcaggtgaacattgtcaaaaagacggaagtgcaaacacatggcctcgaccgggggaaaccgagaggactgtttaatgccaacccctctcctaagcccaagcctgattccagcgagaatctcgtgggcgtcaaacgcaacctggaccccaagaaatacgggggatatgcgggcatctctaattcctacgctgttcttgtgaaggccattatcgaaaaaggggtgaagaagaaagagaccatggtcctggagttccagggcattagcatcctcgatcggatcacatttgaaaaggacaaaagagccttcctgctgggaaagggctataaagatattaagaagatcattgagcttccgaaatactctctgtttgaactcaaggacgggagccgccggatgctggcttccatcctcagcaccaacaataaaagaggagagattcacaagggcaacgaactgttcgtgcctcagaaatttaccacacttctgtatcatgccaagcgcatcaataaccccattaataaggatcacatcgagtacgttaaaaagcatcgggacgatttcaaagagctgctcaactacgtgctggaatttaatgagaagtatgtcggggctacgaaaaacggagaaagacttaaggaggccgtggcggacttcgattctaaatccaatgaagagatctgtaccagctttctgggcgccgttaactccaagaatgctggactcttcgagctgacatctctcggcagcgcctccgactttgagttcctgggagtgaagattcctcggtaccgcgattataccccctctagccttctgaaagactccacactgatccaccaatctattaccggcctctacgaaacgagaatcgacctgagcaaacttggggaagattga

SEQ ID NO: 4388 - RNA, 4161 nt, synthetic construct
  misc_feature 1..4161: note = Cas9 variant
  source 1..4161: mol_type = other RNA
atgaccaagatcacagaggactacattgtgggcctggatatcgggacgaacagctgcggatgggtcgccatggactccaaaaataccattctcagaatgcacggcaagacagctatcgggtctcatctgttcgatgccggaaacagcgcggctgaccggcgcgcctttagaaccacacggcgcagaattaaacggcgcaagtggagacttaaactgctcgaagagatcttcgattcccacctggccaaggttgacccctactttttcgctcggcttaaggaatctggcctgagccctctcgatacccgcaaaaatgtgtcctctatcatttatccgacaagcctggaggacaagaaattttatgtggataaccccaccatctaccatctgagatataagctcatgacggaagaccggaaattcgatctgcgcgaggtctaccttgccattcaccatatcgtgaagtatagagggaattttctgtacaacacccctgttaaggctttcgaggcctccaaaattgacgtgaagggaagcctcaaaaagctgaatgaactttacgagggcctggattctgaatttaacgtcgagctcgactccaataacgcgctggagatcgaaaatattatccgggacaaaaagatcttcaaaattaacaaggtgaaggagatcaatcagctgctcagcctgaaaacagaagataaggagcgcaccaaacttatgaaggacgtttctaaacaaattgtgaacgccatcctgggctataagacaaagtttgaaaccattctcctgaaagatgtctccaaggacgaggctgatgactgggagttcaaacttacggatgtggacgccgataataagtttgaaaacctgatcggggacctcaacgagaatgaacaggagatcctgctggtgattagaaaactcgctaacgccatcacactgagcaatattgtcgaagagggaaagaccctttctgagtccatgaaggataaatacaagaaacacagcgacgacctgaagctcctgaaacaggttatctccgatcaccccgaccgggataaggcgaagaaacttgccctggcttatgacctctacgtgaacaatagacatggcaagattctgcaggccaaagatatcctggaaaagaaaaagacactctctaaagaggacttctataaggaaatcaagaaaaacctggatgacagcaaggagtcccaagaaattcttgatgctatcagcctggactctttcatgcctaaacagcgcaccaatgagaacggggtgattccctaccagctccaccagctggagctggataagatcattgaaaatcaaggaaaatattacccttttcttaaggaggtcaacccggtgtccagccatctcaagcaggccccctacaaactggacgaactgatccggttcagagttccttattacgtgggccccctcatttctcctaatgagagcaccaagaacaaacagacaaagaaaaatcagaactttgcctggatgatccgcaaggagcaagggcagatcacgccctggaatttcgatcagaaggtcgaccggatggcttccgcgaacaaatttattaagagaatgaccacaatcgacacctatctgcttggagaagatgtgctgccggccaactctctcctgtaccaaaaattcacagttctgaatgagcttaacaatgtgaagattaacggcaaacgcatcagcgtccctctcaagcaggaactgtataataacctgtttaagaaaaattccaccgtgacgacaaacaagctcaaaagctacctgaaggagaattataaacttattaaggtcgaaatcaaaggcctgtctgacgagaagaagttcaactccgggctcaccacctacaataaactgaagaacctgaaaatctttgatcagcagattgacgatcccaattacaacaaggacttcgagcggatcattgaatggagcacaatctttgaggataaagctatttataaggaaaaacttaaaaccatcgactggctctctgatagacaaatcgacaagctgtccaaaattcgcatgcagggatggggccagctgagcaagaaactcctgtcccagcttacagataataacgggcaaacgatcattgagcagctgtgggactctcagaacaatttcatgcagatcgtgaaccaagccgattttaaggacgccattgctgttgccaatcagaacctcctggtggacaccagcgtcgaagatatcctgaatgaggcgtacacatcccctgctaacaagaaagccatcagacaggtggttaaggtggtcgacgatattgtgaaagccacctctggaaaggtgcccaaacagatcgctattgagttcacacgggacgccgatgacaatgctaagatcagccaatcccgcgccaacaaacttcggaaagtttataaggaaatgagcaatgagctcgcgtctgaaaccattagaaacgagctggaacgggtcgccaaagatcagaagctgctcaaagacaagcactacctgtatttcatgcagcttggccgcgatgcttacacgggggagctgatcgacattgataatctcgagcaatatgacatcgaccacgtgctgccccagtcctttatcaaggatgacagcctggaaaacagagtgcttgtcaaaaaggccgtgaataacggaaaatctgataatgttcctgtgaagctgtacggcaaccggatggctaccgacctcggcatgacaattagacatatgtgggagaaatggaaggaacaggggctgatcaccaaaacaaagtacaacaatctcattatcgatccggacaagattaacaaatatgagtccagcggattcatccaccgccagctggtcgagacctctcaaatcattaaacttgtgagcacgatcctgcagtccaaataccccgatacagaaattatcgttgtgaaggcccggtataatcattacctcagaaaacgcctgaacctgtataagagcagagaggtcaatgactaccaccatgcgattgatgcctatctttctgctatctgtggcaacctgctctaccaggtgtacccttatctgcggccctttttcgtttacgggcagtataagaaattttccagcgaacctgagaaggaaaagatcatttacgacaagacccgcagatataatttcatctcccaaatttttgagaacaaagataatgacatcatttctcgggagacaaagaagaaagtgttcgataagaaagacatcattgaaaagctcaaacgcgcctacaactataagtacatgctggtcagcagagagaccgaaacccacgaccaggagatgtttaagatgacagtgtacccccggctttcccgcgatacgaaaaagtctagaaatctgatcccgaaaaagaaagacatgcctaccgaaatctatggaggctacacaaacaatagcgatgcttatatgattatcgcccggattaacaagaaaaaggggcccgagtaccgcgtgttcggcgtccctatgagagagctcgttaatctgcggaaggccgaaaagaacggacactataaggcttacctgaaacaggtgcttgagcccgaaatcatgtattccaagaatggcaaaaagaacaagaccatttctagctttgagatcgtgaaagcgaaggtcccttacaaacaggtgatcctggacggggataagaaattcatgctcgcctccagcacatacgttcaaaacgctaagcagctgaccctctctcagtattccatgcaagccattacggacaattgcgaaaacgatacagaggaggaaaaggccctggtggaggcttacgacgaaatccttaccaatattgataaatatctgcccctgtttgacatcaacaagttcagagagaaactccatgccggacgcgagaagttcgtcgatctgccgcttgcggaaaagaaggagaccattctccaggtgctgaatggcctgcacgacaacgctgttatgcctaagatcaaaagcctcgggctgtctacaccccttggatttatgcagttccataccggcgtgtccctgagcgaaaatgccaagctgatctaccagtctcccacagggctctttgagaaacggctgaagatttccgatctttga

SEQ ID NO: 4389 - RNA, 4164 nt, synthetic construct
  misc_feature 1..4164: note = Cas9 variant
  source 1..4164: mol_type = other RNA
atgagcgactccaagaaattcgagggcgaaaacgtgaagtctggggataaaaagaccaataaaaaccacggaaaggtccttaagagctcccccaaagagatcagaaagaatacagaatactttattggcctcgacatcgggacgtctagcgttggatgggccgtgaccaacacagattatgagattctgaaattcaatggcaagcggatgtgggggtcccgcctttttaacgaggcttctaccgccgaagagagacggggacatcgcgtgaatagacggcgcatccagagacggcgcgacagactgaacctcctggaagagattttcagcgaagagatggcgaaagtcgatcctgagtttttcatgcggcttaaggaatccaagtttcacctggaggacaaagatgaacgcatcctcggcgagagcaatatcattttcaagggctctgaagacggggataaaaagtactatgagaaatacccgacaatctatcatctgagacacaagctgatgcaatcctgcgaggacgtggatattcgggaactctacatggctctgcatcacatcattaaatatcgcggacactttcttttcaagggcgactttgaggaaaccgggacaagcatcgagaacattatcatcgaactgctcgagctgattaataacaatcttggagttaagaaattcgagtacaacgaatctctgatcaatgagctcaagaacattgtgtccaacaccagcaatacgatcaccaacaaaaagaaactgctgggcgaatttttcaataagaaggagtacaaagcccataagtctctcttcattctgtccatcggggccagcgtcaaacccgtggatctttttctggaagaggagtataaggacatcgacgatattaaaaacatctccttcaagaatctcgaatacgaccaggttagagatacatatgagtctatttttctggacaagatcgagttcattgatgtggctaaacggctttacgacgccaccatcctgctcagcatcaagcctgaaggaaaaacactgtccgaggctaaggtcgatatttataacaaacaccataatgacctggaactcctgaagaaggtgcttaaaaccgataaggagaaatacgacagcatcctgaagctcgatattaaaaagggcaacaattatgtgaactacgtcaaaaagtctaagaatggcatctcctgtagcaaagaagagtttcacaacgccctgaagaaagttcttgtgaagattgaaaagacggacgacatcaagtacattctgaatgagatcgagctcgaaagattcctgcccctgcagcgcgtgaaggataactctgtcatcccttatcagattcaccggtacgagctcaaaaagatcctggaaaatgcgagcaaaaagtttacattccttaacgaggaatccgacgggcataccaacattgagaaaatcattaagatcatggagtatagaatcccctactatgtgggacctctgaatgatcaccattctgtttacaacaatggctttgcctgggtgagccgcaagcggtccgggagaattacaccgtggaacttcgacgaaatggtcgataaagaggaaagcgctgagcgctttatcgaaaatctcaccaacaagtgctcttatctgattggagaggacgtgctgcccaaagagtcccttctctacagcgagttctctctgctgaatgaactcaacaatatcaagtacgatggcatttccctgcctatcgacatcaaaaagagcattgttgaaaagatctttcgggtggagaaaaagagagtcaccaaaaagtatattaaagagttccttaagcaagaagggtactccgatggaaaaggcgaggtgtctggcatcgacattgatatcaagagcgacctgaagtcctatcgcgatatggtcaaaatcttcgggacagaaattgactaccggatggccgagaacatcattaagtgggtgacgctctttggagactctaaagatctgctgaagaccaaaatcaataaggaatatggcgagaaggttagcaaagaccagcttaagaaagtgtgtaagctcaaatacagagattgggggcgcctgtccaagaagttcctgacaggcattcggagctctgtcctcgtgaacgacgctaccggagaggggtatacaatcattgaagccatgagaaataccgataacaatctgatgcagcttctgcggaacgagtacgactacctcaaaaagatcgatcagatcaacatgctgtcccgcaaagacattgatgaaatcagccacgacattctggatgacctttattgctctcccgcggttaagagatccctctggcaaacgatcaaaattgtggaggaaatcaagaagatcatgggccatgagcctaaaaaggtctttgtggaggtgacacggaccaataaagccgataagaaaaccacaattaccagaaagaaccgcctgctggaactctacagcgctatcaatgccgagtctcgggactgggttaacgaactgaatagcacagaggtctccaagttcaacagcaaaaagctgtatctgtactatacgcagatgggaaaatgtatgtacaccggcaagaatattgacatcgaatctctctttacagatatgtatgacattgatcacatcttccccagatccaaaaccaaggacaacagctttgagaatctggtgctggtgacacgcaaagctaacgccgataagagagacgtctacccgatcgatcctaagattcagaccgagcggaaatccctttgggacatgctccacgataagaaactgatcggggacaagaaatacgatcgcctgacgagaaccacaggattcaccgacgacgaaatgtctggctttattgcccggcagctcgtggagacaagccaggcttccaaggcggccgctgaaatgctgaaacttatcaataacgattctgagattgtttatgtgaaagccgagaatgtcagcgacttccgccatgaaaacgagtttatcaaggtgagagaaattaatgatcaccatcacgccaaagacgcttacctgaacatcgttgtggggaacgtctataatgagaagttcaccaaaaaccccgccaattacatcaagaagggaggcgggaacaattattccctcaactgcatttttaatcggaacctggatcgcaatggcaaaagaatctgggacgaaaagaaatctattgatacggtgaaccggatgatgaaaagcaatgacgttcgcgtgacattcaaaaacagagtcgataagggacctatcctgaataaggtgaccattcacaaagcgtccgagttcatggacgatggcaagaaaaacaagaaagggtttcccatcaagagctctgagaaaaatggaaacaatcggctttgtaacctgtacaagtatggcgggtacaaggacctcaactactcccattatacaatcgtgagatacaatgtctatgaaaagaagggactggatattaaatactatatgatccccattccttactatctctgcctgtgtaacatcaatcaacacgactacgtttacgactatattagcaaccgctctaagaaagatgtgaataacatcgagatcattgtgaatgaacttaagatgggctccctgatcaacattgacgggtacaattattacctcggcggaagcaagccgaaaaccttctatgtcgatcccgcttaccagatcattctggacaaggagatcgaacggtgcattaaagagatcgtgaaggccaaaaacaatgagtatagatttatcaacaccgataagattaataagaacctgaatatgaaaatctacaagtacattgttaacaaaaagatcattggcgtgttccgcaaccggaaatgggacaagggggaatatcttaattcttccgagacaatcgaaaagtttagcggactgtccgtcgagagccaatgtaacgtgatcctcagactgattaatgatatgcgcggctctaacaaagggggagccaatagcaagttcgacgaactcgagatgacgatctcccgggctgagattcctcagaccctgtctaacgttagctcctttaaaatcattaatcagtctatcacaggccttttcgaaaacgaggtgaccatcgtctga

SEQ ID NO: 4390 - RNA, 4167 nt, synthetic construct
  misc_feature 1..4167: note = Cas9 variant
  source 1..4167: mol_type = other RNA
atgaccaagccctacagcatcggcctggacattgggacaaactccgtgggatgggccgtcatcacggatgactataaagttccttctaagaaaatgaaggtgctcggcaataccagcaaaaagtacattaagaaaaacctgcttggggctctgcttttcgattccggaatcacagccgagggcagacggctgaagcgcaccgcgagacggcgctatacaagacggcgcaatcggattctttacctgcaggaaatcttttctaccgagatggctacactcgacgatgccttctttcaacggctggacgatagcttcctggtgccggacgataaacgcgactccaagtatcccatctttgggaacctcgtcgaagagaaagcctaccacgatgagttccctaccatttatcatctgagaaagtaccttgctgactctacgaagaaagccgatctgcggctcgtgtacctggctcttgcccacatgatcaagtatcgcggacattttctgattgaaggcgagttcaatagcaaaaacaatgacatccagaagaactttcaggacttcctcgatacctacaatgcgatttttgaatccgacctgagcctggagaactctaaacagctcgaagagatcgttaaggataaaatttccaagctggagaagaaagacagaatccttaagctgttccccggcgaaaagaatagcgggatcttttctgagttcctcaagctgattgtgggaaaccaagccgatttcaaaaagtattttaatcttgacgaaaaggcttccctgcacttcagcaaagagtcttacgatgaagacctcgagacactgctgggctatatcggggatgactactccgatgtctttctcaaggccaaaaagctgtatgacgctattcttctgagcggaatcctcaccgtgacagacaacggcaccgaggcccctctgtcctctgcgatgattatgcggtacaaagaacatgaggaagatcttgggctgctcaaggcctacatccgcaatatcagcctggagacgtataacgaagttttcaaggacaactccaaaaatggatacgctggctatattgatggcaagacaaaccaggaggacttttacgtgtatctgaaaaatctcctgagcaacttcgagggggccgattactttcttgaaaagatcgacagagaggatttcctgcggaaacagagaacctttgacaatggatctattccctatcagatccacctccaagaaatgcgcgctattatcgataagcaggccaagttctacccttttctggccaacaataaagagcggatcgaaaagattctgacattcagaatcccgtactatgtcggcccccttgctcgcgggaactccgactttgcgtggagcattcggaaaagaaatgagaagatcaccccttggaacttcgaggatgtgattgacaaagaatctagcgccgaggctttcatcaatcgcatgacctcctttgatctctacctgcccgaagagaaggtgctgcctaaacactctctcctgtatgagacattcaacgtctacaatgaacttacgaaggttcggtttattgccgagagcatgtccaagtatcagttcctggacagcaaacagaagaaagacatcgtgagactctactttaaggataaacgcaaggtgaccgacaaggatatcattgaatatctgcatgccatcgacggatacgatggcattgagctgaaagggatcgaaaagcaattcaactcttcccttagcacataccacgacctcctgaatattatcaacgataaagagtttctggacgattcttccaacgaggctatcattgaagagatcattcataccctcacaatcttcgaagaccgggagatgattaagcagagactgagcaaatttgaaaatatcttcgataagtccgtccttaagaaactgtctcgccggcactataccggatggggcaagctcagcgccaaactgatcaacggcattagagacgagaagtccgggaatacgatcctggattaccttattgacgacggaatctctaaccggaattttatgcagctcattcacgatgacgcgctgagcttcaaaaagaagatccaaaaagctcagatcattggcgatgaggacaaggggaacatcaaagaagtggttaagtccctgcccggaagcccggccattaaaaagggcatcctccagtctattaaaatcgtggatgagctggtcaaggtgatgggcgggcgcaagcctgaatccattgttgtggagatggccagagaaaatcagtatacaaaccaaggaaaaagcaattctcagcagcggcttaagagactggagaaatccctcaaggagctgggcagcaaaatcctgaaggaaaacatccccgctaagctctctaaaattgacaataacgccctccagaatgatcgcctgtacctgtattacctccaaaacgggaaggacatgtataccggagatgacctggatatcgaccggcttagcaattacgacattgatcatatcattcctcaggcttttctgaaagacaactccatcgataacaaggtcctcgtgagctctgcctccaatagaggcaaaagcgacgatgtcccctccctggaggtggttaagaagcgcaaaaccctgtggtaccagcttctgaagtctaaactcatcagccagagaaagttcgacaacctgacaaaagcggaaagagggggactctcccgcgaggataaggcctctttcattcaaagacagctggtggagacccggcagatcacaaagcacgtcgctcgccttctggacgaaaaatttaataacaagaaagatgagaataacagagccgtgcggacggttaagattatcaccctcaaaagcacactggtgtcccagttccgcaaggactttgaactgtataaggtcagagagattaatgatcttcatcacgctcatgacgcctacctgaacgcggtggtggcctctgctctcctgaaaaagtatcccaaactcgaacctgagttcgtttacggcgattatccgaagtacaatagctttcgggagcgcaaatccgccaccgaaaaggtctatttctacagcaacatcatgaatatctttaaaaagtctatttccctggctgacgggacagtgatcgagaagccccttattgaagtgaacgaggaaaccggcgagagcgtctggaataaagagtctgacctggccacggtgagacgggttctctcctaccctcaagtgaacgtcgtgaagaaagttgaaaagcagaatcacggactggatagaggcaaacccaaggggctgttcaacgccaaccttagctctaagcctaaacccaattccaacgagaatctggtgggagctaaggaatatctcgacccgaaaaagtacggcgggtatgcgggaatcagcaactcctttgccgtcctggtgaaaggcaccattgagaagggggctaagaaaaagatcacaaatgttctcgagttccagggcattagcatcctggatcgcatcaactaccggaaagacaaacttaattttctgctggaaaaaggatataaggatattgagctcatcattgaactgcctaagtactctcttttcgagctgagcgacggctccagacgcatgctcgcctctatcctgagcaccaacaataaaagaggggaaattcacaagggaaaccaaatcttcctctcccagaaatttgtgaagctgctttatcatgccaaacggatctctaatacaattaacgagaatcaccgcaagtacgtcgagaaccataaaaaggagttcgaagaactgttttactatatcctggagttcaatgaaaactacgtgggcgctaagaaaaatgggaagctcctgaacagcgcctttcagtcctggcagaaccactctattgatgagctttgcagctccttcatcggacccaccggcagcgagcggaaagggctgtttgaactcacgtctagaggctccgcggctgacttcgagtttctgggagtgaagattcctcgctatcgggattacacacccagctctctcctgaaagacgccacccttatccaccaatccgtcacaggcctgtatgaaaccagaatcgatctggccaagctcggggagggatga

SEQ ID NO: 4391 - RNA, 4167 nt, synthetic construct
  misc_feature 1..4167: note = Cas9 variant
  source 1..4167: mol_type = other RNA
atgaccaagccctacagcatcggcctggacattgggacaaactccgtgggatgggccgtcatcacggataattataaagttccttctaagaaaatgaaggtgctcggcaacaccagcaaaaagtacattaagaaaaatctgcttggggtgctgctgttcgactccggaatcacagctgagggcagacggctgaagcgcaccgccagacggcgctatacaagacggcgcaaccggattctttacctgcaggaaatcttttctaccgagatggcgacactcgatgacgctttctttcaaagactggatgacagcttcctggtcccggatgacaaacgcgattccaagtatcccatctttgggaatctcgtggaagagaaagtttaccacgacgagttccctaccatttatcatctgagaaagtaccttgccgattctacgaagaaagccgacctgcggctcgtgtacctggctcttgcccacatgatcaagtatcgcggacattttctgattgagggcgagttcaacagcaaaaataacgatatccagaagaattttcaggacttcctcgacacctacaacgctatttttgaatccgatctgagcctggaaaattctaaacagctcgaagagatcgtcaaggacaaaatttccaagctggagaagaaagatagaatccttaagctgttccccggcgaaaagaacagcgggatcttttctgagttcctcaaactgattgtgggaaatcaagccgacttccggaaatgctttaaccttgatgaaaaggcgtccctgcacttcagcaaggagtcttatgacgaagatctcgagacactgctgggctacatcggggacgattattccgacgtttttctcaaagccaagaaactgtacgatgctattcttctgagcggattcctcaccgtgacagacaatgagaccgaagcccctctgtcctctgctatgatcaagcgctataacgagcataaagaagaccttgccctgctcaaggagtacattagaaacatcagcctgaagacgtacaatgaagtctttaaagatgacacaaagaacggctatgcggggtacatcgatggaaaaaccaatcaggaggacttctatgtgtacctgaagaacctcctggccgagtttgaaggcgctgattatttccttgagaaaattgaccgggaagattttctgagaaagcagcgcacattcgacaatggctccatcccctaccagattcacctccaagagatgcgggccatcctggataagcaggctaaattttatcctttcctggccaagaacaaagaaagaattgagaagatccttacctttcgcatcccgtactacgtggggcccctcgcccggggaaatagcgacttcgcttggtctattagaaaacgcaacgagaagatcaccccttggaatttcgaagatgtcattgacaaagagtccagcgcggaagcctttatcaaccggatgacatctttcgatctgtatctgcccgaggagaaggttctccctaagcacagcctgctttacgaaacgtttaatgtgtataacgagctgaccaaagtgagattcattgctgaatccatgcgcgactaccagtttctcgactctaagcagaaaaaggatatcgtccggctgtatttcaaagacaagagaaaggtgacagataaagacattatcgagtacctgcatgccatctatggctacgatgggattgaacttaagggaatcgagaaacaatttaatagctccctcagcacctaccacgacctgctgaacattatcaatgataaggagttcctcgacgattcttccaacgaagccattatcgaggaaatcattcatacactgaccatctttgaggaccgcgaaatgattaaacagcggcttagcaagttcgagaacatctttgataagtctgttctgaaaaagctctccagacggcactatacgggctgggggaaactgagcgctaagctgattaatggaatccgcgacgagaaatccggcaacacaatccttgattacctcattgacgacggcatctctaatagaaacttcatgcagctgattcacgatgacgccctgagctttaagaagaaaatccaaaaggcgcagattatcggggatgaagacaaaggaaatatcaaggaggtggtcaaatccctccccggctctccggctattaagaaagggatcctgcagagcattaagatcgtggatgaacttgttaaggtgatgggaggccggaaacctgagtccattgtcgtggaaatggccagagagaaccagtataccaatcaaggcaagagcaactctcagcagcgcctgaaacggctcgagaagtccctgaaagaactggggagcaagatccttaaggagaatattcccgccaaactctctaagatcgacaacaatgctctgcagaacgatagactgtacctctattacctgcaaaatggaaaagacatgtataccggcgatgaccttgatatcgaccgcctgtccaactacgacattgatcatatcattcctcaggccttcctcaaggacaatagcatcgataacaaagtcctggtgtctagcgcttccaacagaggaaagagcgacgatttcccctctctggaagttgtgaagaaacggaagacattttggtaccagcttctgaaatccaagctcattagccagcgcaaattcgacaatctgaccaaggccgagagagggggcctcctgcccgaggataaggcggggtttatccaacggcagcttgtcgaaacacgccagatcacgaaacacgtggccagactgctcgacgagaagttcaacaataaaaaggatgaaaacaatcgggctgttcgcaccgtgaaaattatcacactgaagtccaccctggtctctcagtttagaaaggacttcgagctttataaagtgcgggaaattaacgattttcatcacgcccatgacgcttacctgaatgccgtgatcgcgagcgccctcctgaagaaatatcctaagctcgagccggagttcgtttacggagattatcccaaatacaactcctttcgcgaaagaaagtctgctacagagaaagtctatttctacagcaatattatgaacatctttaagaagtccatctctctggccgacggccgggtgattgaaagacctcttatcgaggtgaatgaagagaccggggagagcgtctggaacaaagaatccgacctggctacggtgcgccgggttctcagctacccccaagtgaatgtcgtgaagaaagttgaggaacagaaccacggcctggatagaggaaagcctaaaggcctgttcaatgccaacctttcttccaagcccaagccgaacagcaatgagaacctggtgggggccaaagaatatctcgaccctaagaaatacggaggctatgctgggatttctaattccttcgcggtcctggtgaagggaaccatcgagaaaggcgccaagaagaaaattacaaacgttctcgagtttcaggggatcagcattctggatcgcatcaattaccggaaggacaaacttaacttcctgctggaaaagggctataaagatatcgagctcattatcgaactgcccaagtactctctttttgagctgtccgacggaagcagacgcatgctcgcttccattctgagcaccaataacaagcggggcgagatccacaaagggaatcaaattttcctctctcagaagtttgtgaaactgctttatcatgccaagagaatcagcaacacaatcaatgaaaaccaccgcaaatacgtcgagaatcataagaaagagttcgaagaactgttttactatattctggagttcaacgagaattacgtgggagccaagaagaacggcaaactcctcaattccgcttttcagtcttggcagaaccacagcatcgatgaactttgttcctctttcattgggcctaccggaagcgagcggaagggcctgtttgaactcacgtccagagggtctgccgcggacttcgagtttctgggcgtgaaaatcccccggtatcgcgattacacacctagctccctcctgaaggacgctacccttattcaccaaagcgtcacaggactgtatgaaaccagaatcgatctggccaaactcggcgaggggtga

SEQ ID NO: 4392 - RNA, 4167 nt, synthetic construct
  misc_feature 1..4167: note = Cas9 variant
  source 1..4167: mol_type = other RNA
atgaccaagccctacagcatcggcctggacattgggacaaactccgtgggatgggccgtcatcacggataattataaagttccttctaagaaaatgaaggtgctcggcaacaccagcaaaaagtacattaagaaaaatctgcttggggtgcttctcttcgactccggaatcacagctgagggcagacggctgaagcgcaccgccagacggcgctatacaagacggcgcaaccggattctttacctgcaggaaatcttttctaccgagatggcgacactcgatgacgctttctttcaaagactggatgacagcttcctggtcccggatgacaaacgcgattccaagtatcccatctttgggaatctcgtggaagagaaagcctaccacgacgagttccctaccatttatcatctgagaaagtaccttgccgattctacgaagaaagctgacctgcggctcgtttacctggcccttgctcacatgatcaagtatcgcggacattttctgattgagggcgagttcaacagcaaaaataacgatatccagaagaattttcaggacttcctcgacacctacaacgccatttttgaatccgatctgagcctggaaaattctaaacagctcgaagagatcgtgaaggacaaaatttccaagctggagaagaaagatagaatccttaagctgttccccggcgaaaagaacagcgggatcttttctgagttcctcaaactgattgtcggaaatcaagcggacttccggaaatgctttaaccttgatgaaaaggcctccctgcacttcagcaaggagtcttatgacgaagatctcgagacactgctgggctacatcggggacgattattccgacgtgtttattaaagctaagaaactctacgatgccatcctgcttagcggattcctgaccgttacagacaatgagaccgaagctcctctctcctctgccatgattaagcgctataacgagcataaagaagacctggcgcttctgaaggagtacatcagaaacatcagcctcaagacgtacaatgaagtgtttaaagatgacacaaagaacggctatgccgggtacattgatggaaaaaccaatcaggaggacttctatgtctacctgaagaacctgctcgctgagtttgaaggcgccgattatttcctggagaaaatcgaccgggaagattttcttagaaagcagcgcacattcgacaatggctccattccctaccagatccatctgcaagagatgcgggctattctcgataagcaggccaaattttatcctttcctggccaagaacaaagaaagaatcgagaagatcctgacctttcgcattccgtactacgtggggccccttgctcggggaaatagcgacttcgcgtggtctatcagaaaacgcaacgagaagattaccccttggaatttcgaagatgtgatcgacaaagagtccagcgccgaggcttttattaaccggatgacatctttcgatctctatctgcccgaagagaaggtcctgcctaagcacagcctcctgtacgaaacgtttaatgtttataacgagcttaccaaagtgagattcatcgccgaatccatgcgcgactaccagtttctggactctaagcagaaaaaggatattgtgcggctctatttcaaagacaagagaaaggtcacagataaagacatcatcgagtacctgcacgccatttatggctacgatgggatcgaactgaagggaattgagaaacaatttaatagctcccttagcacctaccacgacctcctgaacatcattaatgataaggagttcctggacgattcttccaacgaagctatcatcgaggaaattatccatacactcaccatttttgaggaccgcgaaatgatcaaacagcggctgagcaagttcgagaacatttttgataagtctgtgcttaaaaagctgtccagacggcactatacgggctgggggaaactcagcgccaagctgatcaatggaatccgcgacgagaaatccggcaacacaattctggattaccttatcgacgacggcatttctaatagaaacttcatgcagctcatccacgatgacgcgctgagctttaagaagaaaattcaaaaggctcagatcatcggggatgaagacaaaggaaatattaaggaggttgtgaaatccctgcccggctctccggccatcaagaaagggattctccagagcatcaagattgtcgatgaactggtgaaggttatgggaggccggaaacctgagtccatcgtggtcgaaatggccagagagaaccagtataccaatcaaggcaagagcaactctcagcagcgccttaaacggctggagaagtccctcaaagaactggggagcaagattctgaaggagaatatccccgctaaactttctaagatcgacaacaatgccctccagaacgatagactgtacctgtattacctccaaaatggaaaagacatgtataccggcgatgacctggatattgaccgcctttccaactacgacatcgatcatattatccctcaggctttcctgaaggacaatagcattgataacaaagtgctcgtctctagcgcctccaacagaggaaagagcgacgatttcccctctctggaagtggttaagaaacggaagacattttggtaccagctgcttaaatccaagctgatcagccagcgcaaattcgacaatctcaccaaggcggagagagggggcctgctccccgaggataaggccgggtttatccaacggcagctggtggaaacacgccagattacgaaacacgtcgctagacttctggacgagaagttcaacaataaaaaggatgaaaacaatcgggccgtgcgcaccgttaaaatcattacactcaagtccaccctggtgtctcagtttagaaaggacttcgagctgtataaagtccgggaaatcaacgattttcatcacgctcatgacgcctaccttaatgcggtgattgccagcgctctgctcaagaaatatcctaagctggagccggagttcgtgtacggagattatcccaaatacaactcctttcgcgaaagaaagtctgccacagagaaagtttatttctacagcaatatcatgaacatctttaagaagtccatttctctcgctgacggccgggtcatcgaaagacctctgattgaggtgaatgaagagaccggggagagcgtgtggaacaaagaatccgaccttgccacggtccgccgggtgctgagctacccccaagttaatgtggtcaagaaagtggaggaacagaaccacggcctcgatagaggaaagcctaaaggcctgttcaatgccaacctgtcttccaagcccaagccgaacagcaatgagaaccttgttggggctaaagaatatctggaccctaagaaatacggaggctatgcggggatctctaattccttcgccgtgctcgtcaagggaaccattgagaaaggcgctaagaagaaaatcacaaacgtgctggagtttcaggggattagcatcctcgatcgcatcaattaccggaaggacaaactgaacttccttctggaaaagggctataaagatattgagctgatcattgaactccccaagtactctctgtttgagctttccgacggaagcagacgcatgctggcctccatcctcagcaccaataacaagcggggcgagattcacaaagggaatcaaatcttcctgtctcagaagtttgttaaactcctgtatcatgccaagagaatcagcaacacaattaatgaaaaccaccgcaaatacgtggagaatcataagaaagagttcgaagaactgttttactatatcctggagttcaacgagaattacgtcggagctaagaagaacggcaaactgctcaattccgcctttcagtcttggcagaaccacagcattgatgaactgtgttcctctttcatcgggcctaccggaagcgagcggaagggcctttttgaactgacgtccagagggtctgcggctgacttcgagtttctcggcgtgaaaattcaacggtatcgcgattacacacccagctccctgctcaaggacgccaccctgatccaccagagcgtgacaggactttatgaaaccagaatcgatctggccaaactgggcgaggggtga

SEQ ID NO: 4393 - RNA, 4167 nt, synthetic construct
  misc_feature 1..4167: note = Cas9 variant
  source 1..4167: mol_type = other RNA
atgaagagaatcctgggcctcgacctggggaccaacagcattggatgggcccttgtgaatgaggctgaaaacgagaaagaaatctccaagattatcaaactgggcgtccgggttaatcccctcacaattgatgagaagacgaacttcgaaaaagggcgccctctgtctaccaatgccgacagaacacttaagcggggagcgcgcagaaacctgcagcggtacaagctccgcagagagaatctgatcgagatcctgattgataaccacatcattaccaaagaaacaccgctcaccgagatcggcaaggggacaacctatcaaacgctgagccttcgggctaaagccgtgcgcgaaagaattgacctggaggattttgccaaggtgctcctggctatcaataaaaagcggggatacaagtcctctcgcaaagccagcaacgacgaggaaggccaggctattgatggcatggccatcgcgaaggagctttatgaaagagggatcacccccggacagtacgtcctggagctcctggaaaatgaccggaaatatattcctgatttctaccgctccgacctgaagcaggagtttaacaaaatctggaataaccaaaagacattctatcccgagattctcaccgatgaactgtttaaagagcttgacggcaagaataagtctcagacatgggccatctgccagaaacctttcaacattaaggggatcaaaagaatcaccaagggacgggaaaagacgattgagaactaccattggagagtgaagggcctgagcgggaagctcaatctggaaaaacttgctatcattctgcaggagatcaacaatgatattaaccaatccagcggatacctcggcggcatctctgacaagtccaaaaagctgtatctgaataaagagacagttggggaatttctctacaagcagatcgccaagaacccccacaccagcctgaaaaatcaggtgttctatcgccatgactaccttgatgagtttgaacagatttggaagacacaatctaacttcaatgctaacctgaccgacgagctcaaacaggaaatccgggatgtcattatcttttatcagagaaagattaaatcccaaaagagcctgatctctttctgtcagtttgagtcctgggagcaggaatacttcgacaaggagaccggaaaaacaaagacgcgcaccgtgggccggagagttattcctaaaagctccccgcttttccaggaatttaagatctggcaaaatctgaaccacctcgtgttcacaaattctgagaccgatgagaaaatcgaaattaaggaggtcgaacaggagatccgcaaagaactgtttgaggagctgaacctccggggagacctgaatcccaacgatcttctgaagattctcagaagccagttcaagatcggaaaactgtccaactggaagtgcaattttgagaaaattgagggcaaccgcacaaatgccgcgctgttcaacatctatcagaagatcagcgactttgaagggtacggaattgattggaataaatctaacgccaagaagatccggaaagagcttaaggctaccttccctgaaattggcatcgacgcctccattctcgagtttgatgcttacaaaaagcaactgacgaatcagagctcttatgagctgtggcatctcctgtacagcgccgaagaggacttcaaaatctccgaacaggacaaacttatctatggcaactctagcgtgtccctgaagaaaaagctccacctgaaatttgggttcaatcccgagtacgccaagatgctggctaaccttagcctcatgtctgattatggaaatctgtccgcgaaagccattaagaagatcctgccttacctcgaagacggccacctgtatagcgaggcttgtagacttgccgggtacaaccattctaaatccctgacagccgaggaactcgagaagtttgaacccaaagctaagctggatctgcttaaaaagaatagcctccgcaacccggtggtcgagaaaattctgaatcagatggttaacgtggtgaaccaagtcatcgacacctacggaaagcctgatggcgtgcggattgagctggccagagaactcaagaaatccgcgaaggagcgggctgaaatgaccaaagggatcgccgacggcacacgcagaaatgaggaaatcaagaaaattatcacccagaagttcgggattcccaaccctacaaagtctgatctggttcggtatagactttggcaggagctggagagccgcggctacaaagacatcttcacggataagtatatttcccccgacaaaatcttttctagcgaaattgatatcgagcacatcattcccaaggccctcctgttcgacgattcctttagcaataaaaccctgtctttccggaacgtgaatcttaagaaggctaacagaacagccctcgactttatcacccaggactaccaatccaatgtcgaggcttataaagagcgcgtggaaacatggaacaaggataatcatattagcaaagggaagagaaacaaactgctgatgtctctcaaggacatccctgatggattcattgagcgggacctgcgcaattcccagtacatcgccagaaaggcgaaacggatgctttatgaggtttttccgaacgaagtgctggccaccagcggctctatcacggataagctccgcagcgactgggatctgattaatgtcatgaaagagctgaaccttcccaagtacaaagctctggggctcaccgaatacgaggaaagactggacaagggaacagaggaactcttcaagcacgaagtgatcaaagattggaccaagcggaatgaccaccgccatcacgccatggatgctctggccgtcgcgtttacaacccataaccacattcagtatatcaacaatcttaacgccagaaaagacattacgcaagataatcatcctatcatcaagaacattgagaatctgatcacagaagtgaactccaaaggcaagcgggttttcaaagctcccatgagctcttttcgcgagtccgccaaggagcagattgaagctatcctcgtgagcttcaagaataaaaacaaggtcgtgaccaaaaatattaaccagacaaagaaagaagggggctttaattaccagaacgccaagacccctagaggacaactgcacaaggaaaccatctatggcaaatccaagcagcccctggagaaaccggttaagattaataaccggttctgcaaaaagcaagtggggcttatcatcaatttcaaggaacaggaggccgtcctgcaccatctcaaaaagtacgacaacaatgagaaaattgctttttctaacaagacactgaaaagcgaccctatccaggtgaacggatctcccctcagagaagtgaagattttcgaggaaatctttacgattcgcaaggatatcaatcctgacaacttcaaaacccagaagcacctggataaaatcattgacaagggcatcaaagaggttatgaagaaacggcttgaagagtataatggggattttaagacagcgttctccgacctggataagaaccccatttggctcaatcagagcaaaggaatcaccattaagagagccacaatctccggcgtcaccaacgctgagcctctgcatcaggccaaagaccacctggggaatatcattcttgatgacaacggcaaggaaatccccattgattacgtgtctacgggaaataaccaccatgtggccatctatcaagacgagagcggcaatctgcaggaagaggtcgtgtccttttacgaagctgttattcgcaaaaaccaggaccaaccgatcattaagaagcggcaccctaaagggtggaagttcctctttacaatgaaacagaatgagatgttcgtgtttagctctgagaacttcaatccctccgaaatcgatctgctcgacgagaagaacgccgcgatcattagccccaacctgttcagagtccagaaaatcgctaccaagaattacatgtttcgccatcaccttgaaaccgaggtgacaaacaatctggatttcacctatcggcattttcaggccacagagtggctgagaaacctctgtaaggttcgcattgaccacatcggacggattgtgcaaatcggcgaatactga

SEQ ID NO: 4394 - RNA, 4170 nt, synthetic construct
  misc_feature 1..4170: note = Cas9 variant
  source 1..4170: mol_type = other RNA
atgatcattagaacctacgagctgaagacaatcacgaccattgccatcctcaaaatgttccagctgcttacaggcgggctgagcatgaccaagctcggaaaaccctatggcattggggtggacatcggatccaactctatcggctttgctgccgtcgatgaaaatagccacctgattcggcttaaggggaaaacagttatcggagcgcgcctgttcgaggaaggcaaggctgccgccgacagacgggcttcccgcaccacaagacggcgcctctctagaaaccggtggcgcctgagctttctgagagatttctttgagtcccatattacccctacgggcccgaatttctttatgcggcaaaagtactctgaaatcagccccaaagacaaggcccgctataaatacgagaagagactcttcaacgatcggaccgacgctgagttttatcagcagtaccctacaatgtatcatctgcgcaatagacttctgaccgatccctccaaagccgacgtgcgggaaatttacttcgcgatccaccacattctcaagagcagagggcattttctgacatctggatacgccaaggatttcaacaccaataaagtggctcttaacgagatctttcctgccctgcaggacgcttatgcccaagtctaccccgatctcgacatcacgttcgatgaaaataaggtgaacgagttcaaaacagttctgctgaatgagaaggcgaccccttccgacacacagcgcgccctcgtgaacctgcttctggctgaagacggcgataaagacattctcaagcagcagaaacaagtcctgaccgagtttgccaaggctgtggttgggcttaagaccaaactgaatgtggccctcggaacagaagtcgatagctctgaggccacggtgtggaacttctccctgggccagctggacgataagtgggctgggatcgaaagcgcgatgaccgacgagggaacagagattctcgatcagatccgggacctgtatagagcccgccttctgaatggcattgtgccggctggcaaaaccctctctcaggccaaggtcgatgactacgcccaacaccacgaagatctggagctttttaaagactatctgaagcagctcgaagacgatgggacagctaaggccatccggcagctgtacgacagatatatcgatggagacgatgcgaaacccttcgttcgcgaggactttgtgaaggctctgaccaaagaagtgacggcccatcctaacgccaagtcccccgagctcctggagcggcttgctcaacctgatttcatgctgaaacagagaaacaaggccaatggcgctattcccgtccagatgcagcaacgcgaactcgaccagatcattaagaaccagagcgtgtactacgattggctggccgcgccgaatcctgttgagaaacaccggaagtccatgccctatcagctggacgaacttctcaactttagaatcccttactatgtggggcccctggtcacagccaaagagcaaaaggctgcccagggaggcgtgttcgcttggatggttcgcaaagatcccgacgggaatattaccccttacaactttgatgaaaaggtggaccgggaggcctctgcgaataccttcatccagagaatgaagacaaccgacacatatctgatcggagaggatgtcctcccgaaacagagcctgctttaccaacggtatgaagtgctgaacgagctcaataacgtccgcgtgaataacgaaaagctgtccattgagcagaaacagcaggttatcagagagctgtttgaacggcataatagcgtgacgattaagcaattcgccgagaaccttagagctcacggcgactacgcccacatccccgaaattcgcggcctcgctgatgagaaacggtttctgtcttccctgagcacctacagacagctcaagtctctgcttcctgacgccatcgatgaccccgccaaacaggctgatattgaaaatatcatcgcgtggagcacagtcttcgaggacgccgctattttcaagaccaagctgaaagagatcaactggctcgattcccaaacaattaccaagctgtctaacatccgctatagagggtggggacagtttagccataaattcctgaatggccttacgctcgggaacggacacaccattatccaggaactgtttctgtccaataacaatctcatgcagatcctgacagacgagacccttcaaaagaaaatgacagaactgaacgccgataagctcaaggccgctaatattaacgacgccatcgatgacgcgtacaccagcccttctaataaaaaggctctgcgccaggtgctgcgggttattgaggacatcaaaagagccgccgatggccaggacccctcctggctttatgtggaaacggctgatgggggcggaacaccgggcaagcggacccgcgccagacagcatcaactccaggagatttacgcgaacgctgcccacgagctgatcgacagcgccgtccgcggggaactggaggataaaatcgctgacaaggccgatttcaatgaccggctcgtgctgtattttatgcagggaggcagagatatttacacagggacccctcttaacatcgaccagctgtcttcctatgatattgaccatatcctcccccaaagcctgattaaggacaattccctggataaccgggtgcttgttcacgctatcatcaatcgcgagaaaaacgccaccttcgcgtctacaatttacgcccagaagatgaacgctacgtggagacagtggcacgaggccggactgatcagcggccggaaactcagaaatctgcaaatgcgccctgaccagattgataagtacgcttccgggtttgtcgcccggcagctcgtggaaaccagacagatcattaaactgacagagcaaatcgtggccgctcagtatcccgagaccaagattatcgcggtcaaggccggcctttctcatcagctgcgcgaagaactcgagttccctaaaaaccgggacgtgaatcactaccatcacgcttttgatgccttcctggccgctagaatcggaacatatctgcttaagcgctttcccaacctgcaggccttctttacctacggcaaattcaagaaagcggacgttaagaaactccgggggttcaattttattagagatatcacgcacgctgaagacaagattgtggtcaaggatacaggagaggtgatctgggacaaaaagcgcgatgttgacgaactggatcggatttataacttcaaaagaatgctcatcacccatgaggtgcactttgaaaaggccgacctgttcaaacaaaccgtctacggcgccaaggacagcaaggaggctgggggcaaaaagcagcttatctccaaaaagaaaggatatccggtggatatttacgggggctacacacaggaaaccggaagctatctgtctgttgtgcggctcacaaagaaggccatgtacgcggtcgtgaaagtgtccacgcgcgacgctgccaagctggccgtcgctaaaagcatctctgagcagaaggagaatgaaaccctgaacgatattatcgacgagaaactttccaagattagcaagaatggcaaaatcacacatgaactgtttgaggttgtgctccctagagtggggcaaaagaccctgttcaaaaactctaagtataatctctttctggtcaacagcgatacatacatgcacaattatcaggaactttggatgccccgggagtaccagaaaatgtggaaggacatctccctgagcaagtatggagatgcccagaccgaggaccaactggatcagattttcggctttatcgtgtctcaggttaactcctacttcaatctctacgacattaaccaatttcgcaaaaagctgaacgatgctgccgacaaattcgcgacgcttcccatgagagataccgacgacatgcaggggaagatcgccacaattggacagctgctcatcggcctgcaggctaatgccgctcggagcgatctcagaaacctggacattaaaacccctcttgggctgctgcaaatcccgaatggcatctccctcgattctgacacaagcgtggtctatcagtcccccaccggactgcttgaacgcgaggtgcatctgtctgatctctga

SEQ ID NO: 4395 - RNA, 4170 nt, synthetic construct
  misc_feature 1..4170: note = Cas9 variant
  source 1..4170: mol_type = other RNA
atggccagagactacagcgtgggcctggatatcgggacctcctctgtcggatgggctgccattgacaacaagtatcacctcatccgggcgaaaagcaagaatctgattggcgttcgccttttcgattccgctgtgacagccgagaaaagacgggggtaccgcacgaccagacggcgcctgtctagacggcattggcgcctcagactgcttaacgacatctttgccggacccctgacagatttcggcgacgaaaattttctcgctcggctgaagtatagctgggtgcaccctcaggatcaatccaaccaggcccatttcgctgccgggctgctctttgactctaaagagcaggataaggacttctaccgcaagtatccgaccatttaccacctgagacttgcgctgatgaatgatgaccagaaacatgatctccgggaagtctatctggccatccaccaccttgtgaagtaccgcggacattttctgatcgagggcgacgttaaagctgacagcgccttcgatgtgcacacatttgctgacgccattcaaagatacgcggaatccaacaatagcgatgagaacctcctgggcaagatcgacgagaaaaagctgtctgccgctctcaccgataagcatgggtccaaaagccagcgggccgaaacagctgagaccgccttcgacattctggatcttcagtctaagaaacagatccaagccattctgaagtccgtcgtgggaaatcaggctaacctcatggcgatctttggcctggacagctctgccatttccaaagatgaacagaagaattataaattcagctttgacgatgctgacatcgacgagaagatcgccgattccgaggcccttctgtctgacacggagttcgagttcctctgcgatctgaaggctgcctttgacgggctgaccctcaaaatgctgcttggagatgacaagacagttagcgcggctatggtgagacgcttcaacgaacaccagaaagattgggagtacattaagtcccacatccggaatgccaaaaacgccggcaatgggctgtatgaaaagagcaagaaatttgacggaattaacgctgcctacctcgctctgcaatctgataacgaggacgatagaaagaaagccaagaaaatcttccaggacgagatttccagcgcggatatccccgacgacgtcaaggccgattttcttaagaaaatcgacgatgaccagttcctgcctattcaacgcaccaagaataacggcacaatcccccatcagctccaccggaatgaactggagcagattatcgaaaaacagggcatttattacccttttctgaaggatacctatcaagagaactctcatgaactcaataaaatcacggctctgatcaacttcagagtgccctactacgtggggcctcttgtcgaggaggaacagaagattgccgacgatggaaagaatatcccggaccccacaaaccactggatggttcgcaaaagcaatgataccattacaccttggaacctgtcccaggtggtggacctcgataagtctggccggagatttatcgagcgcctgaccgggaccgacacatatctgattggagaacccacgcttcctaaaaatagcctcctgtaccagaagttcgatgtcctgcaagagctcaacaatatccgggtgtccggcagacgcctggacattcgggctaaacaggacgcctttgaacatcttttcaaggttcagaaaaccgtgagcgcgacaaacctgaaggattttctcgtccaggccgggtatatctctgaggacacccaaatcgagggactggctgatgtgaatggcaagaacttcaacaatgccctgacaacctacaactatcttgtttccgtgctcggcagagagttcgtcgagaatcccagcaacgaagaactgctggaggaaattacggagctccagacagtgtttgaagacaaaaaggtcctgcggcgccagcttgatcagctggacgggctctctgatcacaatagagagaaactgtcccggaagcactacaccggatggggcagaatcagcaaaaagctgcttaccacaaagattgtgcaaaacgctgacaaaatcgataatcagaccttcgacgttccgcgcatgaaccagtccattatcgatacactctataatacgaagatgaacctgatggaaatcattaataacgccgaggacgactttggggtgcgggcctggatcgataaacaaaataccacagacggagatgagcaggacgtctactctctgattgatgaactcgctggccctaaggagatcaaaagagggattgtgcagagcttccgcatcctggacgatatcaccaaggcggttggctacgcccccaagagagtgtatcttgaatttgctcggaaaacacaggagtcccatctgaccaactctcgcaagaatcaactcagcacgctgctgaaaaacgccggactttccgaactcgtcacccaggtgagccagtacgacgccgctgccctgcagaacgatagactgtatctctacttcctgcaacagggcaaggacatgtattctggggagaaacttaatctggataacctctccaattacgacattgatcacatcattcctcaggcgtatacaaaggacaacagcctggacaatcgggtgctggtttctaacatcaccaatcgcagaaagtccgatagctctaactaccttcccgctctgattgacaaaatgcggcccttttggagcgtcctctccaagcagggactgctcagcaaacataagttcgccaatctgacacgcaccagagattttgacgatatggagaaagaacggttcatcgcccgctctcttgtggagacgagacaaatcattaagaacgtggcttccctgatcgacagccactttggcggggaaacaaaagccgtcgcgattcggtcctctctcaccgctgatatgagacgctacgtggacatccctaagaatcgggatattaacgactatcaccatgccttcgatgccctgctgtttagcacagttggacagtacaccgaaaattccggccttatgaagaaagggcagctgtctgacagcgctggcaaccaatataatagatacatcaaggaatggattcacgccgctcgcctcaacgcccagtcccagcgggtgaacccgttcggattcgtcgtgggctctatgagaaatgcggcccccgggaaactgaaccctgagaccggagagatcacacccgaagagaatgctgattggagcatcgccgacctcgactatctgcataaggttatgaactttcgcaaaattacggtgacccggagacttaaggatcagaagggccaactgtacgacgaatcccgctatcctagcgtcctccacgatgctaaatctaaggcctccatcaatttcgacaaacataagcccgtggatctgtacgggggatttagctctgccaaaccggcttacgcggccctgattaagttcaagaacaaatttcggcttgttaatgtgctgagacagtggacatattccgacaagaacagcgaggattacatcctcgagcagattcggggcaaatatcctaaggctgaaatggtcctgtctcacatcccctacgggcagctcgtgaaaaaggacggcgccctggtgaccatctccagcgccacagagcttcacaatttcgaacaactgtggctgcctctcgctgattataagctgattaacacccttctgaaaacgaaggaggacaatctcgtcgatatcctgcataaccgcctcgacctgcccgaaatgacaattgagtccgccttttacaaagcgttcgacagcatcctttcttttgctttcaatagatatgccctgcaccagaacgccctggttaagctccaggctcatcgggatgactttaatgccctgaactacgaggataaacagcaaacccttgaacgcattctggacgcgctccacgctagccctgcctcctctgatctgaagaagatcaatctcagctccggattcggcagactgttctctcccagccattttacccttgccgacacagatgagttcatctttcagtccgtgaccgggctgttctctacacagaaaacggtggctcagctgtaccaagaaaccaagtga

SEQ ID NO: 4396 - RNA, 4170 nt, synthetic construct
  misc_feature 1..4170: note = Cas9 variant
  source 1..4170: mol_type = other RNA
atgaagaactacaatatcagcctggtgccctccccttctggcgtcgggtatgccgttaccgacgataacctcaatattatcaaaccggtgcaccatgtgagcggaattggctccagactgttcaacgaggggtctagcaagcaggaccggcgcaattccagatctgctcggcgcagcagacaccggcaacagggacgcatcaaagcccttaactccattatgaaggatgaaatcatcaaagtcgaccccacatttttcgatagactgtaccagagcgagctctctcctctggacaagaataagaaatatcggaacattatctttgataagccctccgtggaaagctactattacaaaaagttccctacgatttatcatcttgagaaatacctgatcaataccgacggcaaggcggatattcgcctcatctactgggctctgcactctctgctcacacatagagggcacttttataacaccacacccgtttcccagttcaagcctggagccctgaatattaaagacaagtttatcgaacttaaccaactgaatcaggtgaaaaccttcgagtttagcgtcgccaacacaccggagatcgaacacattctcaaggatcggtacatctctaaacagaataagattaaccagctggctgagcttctgttcgaacaagagcccgagaaagacatccagaaggccaacaccaaggtggctaaaacgattgccaaggcgatcctcggcaataaatttcagctggatgaaatcattggcctggacgttaacaagtccgagaaaaaggaatggagcctccagctgtccgaccttaatctggattctaagatcgacgagctcagcgattccctgaccgaccaacagcttcgcattctggaaatcctccaggagatgtatgccgctacaaccctgctggatattctccaagggagcgactctctgcttgatgccaaaatcaagtcctacaacgagtataaacagaatagactcctgttctttgacctgcttaagacactgcctgataaaaaggctcatctcctgcggcagggatacaccctgtatctcaacaatcaccatcgcgacctggccagcgcgagaaaggatcttggcatcgtggccgctacgaacttctctaaaacagacctgtacgccctcattaagaaaaccctgaaggacgaacccgagacacctgaaagcaaaaaggtcctggggcttatcgataagggagagttcctcaataaacagcggaccgacctgaacacctacattccctatcaactgaatgctctcatcctgaacaagattcttaaaaatcagggcaagcactacccgtttctgatcaaagaaaaccctgccgagcccgatagaaaggaggccccttatgaaatttcccagctcatgcagttcacaatcccctactattgcgggcccctggctacgcctgaggaacaaaagaatctgccggagtctagccgctttggatggcttgtgcggaaggaagagggcagaatcaccccctggaacttctacaacaagattaatgtgatcgagacagcgaacgcctttattaaacgctccatcggcaaggacacctatctcctgagcgaacctgtcctgcccgataattctctcctgtaccagaaatacaaggttcttaacgagctgtccagcatttctctcgtggacgctaataccaaaaaggaaaagaaactgacagccaagatcaaacagctgctttataaggaggggttcaaaaagcacgtgacggtctccaagacaatggccctcaaaatcctgaacgataataacgtgcctaccagcgacattctgggactctccaccggcaagaaatttgataattctctgagcacatacaactcctggaagaaggctttccccgagcagatcgacaatccgcattatcggcaagatcttgaatacatgattgagtggtctaccgtttttacagacagaaagatcctggtggaaaagctcaaagagattgaatggctgcgccctgagcagatcaagttcgtcctggagcaccggcttacggggtggggaaaactcagcaagagactgctggtggaactcaaagataacaagggcaaatccaatatcgacaacctgtttaataccaagaagaacttcatgcagattgttagccagcaagtgtataacacacagatcgaggccattgcgcttaaaaccacaaagaatcagtctctggacaacatcctcgaagctgcctacacctcccccgccaatcgcaaagctattcggcaaacgatgaaggtcgtgaacgagatcgtcaccctggccgggaaaggaacacatcctgataagatctttctgaccttccagagaagcaaggaacaggagggcaaacttacaaccgaccgcgcttcttccctgctcaagatttatcggggcatcaaagatcccctgtgtacgaaggagctcgtggacgaactgagcaaaaatgttagagccaaccttattaagacaaaggagtacctgtactatcagcaactcgggcgggatgcgctgaccggagaaatcattgacaaaacagatctgcgcaattacgccgtgcttcacatcattcctagatctgtcgtggttgacgatagcatcaacaatctggtgctcaccaaggtcaaaaacgctaaggagtccatcgtggtgcagtatggcagcaaaaatatttctgacatctccatgagcgttaaggatttctggaaccggctgcagaagctcgggctgttttccaaaggaaaacttagaaatctgaccacagacctcacggaactgaaccagtacgagaaacaaggcttcattgcccgccagctggtcgagaccaatcagatcgtgaaacttctggctacaattctccaggggcaatttccccataccaaaatcatcgaagtgcggcaggagcagattgccaacatcagatatcaactggatatttaccgcctcagagacctgaacgtctattaccggggcatggacgcgtaccttgccgctgtggttggaacatatctgtacaccgtgtatccgaaggcccgcagattctttgtctacggcaagtatctgaaacaggataagaataaccgggaagaggggcagttcaaaacgtctggacacagctttaatttcctctggaagctgttttacggcggggaggacgaaatctatgtgcagggaacaaacaatattgctttcaacaaaaaggatcttctgcagaaaatcaaggaggttaataactacaagtttcaaaatgtgtccctcgccaccggcacccgcagatctgacctgttcaaacagacaatctaccctcggcaggaacgcgatgtcaagaaaagcagaaccctcattacaaagaaaaacgggctgtttacggacatctatggcggatacaccggcaatgtgaactcctatttcgttcttgtgcaaacaaagtacaagaaagatcccgacaagttcaatctgtatggggtccccaaccggtacgtggccatgctggagcagtctaaaagcaagggaaattatgaaaccaaactcaaggaggtgatggagcctattatcaagaactccaataaacgcatgattggctacaagatcctgaaagatcggattctttacaaccagatcatcgaagacaacgggtataagtttttcattacaagctctcagtacagacacaattttagacaaatgatcctgtccgatcagagcaaaaagattctcatggactatgtcttcgacccgaacttttaccgccataagaaaaccgaggatgttaataacgacaaggatgctaaactgatcaaggtgtatgacgaaattctctaccagatcgatcactatctgcagatcttcacgattggacatcacatcgacaaacttaagaaagcgcggcccctgtttgagaagtgcaccctggccgaaaaggctcaagtgctcaatgatattctgatcattgccggctctaaccagacagagcttgccctgaaacctctcaagaccacaaaactgaccttctccaagcagaattgtcccctcacaaaagacgctatcttttactaccaaagccctaccgggatgatcacgagaaaggagtctattaaggatatcctgaaacagaacatttga

SEQ ID NO: 4397 - RNA, 4173 nt, synthetic construct
  misc_feature 1..4173: note = Cas9 variant
  source 1..4173: mol_type = other RNA
atgagcagaaagaacatcgtggaggactacgccatttccctggatatcggcaatgcttctgtcgggtgggttgccttcacccccaactatcggctcgtgcgcgcgaaaggacacgaactgattggcgctagactttttgagcctgccagcacagccgaggagcggcgcatggctagaacgacccggcgcagatactcccggcgcagatggcggctgcgcatgctcgactctatgttcgatcaggccctgagcgaagtggacccgtcctttcttatgagacggaagtattcttgggtccatcccgaggataaaaataacgaggctcactggttcgggggagtgctgtttgacagcaatgaacaagataagcgcttctacgagaaatatcctacaatctaccatctcagaaagtccctgatggaagacgatgagcggcacgacattagagaggtttatctggccatccatcacatgatgaagtaccgcggcaactttctcaccgaaggggagctggcgcccagctctgtgttcgatgtcgaagactttcttaaactgctcacagagatcctgcagtacgccgatgaaggagagaccgacgaggaccttgaactgcaggctgatgccaatggcctcacagaggctctgtgcaccacgaagggctcccggagcattagagccaaaaacgcgatctctattctgaaggaaggggccgctctctccaaacgccaggaggccatcattagcgctgtgttcgccggactggaaggcaataaacttgacctgaccaaggtttttcctaacaaagagtatacacccgaggataagaaaaccctcgccctgtacttcaataaggctgactatgatgaaaaacgggtggcgatcggggactctggacttctggaggataacgaatgtgactttctcgattgcattagacgccaatactccgccatcgctctgaagcagctgctcggcgacttcacaagcatctccgagtctatgtgtgcccggtatgaacagcaccagagaaattgggatctgattaaacgctactgccgggaggagagcaacgccgaaaatatcaacaagaactatggggctcttgtcggatgggagattgtgggcggccaaagacgctccatcagaggggccaaggactacgaaaataaaagaaaggcggctaacaaattctttgaggagctgattaagggaagcgccctccctgaccaggaaaaagagcggctgcttcatgatatcgaaaatgacgagctgttcccggtgcagcgcgattctggcaacggggtcatcccctaccagctccacctgaatgaactgaagaagattatccaaaaacagggaagatattacccttttctcctggagacctatattaaggacggcaaagaggttaacaaacttgaagggctgctcgccttccgggtgccctactatgtgggacctctggtctccagagatgacatgcagagctctgataatcgcgagaaccattggatgatccggagaaagaagggcgtgattacgccctggaattttgacgaaatggttgataaggacaaaagcggccacgagttcatcaagtccctggtggggacagattcttaccttctcggagaaaccacactgccgaaaaacagcctgctctatcaagagtttgaggtcctgaatgaacttaacaatgtgcgcctgtccatcagaaccggcaaccactgggctgacaagcggcgcgttagactcgggcataatgagaaaaagctgctgcttgaagaactcttcgccaagcaggctaccgtgacaaagaaggccgcggaaaacctgctgcggcgcacgtacggaaacacctacgagattagcggcctcgccgatgagaaaaagtttgtctcttccctgagctcttatgggaaaatgtgtagaacacttaaggcttcctacgtgaatagccacaaagacgtcgtggaaaagatcattgagctgcagaccgttttcgaagacaagaaaacactcaagcatcagctgcaactgcttggcgagctcgccgagaccaactgcgaactgctgtccaatacgcactatacaggatggggcaaactctctcggaagctgcttaccagcaaagtggtcgtgtgtaagatcgggaacgattttgctcctgccaagcattccattatcgagattatgcgcgaaaccgacagaaatttcatggagatcatcacagataaagacctgggagttggcgaatggattaaccagcagaatgtgggggcggaggatggaaactcttaccaggacatcattgatgacctccgggtcagccccaaggtgaaacgcggcatcaatcaagccattagagtgatcgatgacatctccaaggctgttgggaaagagcctagccggatttttctggaactggccggcgatgtccagcagtctgctagaaccgtgtcccgcaagagccggcttcagggactctataagtctgccggcctgcaaaaagagttcagagacctggccgaatccctcaacgagtgcagcgataatgacctgcgcgacgatcggcttttcctgtactatacacagctcgggaaggacatgtacacgggagaacccctgaacctggatagactttctagcgactacgatatcgaccacattatcccccaggctgtgacccagaatgattccctggacaaccgcgtcctcgtggcgcgggttgccaatgctagaaaaacagatagctttcaatatctgcctgagattgccaaccgcatgcggaacttctggcaggagctcctggacgccggccttatctctagagtgaagtttgatcggctgaatcgccagaacgacttctccagccacgaaaaagagagatttgtccaacggtccctcgtggaaacccgccagatcatgaagaatgttgctacaattatgagaaagcggtacgggaactctgccgcggtgatcggactgaatagcgagctgaccaaagaaatgagacagtatcttggcttctcccataagaaccgcgacattaatgattaccaccatgctcaggacgccctgtgtctcgggatcgccggccaatttgctgtcaaccggggattctttgccaatggcatggtgtctgatggggcggttaacagctataatctgtacctccaggactatctgagaggataccgcgagaaaatgtccgctggcgagcggagacgcaacaaggccttcgggtttattgtgggatctatgaatagccaggattccgacaaacggatcaacccgaagacgggcgaaatcgcctgggatgacgaggataaagtctaccttagaaaggtgatgaattatcgcaagatgctgattacccagaaagtgggggacagcttcggcgctctctacaacgaaacaagatatggaacctctgccaaggagggcgtcaacgggatcccctttgataaacacaagcaagacacagctctgtacggaggcttctccagcgccaaaaccgtttatgtggtgctgattgaggcgaagaagaaaacgcggcttgtcaatatcacaatgcaggaatacgccgagctgggggatcacccttctgacgacgctctccgcgccgtgctggctaagaaaaagcccgaatatggaaaagcccggattctcctgcggcatatccctcccatgcagcttattcgctacggcggcgccctggttaccgtgaagtccgctacagagctgaacaatgcgcagcaactctggctgccgtacaaggaatattgccttttcgatgacgtcatcagctctgccatcgatgtggacgaggctagactgtgtcagatgctcgatgttattctggacgccatccagaaatactatcctaagcaacggtttgatgagaccgggctctccgccttccacaacgcttttaatgaagtgagcgccgaggacaaaaagagaattgtcggagaaatggtgggcatgctgcatgcggatgctaaaaacgccaatcttaaggccctggggatgtccggacgctggggccggatgagcaaccagtctgggtacaccttcgctgacagcgatgagtttatcttccagtccccctctggactgtttgaaaagagaattagcgttggcgagctcaaaaagcgccgggccagatga

SEQ ID NO: 4398 - RNA, 4173 nt, synthetic construct
  misc_feature 1..4173: note = Cas9 variant
  source 1..4173: mol_type = other RNA
atgaaggaggtgaaagactacatcattggcctggatatcgggaccaacagctgcggatatgtcgttacagacaagcagaataacattctcaaactgaagggcaaaacggccatcggggctagacttttcaaggaaggagaggccgcggctgatcggcgcgcctttagaaccacacggcgcagactggcccggcgcagatggcggctcggcctgcttgaagagattttcgacgaagagatggctaaggtggattcctctttcttccgcagactgaaagagagcgactactcccccaaggattctcggaaacaatttaatagcatcgtgttcgaatcctctgaggccgacaaggatttttatgacaaataccctaccatctatcacctccgcaacgctctgatgcatgatgaccagaagcacgatctgagagaaattttcctcgccgtccatcacatcgtgaagtaccgggggaattttctgcgcgaggacagcgttaaagcgttcaaggccgctaaatttacacttcagggagaggacggcattggcccggtggataagctgaacgacctcctgaaagaaatctatattgaggccgctcccgaacttgccaccgataatctgtccaagatcgaggaaattatcaaagacaagaagctctacaaacaggataagctgaaacaagtcgcgacactgctcaccaaggaggccgacacgaaagataaggctaagctgaacaaagacgtggccaagcaggttgctaatgccttcatggggtacatgatcatttttgataccatcttcaaccttagcgacgtggattctaaagactataaggtcaaattctccgacgccaatattgatgagaagctggacacactcaccagcctgcttacagataagcagaccgaatttgtgctggagctccagaacatctacaatacgattgtgctgaacgaaatcgtccctgacggaaaatctctgtccgagagcatggttaagaaatatgatgaccataaggaagatctcaaactgttcaaggcttaccttaattctctgacagacgtgaagaaagtgaaggagctcaaagcggcctatgtcctgtacgtgaacaacagaaaggctaatcttctggccgccaaaaagctcctgggcaaaaaggctgataacatgaataactttgagatcttctccaagtttgttgccgacaatctggatgacagcgaactcgcgaacaaaattcgggctagactggatcttggggagttcctgcccaagcaacgcaccaatcagaacggagtgatcccttatcagctccaccaggtcgaactgacacaaattctggagaaacagggcaagtactacccctttcttatcgcccctaatccggtggaatcccaccggaacaatgccccctatagaatttctgagctcgttagcttccgcgtgccttactatgtcgggcccctgatcgaccctaacaatgctgagtccgaacaggacaaagccaacagctcttttgcttggatggtgcggcaaaagcagggacagatcaccccctggaatttcgaggaaatggtcgataccacagagtccgccaacaagtttattaaaagaatgacgaccaaggacacatacctgctcggcgaggatgtgctgccggcgagctctcttatctatcagaaattcgttattctgaacgaactcaataacatcaaggtgaatggcattaaactgaccagcgaggaaaagcatcaaatctttgacgagctgttcaaggtccagaaatccgtgtctcttaagaacctcgttaatttcctgacagcccacgggtgtgtggctcctaacgtcaccggactgagcgatggcacgaaatttaattccagctactctacatatattgactaccgcaagatcttcggggccgaaatcgataacaaagacaagcaggctgattttgagaagatgattgagtggtccaccgtgttcgaagaccggaaaatctttaagagaaaactcgaggaaattacctggctgacacccgatcagatcaagcaagtgagctctaaacgctactccggatggggccggcttagcaagaaactgctcacccagattacagacgagaatggggttaacatcctgcagagactgtggaatgaatccgagaaccttatgcagatcctctctgatcctgtcattaaggagaagatcgtggccgcgaatagctccttcacgaaagccaccgacatggaagacattctggctgaggcctatacatctccccaaaacaagaaagctatccgccaggtgatgcgggtcgtggatgacattatcgccgccgctcatggaaagaaacccagccagatcgcgattgaatttgccagagaggatcaggacaatcctcaaatgaccaagtcccggaaggctcagctggatcagatctacgccaaaattagcgacgaatttctcgataacgccgttaagaacgagctgaaaaatatgaaggacaacaaaccgcttgctaaggataaggtgtttctgtatttcaaacaaatgggccgcgacgcctacacaggcgagaagctctctctggataatctgcaggactatgacatcgatcacatttacccccagtcctttatcaaagacgatagcttcgacaacagagtccttgtgcagcgggcggttaataacgggaagtctgataatgtgcctgtcctcctgtttggaaacaaacaagctgccgacctgggcatgaccatcagacagatgtggaagaagtggctcgaactggggcttatttccaaacgcaagttcaataacctgatcacggatcccgagaaaattagctcttatatggccagcggattcgtgaatcggcagctcgttgaaacctcccaggtgatcaagctggtcgctaacattctgcaagccaaacttcctgacacagagatcattgaggtgaaggcgagctacaattctatcctgagaaaggaatttaacctctacaaatcccgcgaggtgaatgattatcaccatgctatcgacgcctacctgaccacaattgtcggcaactatctctaccaggtttatcccaagctgagaccgtacttcgtgtatgggcagtttaaaaagttcggcaaagccgaaagcaaggaggatgaccctgtgaaaaagatcaagcagtttaacttcatttaccaacttctgtggggaaaagatgacgctatctgcatttcccacaccgaccagcaggtcttttctcggagcgatatcatcaataagctcacgacagcctacaacttcaaatatatgaatgtgtcccaagaagtttacaccaactctaataacgtgtttaagcagacagtcttccccattatcgagcgcgacaccgctaaaagcagatccctgattcctaagaagctggatcggcccaccgacatctatggcgggtactctaataacaatgatgcctatcttgcgctggtgaaagttgacaagaaaaagggaagcgagtaccgcgtggtcggcattcctatgagagccgctgccatgctcaaggcttccaaaaactatgatgaagacctgcggaaggtgatcgagcccatggttatgctcgataaaaatgggaaggccaaacgcggaatcgaaggctttagagtgctggtcgggaagatgccgttcaaacaggccgtgcttgacggcgataagaagttcatgctgacaggaacgaacgacatgcctaatctcaaacagctggtgctgagccaacagaacatgaagtacattcttgattacatcgacgacattgattgtcggaaacataagtttggcaataaaacccaggacgggaacaagtgcctgctcgaggtcttcgatgaaatcattcagatcgttgacaaacactttgagctgttcgataatcgctcttttagagagaagctccggaactccagagtgaacttcattaatctggctcttagcaagaaagcggaagccctgctggctatcctcaacggactgcatgccaattctatgcgcacaaccatcaaggagcttaaaatttccgacctgggccggatccaaagctctgtgatttcccccgaagcccagctcatctatcagagccccacagggctgtttgagagacgcgtcaaggtgaaagatctctga

SEQ ID NO: 4399 - RNA, 4176 nt, synthetic construct
  misc_feature 1..4176: note = Cas9 variant
  source 1..4176: mol_type = other RNA
atggagaacaagcagtactatatcggcctggacgtggggaccaatagcgtcggatgggccgttacagatacgtcctacaacctcctgagagctaaaggcaaggacatgtggggagcccggcttttcgaaaaagcgaataccgctgccgagcgcagaacaaagcggacctctcgcagacggagcgaacgcgagaaagccagaaaggctatgctgaaggaactctttgccgatgagattaaccgggtggacccctccttctttatccgcctggaggaatctaaattctttcttgatgacagaagcgagaataaccggcaacgctatacactgttcaatgatgctacctttacagacaaggattactatgaaaaatacaagaccattttccacctcagatccgccctgatcaactctgacgagaaatttgatgtgcggctggtcttcctcgcgattctgaatctttttagccatcgcgggcacttcctgaacgcctccctcaagggcgacggggatatccagggaatggacgtgttttataatgacctggttgagagctgcgaatacttcgagatcgaacttcctagaattacgaacatcgataatttcgagaagattctgtctcagaaaggcaagtcccggaccaaaatcctcgaagaactgagcgaggaactgtctatttccaagaaagacaagagcaaatacaacctcatcaagctgatttctggccttgaggcttccgtggtcgaactgtataatatcgaggatatccaggacgaaaacaagaaaattaagatcgggtttagagagagcgattacgaggaatcctctctcaaagtgaaggagattatcggagacgaatatttcgatctggttgagcgcgccaaaagcgtgcatgacatgggccttctgtccaacattatcgggaatagcaagtacctctgtgaagctcgggtcgaggcctatgagaaccaccataaggatctgctgaaaatcaaggaactcctgaaaaagtacgacaaaaaggcgtataatgatatgtttagaaagatgacagacaaaaactactctgcctacgtgggatccgtgaatagcaacattgctaaggagcgccggtctgtcgacaaaagaaagatcgaagatctttataaatacattgaggacaccgccctgaagaatatcccggatgacaacaaggataaaattgagatcctcgaaaagatcaaactgggcgagttccttaagaaacaactgacagctagcaatggggttattcccaaccagctccagtcccgcgaactgcgggccatcctgaagaaagccgagaattatctcccttttctgaaggaaaagggagagaaaaaccttaccgtgtctgagatgattatccagctgttcgaatttcaaattccctactatgtgggccctctcgacaagaatcccaaaaaggataacaaagctaatagctgggcgaagatcaagcagggcgggcgcattctgccttggaacttcgaggacaaagtcgatgtgaagggatccagaaaagaatttatcgagaagatggttcggaaatgcacgtacatcagcgacgaacacacactgccgaagcagtctcttctctatgagaagttcatggtgctgaacgagattaataacatcaaaattgatggcgaaaagatctccgtcgaggccaaacagaagatttacaatgacctgtttgtgaaagggaagaaggttagccaaaaagatatcaagaaagaactcatctctctgaacattatggacaaggactccgtgcttagcggaaccgatacagtctgtaatgcttacctgtcctctatcggcaaattcaccggggtgtttaaggaggaaattaacaaacagagcatcgtcgacatgattgaggatatcatcttcctcaagaccgtgtatggagacgagaagagattcgttaaagaagagattgtggaaaagtacggcgatgagatcgacaaagataagattaaacgcatcctgggctttaagttctccaattgggggaacctgtctaagagctttcttgagctcgaaggagccgacgtcggcacaggggaggtgcggtccattatccagagcctgtgggaaacgaatttcaacctgatggagctcctgtcttccagatttacctatatggatgaacttgagaaacgggttaagaaactggagaagcccctcagcgaatggacaatcgaggacctggatgacatgtacctgtcttcccctgtgaaacgcatgatttggcaaagcatgaagatcgtcgatgaaattcagaccgtgatcggatatgcccccaagagaattttcgtggagatgacacggtctgaaggcgagaaagttagaaccaagagccgcaaagaccggcttaaggagctctacaatgggatcaaagaagactccaagcagtgggtcaaggagctggatagcaaagacgaatcttattttagatccaagaaaatgtacctgtactatctccagaagggccgctgcatgtacagcggagaggtgattgaactggataaacttatggacgataacctgtatgacatcgatcacatctaccctagatccttcgtgaaggacgattctctcgacaatctggtcctggtgaagaaagagattaacaatcggaagcaaaacgatcccatcacgccgcagattcaggctagctgtcagggcttttggaaaatccttcatgaccaagggttcatgtccaacgagaagtattctcgcctcacaagaaaaacccaggaatttagcgacgaggaaaagctgtccttcattaatcggcagatcgttgagaccggacaggccacaaaatgcatggcgcaaatcctgcagaagtctatgggcgaggatgtggacgtcgtgtttagcaaggctcgcctcgtttccgagttcagacacaaattcgagctgtttaagagccggcttattaacgatttccatcacgccaatgacgcctacctgaacatcgtggtcggaaattcttattttgtgaaattcacccgcaaccctgctaattttattaaggatgcccggaaaaaccccgacaatcctgtttacaagtaccacatggatagattctttgaacgcgacgtgaagtccaaaagcgaggtcgcttggatcgggcagtctgaaggcaactccgggacaattgtgatcgtgaagaaaacgatggccaagaatagccccctcatcaccaaaaaggtcgaggagggccatggatctattacaaaggaaaccatcgttggcgtgaaagagattaagttcgggagaaacaaagtggaaaaggcggataaaacacccaagaagcctaatctgcaggcctatcggccgatcaaaacctccgacgagagactgtgtaacattcttcgctacggaggccggacgagcatctccattagcgggtattgcctggtcgaatacgtgaagaaaagaaagaccatccgctctctcgaggctatccccgtttatctgggacggaaagatagcctctccgaggaaaagctgcttaattactttagatataacctgaacgacggcgggaaagattctgtgagcgacattcgcctctgtctgcctttcatctccacaaattctctggtcaagattgacggctacctttactatctgggaggcaagaacgatgaccggatccaactctacaatgcctatcagctgaaaatgaagaaagaggaagtggagtacattagaaagatcgaaaaagctgttagcatgtccaagtttgatgagatcgaccgcgagaagaaccccgtgctcaccgaagagaaaaatattgaactgtataacaagatccaggataaattcgagaatacagtcttctctaagcggatgagccttgtgaaatacaacaagaaggacctgtcctttggggatttcctcaaaaataagaaaagcaagtttgaggaaattgacctggagaaacaatgcaaggttctgtataacatcattttcaatctttctaacctgaaggaagtggatctctccgacatcggaggcagcaaatctaccgggaagtgtagatgcaaaaagaatatcacgaactacaaagagtttaagctgattcagcagtccatcacaggactctacagctgcgaaaaagatctgatgaccatttga

SEQ ID NO: 4400 - RNA, 4176 nt, synthetic construct
  misc_feature 1..4176: note = Cas9 variant
  source 1..4176: mol_type = other RNA
atgaaggagatcaaagactacattatcggcctggatattgggaccaacagctgcggatatgtggtcacagacaagcagaataacatcctcaaactgaagggcaaaacggccattggggctagacttttcaaggaaggagaggccgcggctgatcggcgcgcctttagaaccacacggcgcagactggcccggcgcagatggcggctctccctgcttgaagagatcttcgacgaagagatgaataaggttgatcccagctttttccgcagactgaaagagtctgactactcccctaaggatcggcgcaaacaatttaactctatcgtgttcgaaagctccgaggctgacaaggccttttatgaaaaatacccgaccatttatcacctcagaaatgctctgatgcatgataaccagaagcacgacctgcgggagatcttcctcgccgtgcatcacattgtcaagtaccgcggcaattttctgagagaggattctgtgaaagcgttcaaggccgctaaatttacacttcagggggaagacggaatcggccccgttgataagctgaacgacctcctgaaagagatttatatcgaagccgctcctgagcttgccaccgacaatctgagcaagattgaagatatcatcaaagacaagaagctctacaaacaggataagctgaaacaaattgcgaacctgctccccaaggccgtggactccaaagataaggctaagctgaataaagacatcgccaagcaggtcgctaacgcccttatgggctacatgttccggctggatacactctttagcttcaccgacgtggatgttaaagactataagctgaaattctctgatgccaatattgacgagtcccttgacgctctgacgagcctcctgaccgatgcgcagatcgagtttgtgctggaactccagtctatttacaacacaatcgtcctgaatgagatcgtgcctgacgggatgtcccttagcgaatctatggtgaagaagtatgatgaccataaaaaggatctgaaactctacaaggagtatattgactccctgagcgatcaaaagaaggccaagcagcttgaagctgcctacgccctgtatgtcaactacagaaaagctgacctcctggccgcgaagaaactgttcgagaagaaaaagatcggagataaaaagtttgttgacgtgatttccaacttcgaggtgtttggcaagttcgtctctgataatctcgacgatagcgaactggctaacaaaatcaaggcccgccttgacctgggggagtttctccccaaacagcggaccaatcagaacggagtgattccttaccaactgcaccaggttgaactgacacagatccttgagaagcaaggcaaatattacccgttcctcatcacccccaatcctgtggaatcccacagaaacaatgccccctatgagattagcgagctggtctcttttcgcgtgccttactatgttgggcccctgatcgacaaccagtccattaaggataagcagaataaaaacaagttcgcttggatggtgcggcagaaacaaggacagatcacgccgtggaattttgaagagatggtcgacacaaccgaaagcgccaaccagttcattaagagaatgacacgcaaagatacctacctcctggctgaggacgtgcttcctaagtctagcctgatctatcagaagtttatgattctcgatgagctgaatcggatcaaaatcgacggcaagaaactgacctccaaacttaaacatgatattttcgaaaaactcttcaagaaacaaaagtctatcaacctggacaatctgaaaaactacctcctggccgagggcaacattcccgggcttatcgaaggactgagcgatggcattaattttaacaattccttcagcacatacatcgactatagaaacatctttggggatgagattgacaatcctaacaagcaggcggatttcgaaaagatgatcgagtggtctacggtctttgaggaccgcaagattttcaaacggaagctcaaggaaatcacctggctgacacccgagcagattaaacaggtgtccagcaagagatactctggatggggccgcctgtccaaaaagctccttacccaaatcacagacgaaaatggggttaacatcctgcagcggctgtggaatgagcccgaaaccctcacggaggtgctggccaaccctgtcattaaaagaaagatcagcgaggctaattccctttttgtgcagattaacaaggttgaaaatatcctggatgacgcctatacatctccgcagaacaaaaaggctattcggcaagtgatccgcgtcgtggatgacatcattgccgcggcccacggaaagaagcccagccagatcgctattgagttcgccagatcctctcagaataaagctaaggtgcctgatacccggaagaaacaactcgacaagatctacaacaaaattagctccgaaatcctggatagctctattaagaacgagctgaaaaatcttaagtccaacaagtatctcagcaaagacaagctgtttctgtacttcaaacagatgggcagagatgcctataccggcgacaagctctctctggatcagcttcagaattacgacatcgaccatatctttccccgctccttcattaaagatgacagcctggataaccgggttctcacacaaaagcctatcaatgccaagaaatctgactacgggattcccgctctggaatttggaaacaagtatgtcccggatctgggcatcaccgtgaaagagatgtggaaactttggcaggagaatgggctgattagcaaatccaagctcatcaacctgtgtacaaatcctaaaaagatcggaagcaagagagcgtctggcttcattaaccgccagctcgtggaaacgtcccaggtcatcaaactggtggccattatccttcaagctgagttccccgacaccgaaattatcgaggttaaggccctgcagaatacaaccctcagagagagctttcacctgtacaaaaaccggtccgtgaatgattatcaccatgccatcgacgcttacctgacaaccattgtcgggaactatctttaccaggtgtatcctaagctgcgcccctacttcgtttacggccagtttaaaaagttcaatcaagaaaagaacatcgatattctcaaaagactgaagaactttaatttcctccggcagctgatctttaacacggacgataatatttatatctctggaaccaaagagattgtgttcaacaagaaagacatcatccacaaacttgaaacagcctacggctataagtacatgaatattagccgcgagtgctatcaggaaacctcctctctgtttaaccaaacactctacgcgcataatagctccgtcaagaactctctgatccctaagaaaaaggggctgcccaccgagatttatggaggctacagcgggaataaagattccttctttgtgcttgttaagatcgtgaagaaaagaacgaacctgtaccggattgtcggaatcccgacacgcgagctcgctaagctgaatagctctaacaattataaccaggccctcaataaaatcgtggaatccaagctgtgtcttaaagagaccgagagcttcaagattctgatcaaaagactgctctacggcacactgattgtggacaacgggcagaagttccggatcggctcttttaaggaaaaacacaatgtccagcaacttgttctgcagctcaagtccatgaaatatattaagttctacatcgacggaggccagaactattttaccgatgtggaacgcaaaaagctggagaagcaggacagagataaatgcctcctgtacgtgttcgacgatatcatgaacgtcgtgaataagcggtttacccttttcgacatgagcaaatatgagaaggatggggactctctgagagaaaaatttaactgtctggatttcaatgacaaggtttccattctcagcgatctgcttaaggcctttcatgctaactccgaccgcacaagcatcacgaaactgaagattaccaatctcggacggcaccaagccggcaaaaacgggatcacactgaccacaaatgcgcagattatctaccagtctcctaccggactcttcgagagacgcattaagatcaaagatctgtga

SEQ ID NO: 4401 - RNA, 4176 nt, synthetic construct
  misc_feature 1..4176: note = Cas9 variant
  source 1..4176: mol_type = other RNA
atgaagaaaatcctgggcctcgacctggggaccaacagcattggatgggcccttgtgaatgaggctgaacacgagcatgaacagtcctctatcgtcaagctgggcgttagagtgaaccccctcagcgtggatgagaaaacaaatttcgaaaaggggcggcctctgtccattaacgccgaccgcacgtctaaaagaagcgcgcggcgcaatcttcaaagatttaagctgcggcgcaagaacctcatcaatctgctgctcaaacaccatattatctccaacgagaccatcctgacagaggtcggaaagaataccacacaccagacccttaaactgagatctaaggctacacaggaaaagattagcctcgaggaatttgcccggatcctgctttccattaacaagaagcgcggctacaaaagctctagaaaggagaaaaatgaggatgaagggttcaccatcgacggaatggccattgctaaggagctgtatgataaccagctcacgccgggccaatacgtgtataatatcctgcaggacggcaaaaactacattcccgatttctatcggtccgacctgcaggccgaatttgatgacgtttggcagttccaaaagaaattttacagctctatcctcaccgatgagttctatctgaagctgaaggggcagggaaaagaaaatacacgcaagctgtttctcgctatccatcaggtgtacaccgccgagaacaaaggcaagagagacgcggtcaaactgcagtactataagtggcggtccgaggccgtgaagaaacaacttagcattgaagaggttgcttacgtgctggtcgaaatcaacaataacattaataagtcttccgggtatctcggagccatcagcgatcgctccaaagctctgtacttcaacaatgagacagtgggcgaatatctgtacgggcagctcgtgaagaacagacacaattctctgcggaaccaggtcttttatagacaagactaccttgacgagttcgagaaaatttgggaaacccaggccaagttttacgatgagctgacgaatgaactcaagcaggagatccgcgacgttgtgatcttctatcagcggaaacttaagagccaaaaacaccttatttccgattgcctgttcgaaaagcatcacaaagcgatccctaagagctctcccctctttcaggagttcaagatttggcagaacctgaattacctggagtttgtgcatacacagtccaaagaaaagatcttctttagcgagctcgacgatgaaaccagacaattcgtctttgccgagctgaacattcgcggaacacttaaaatcaaggagatcaaaaagctgattggcctcgaaacccctgtgtattggaaatctaatttcgacgagatcgaaggcaaccggaccaatcaggttctgtacaacgtgtatcagaacattgctgatgacctggggtacggatttgattggagcaagaagcacgccttcgagatcaatgctgaacttcaggccatttttaaagacgtcggcatcgatacagccattctcaacttcgacgcttccatcgaggagaatgactttgataagcaaaaatcttatcagctgtggcatctgctctacagcgcggaagacacggataaggccaccgaggaagacaaactgatctacgggaacattaatacaaagctgaagaaacagctgcaccagaagtatggattcgaggctaaatacggcaacctcctggccaatatctccctgcaacaggattatgggaaccttagcgccaaggctattaaaaagatcctcccctacctggaatctggaaattccttctatgaggcctgtaccattgtgggctacaaccctagcaattctctgacaaaggagcagcaacagaacagaaaactcaaggacaaactggaacttctgccgaaaaattccctccgcaaccccgttgtggagaaaatcctgaatcagaaggtcaacctgatcaaccagcttattgatgaatatggcaagcctgacgaggtgcggatcgaactcgcgagagagctgaaaaagagcgctaaacaacgcgccgatctgtccaagcacattaatgacgccaccctcaaaaaccagaatatccggaagacgctgcagaaagattttgggattcagaacccctctaagaatgacgtcatcagatacaaactttacgatgagctgaaagacaacggatataagacactcttcaccaataaatacatccctaaggaacaactgtttagcaaagacgtggatattgagcatatcattcccaaggctatcctgttcgacgattccttttctaacaagacccttgcctatcgcaatgttaacctcgctaaagccgacgcgacagccttcgattttattagctccaagcacctggacgatctggacaattacaaagctcgggtggaaaccctcttccagagcaagagaatctctaaaggcaagtataagaaactgcttatgacacggcagaacctgccggaggattttatcgagcgcgacctcagaaattcccagtacattgccaagaaagctacggccatgctgaaggaagtcttccggagcgtggttcctacctctgggagaatcacagataaactgcgcgaggactgggatcttgtgaacgtcatgaaggaactgaatctccccaagtatcggaccctgggactcacagagtttattgaacgcaaaaacggcaacaagatcgagcaaattatcgactggaccaaacgcaatgaccatagacaccacgcgatggatgccctgacggtggctttcaccacacataaccacattcagtaccttaataacctgaatgtgacccatgggctcaacggcgttgacacagatcacgagaagtcccggctgtacgccatcaaacaggctatcaccaaggtctatattgtgggaaagacgaaaaagcgcaaatttatccctcccatggaaaatttcagaagccacgccaagaaccatctggagggcattcttatctctttcaaaaataagaacaaagtggtcacaaagaataagaaccggaccaaaacaaagaccaaaggggtgtttaatgaaaagattcaactgacccccagaggacagctccacaaagagacaatctacggccatgccaagaaggttatcgtgacgaaagaaaaggtcagctccaaattcacccacgagaagattcttcaggtgacaaaacctgcttatagagaggcgctcctgaagcggcttgccagctttaagaacgacccgaaaaaggctttctctgggaaaaatgccctgtccaagaaccccctctactttgatatcaccagcggaaagaaggttcctgacacagtgaagctgtcctatttcgaaaattcttacgtcattcgcaaagaggtgaacagcgataactttaagaatgaaaaatccctgcagaaggttcttgacgtgggcatcagacggattctggagaaacgcctcgccgattataacgggaatgctaaggaagccttctctaacctggagaaaaatcccatctggaaggacaaggagaaaggcgtctgcatcaagaaagtgagaattgaagcgctcaagaacgctgagcctctgcatgtgaaaaaggatcaccttggaaagatcattctggacgacgaaaataaaagcacccccgtcgattttatctccacgggcaacaatcaccatgttgccatttacgaggacaaggatgggaaactgcacgacaaggtggtgtctttctacgaggtcgtgagccgggttaacctcggactgccgatcattgataaatcctttaatagccatcttgactggaagttcctgttctctatgaagcaaaacgaaatgtttgtgttcccttccgaggattttaatcccaaagaaatcgacatcggcaaccctaagaataacgagctcattagcaaatatctgttcagagtccagaagttttctaaagtgacatacgggaactccgccgttcgcgattatgtgttccggcaccatctcgaaaccgagctgatcgacaagaaggagcttaaaggaattacctactatcagctcaagagcatcggcatgctggaaaaactggtcaaggtgagaattaatcacatcgggaaaatcgttcacattggcgagtactga

SEQ ID NO: 4402 - RNA, 4176 nt, synthetic construct
  misc_feature 1..4176: note = Cas9 variant
  source 1..4176: mol_type = other RNA
atgaagaccatcctgggcctcgacctggggacaaacagcattggatgggcccttgtgaaagaggctgaaaatgagaacgaagtctccgatatcattaagctgggcgttagagtgaatcccctcacggtggacgagctgaccaacttcgaagggggaaaagcctactctaataacgcggagcggacacttaagcgcggcgctagacggaatctgcagcgctataaactcagacgggagaacctgatcgaaattctgctcaagaatgggctgatcaacaaggataccgcccttacagaggtcggaaaagaaaccacacaccaaaccctgaagctccgcagcaaatccgccaatgagaaggtgtctctggaggaccttgctaaaatcctgctcagcattaacaagaagagaggctacaaatcctctcggaaggttaatgccgaagatgacggcgtggctatcgatgggatggaggtcgccaaactgctgtatgacgaaaacatgacgcctggagagtacgtgctccgcctgcttgaaagcggcaagaaacatctgccggatttttatagatccgacctccaggaggagttcaatctggtttggaagaaacagagcgaattttacccccttattctgaccaaggaactcttctttgaactgcacgggaagaacaaatctcagacatgggcgatctgcaaggagcctctgggaattgtgggcgtcaaactcaaggggtccgccaaagaacaaaagttcgctcggtatcgcctgagaaaggaggcccttacccagcagatcgagctggaacatctcgctattgtgctgcaggatatcaacaatgacagcaacaaatcttccggataccttggcgccatcagcgatcggtctaaggagctgtttttcaataaagaaacagtgggccaataccagtataagcagctccagaaagaccccaacacctccctgaagaatcaagtcttttaccgccaggactatctggatgagttcgaagttatttggagaaaccaggcgaagttttaccctcaactcacgaatgagctgaaacaggagatccgggacgtggtgattttctatcagagaaaacttaaaagccagaagaacctgatctccttttgtcaattcgaatctacacagcagaattacgtcgagaaagaaaccgggaagacaaagattcgcaccatcggacggagagtgatcccccgcagctcccctctcttccaggagtttaaaatttggcaaagcctgaacaatctgaagttcgttaactctgagtccaatcagatcattcagtttatcgaacttgaggatgacgtgaaaaaggtcgtgttcgatgaactcaacctgcggggcgacctgaaaccgaatcaggttctcaagattctgagcaaatatatgaagatcgggaaacttacccaatggaagtgcaacctggaggaaatcgagggaaacagaacaaattctgccctctacaacgtgtttcagatgattgctgaggaagagggctacgggttcaattggggaaagaaaagcgccctggaaatcaagtccgagctgaaagctattttctctagcatcggcattaacgattccatccttgacttcgattttagcaagaagctcgaccagcagctgtcttatcaactgtggcacctcctgtactccgccgaagagggcaatagcaaaattacggaggaagataagttcacctatgggaacacaggagtcgcccttaaaaagaaactgcatctcaagtttggcttcaagcccgagtactctaccctgatctccaatctgcgctttacaagcgactatgggaacctttcctctaaagctatcagcaagattctccctttcctgcgggacggatccgattactctaaagcgtgtcagtatgccggctacaatcacagcaactccctgagcgctgacgaactcgataatagagagctgaagcccaaacttgaactgctcaagaagaactctctgcgcaatcctgtggtcgagaaaatcctgaaccagatggtgaatgttgtgaaccaagtcattgacaactacgggaagcccgatgaggtgcggatcgaacttgccagagagctcaaaaagtccgccaaagaacgcagccagatgaccaagaatatttctgacgctacgcggagaaacgccgagatcaaaaagtatctgtccaaggagttcggcatcccgaatcctacaaaaggagatgttattcggtaccgcctgtgggaggagctcgcgagcaacggctataaggacctgtttagagataaatacatccccaaggaaaaacttttctctaatgagattgacatcgaacacattatccctaaggctctgctctttgatgacagcttctccaacaagaccctggcctttaaagtggataatctgaagaaagccgaccggaccgctttcgactttatgagcacagatttctctaaggacgtcgattcctatatcgggagaattgagacccttcataaagacggaaagatcagctcctctaagtacaaaaagctgatgattcccaaaagcaagctcgtggatggctttatcgagcgcgacctgcggaacacacagtatattgccaaacaggctagaaagatgctcctggaagtgttcaagacggttgtccccaccacagggaaaatcaccgataaacttcgcgaggactgggatctgatcaatgtgatgaaggaactcaactttcctaagtacaaagccctgggactgacaaagaagattgagagattcgacgtgggctccgaaaagatcaagtctattaatgtcatcgaggggtggagcaaacggaacgatcaccgccatcacgcgatggacgcccttgctgtggcctttaccacgcacaatcatattcaatacctgaactatctcaatgctagaaaggatatccaccatgagatgcacggcaccattaaatccatcgaaaaccagatcattggaaaggacgttatgggcaaacggcgcttcatcccgcccatttctgacctgagaatgaaggccaagctccagatcgagagcattctgatctccttcaaaaacaagaataaagtggtcacatggagcgtgaacaagaccaaacttaaggggaaggataattacaacaaacggcgccagctgacacctagaggacaactccataaggaaaccgtttatggcaaaatcaagctgattgaccccaaacctctgaaacttaataacaagtttacgctggtgcgggcgtctatgatcgtcgataaggtgcaccgcgagattgttctccagcacctgtccaagtacgacaataacagcgaagtggccttcgattctaaaacaatcaagattgaccccatcctcatcgaggggattggactgaaagaggtcgtgtgctatgaagatgtgtttaagatcagaaagaaaatttccggcgacaatttcaagaacgagaaacatcttgaaaaggtcatcgatgagaaagttaagcagattctgaaagaccgggtgatcaagtttcaggggaatttcaaggaggcttttagcaacctggaagagaatccgatttggctcaacaaatctaagggcatcgccgtgaaatccgtcgctatcaagggagtgaataacgccgaaagcctgcacgagggcaaagatcatttcggggaccaaattcttgacaagaataagaaacagatccctgttgattttgtgtccaccggaaacaaccaccacgtcggcatttacgaagacaaggatgggaatctgcaggagagagtggttagcttctttgaggccgtgacacgcgtcaacgaaggactccccatcattgacaaaacctataattctgatatcggctggaagttcaaattcaccatgaagcaaaacgagatgtttgtgttccctagcgacgattttgaccccaatgaatttgatctgacagacgggaagaacgctgcgaaaatctcccctaatctctaccgggttcagaagattgccacgaaaaactacatgtttagacatcacctggagaccgtggtcacaaatgatcttgagttcacctataagtctatccgcagcacaggctggctgcggaacctggtgaaagtgagaattaatcatctcggagaaatcgtctacgttggcgagtattga

SEQ ID NO: 4403 - RNA, 4176 nt, synthetic construct
  misc_feature 1..4176: note = Cas9 variant
  source 1..4176: mol_type = other RNA
atgaagaaaatcctgggcctcgacctggggaccacaagcattggatgggcccttgtgaacgagaaggaaaataacgaggaactgtcctctatcattagactcggcgtccgggttaatcccctgacggtggatgagaaaagcaacttcgaaaaggggaaagacatcaccacaaatgctgatcgcaccaagtgcagatccgcccggcgcaaccttcagagatttaagctgcggcgcgaggcgctcgctgactgtctgaaaagacacggactgatgacagatgagacccctctctgcgaaacaaataactctattatcttcaagacctacagcaatcgggccaaagccgtgtgtgagaagatcgctctggacgattttgtccgcgtgcttttcatgattaacaaaaagagaggctataagtcctctcggaaactgaatacggacgatgaagggaccctcgttgacggaatggatgtggccaagctgctttacaacgagcaaatcacaccgggcgagtatctgctccgcctgtttaaaaagggcaaaaagaccagacccgacttctacctgagcgatctcaaagctgaactggagcggatttgggactttcagcgcacattctatcctgaaatcctttgcaatgccctgaaggaggacctcaaggggaaatccagaacccagagctctgcgatcttttacgccaagtataaagtctccacggctaagatcgccggaaaagataagcggctgcaggaacttacatggagaaccgacgctctgcgcaagcaactcacaattgatgaggtggcctacgttatctgtagcatcaacggcgaggtgaatgggtcttcccagcggctgagcatgatttctgacagatccaaactgctctacttcaaccatcagaccatcggacagtatctgatgcaacgccttgaagagaaccccaatgcgggcctgaagaacattatcttttaccggcaggattatgaagacgagttcaatgatatttggaacagccaggccacctaccacaaagaactcacacctgagctgaagaaagaggtcaaggacatcatcttttatcagagagggcttaagtcctgcaaatggctgattaattactgtgaactcgagcatgaagagatcgaagtgaagacgcccgagggaaaactgcgcaagattaccatcggctctaaaacatgccctaagagctccccgctgttccaagagttcaagatttggcaagtgctcaacaatctgcaggtcagcccccttaactctcggagaaaagctaagcgcaaaaaggatgaggaaccttccctgtttagcgacgaagatatgaataccgcctgtcggtatctcaacgaggaggaaaaactgacactgttcaaggagctttctatcaaaaaggaactcaagaaaaaggacgctctgaaactgctctttgagaattacaaggaactggaccttaactacaaagttatcagcggcaatgtgaccatggccaacctgtatagagccttccaggatattatctccctcacggggaatggagagtttgacttccaggctatgcccgcggaggaagccgagaagacagtggaagagatttttggcgggctgggatacaagaccgctttcctgcactttgatgcctctcttcatgacaaagagttcgaacgccagcctgcctatcggctctggcatctgctgtacagctatgctggcgatcagtccaagaccgggatcgaggccctcgtcaaacggattcaagaactgtgcggatttgagcccgaatacgcgcggatccttgctaacattagcttcatcccggactatggcaacctgtcttccaaggccatgcgcaaaatcctcccttacatgcaggatggctacgagtatagcgaagcctgttctaaggctgggtacagacactccgccagctccctgacaaaggaggagattaataaaaagaactataaaacccacctggacgaaatcaagagaaattctcttagaaaccccattgtggagaaaatcctcaatcagatggttaacgtggtcaatagcgtgattgatacatactccaacatcgacgaaatccgcattgagatggctcgggagctgaagaagtctaaacctgaaagagaggatatgagctttgccatctccaaggcgacgaaagaaaccgagcgcattaagggaatcctggaacaggagttcaaaattcaacacgttacaagaaatgacatcatccggtatcgcctctacgaggaactgaagcccaacggctataaaaccctttacagcaatacatacattcccagagaggatctgttctctaagaagtttgacatcgaacatattatccctaaagcccgcctcttcgacgattcctatagcaacaagaccctggagctgcgggacattaatatcgaaaaagggaaccagacggcttacgattttgtgctttctaagtatggagaggagggcctctacaaatatgaacagagagtcgaggagttcaagaagaataacgaacaggccgggaccaaatgccggaagctgctgatgcgcgaagctgacatcccgtccgattttctcaacagagacctgaatgatagccaatacattgccaaaaaggcgcacgagcttctgcgggagatcgtgcccacagtcaccgccacaaccggctctattacgaaccgcctcagagaagactggaaactggtgaatgttatgaaggagctgaactgggaaaagtatgataaacttggactgacagaggagtacaaggacaaagatggcaataccgtgcggcacatcaaggactggacaaaaagaaacgatcatcgccaccatgctatggacgccctcaccattgctttcaccaagcctagctttatccagtacctgaataacctcaatgcccggtccaacagagggggaagcatttatggcatcgaacagaaggagctggaacgcgagaataacaaacttgtcttcattccccctattgaccccaagatctttcggaaacaggccaaggaacacctgtctaatattctcatctccattaaagctaagaacaaggtggttacgaaaaatgtgaacaagacaaaaagcaagtccgggaccaacagaaaagtccaactgacaccgcgcggacagctgcatcttgagaccgtgtacggcaagatccggacatataaaaccgaggaaatcaaggtggggacgaagctgacagaggaactcattgcgaaagttgccgataagaaaatcagagaggctctgatgcagcgcctctctgaatacggcggaaatattaagaaagccttccaaaacatcagcaagcaccctatttggctgaatggctcccacaccaagcatgtccccgagaaagtgaagatcgtgtttttcgaggacgtctttaccatccggaaagccattacacctgatatcaagattgacaaagtgatcgattctaagattagacggatccttcaggaacgcctgaacgagttcgggggagaagctagcaaggccttctccaatctcgacgagaaccccatttggtttaatagagataaaggcatcgcgatcaagtctgttaaaattcgggggatcgctaagggaaccgccattcgcgtgaaaaaggacatccacggcaagacaattatcgggaacaatggctatcctgtcgccaacgattacgtgaatacgggaaacaatcatcacgttgctatcttcagagacaaagatggcaacctgcaggaacacattgtgagcttttatgaggccaccgcgcgggctatccagaatctgcccattgtcgacagaaactacaattccgagaaggactggaaattcctttttagcatgaagcaaaacgaatacttcgtgtttccgaaccctaatacagggttcaacccctctgagatctccctgaaagatgaaaagaattatgccctcattagccccaacctgtttcgcgttcagaaactctctcattactattacgtgttccggcaccatctggagaccaatgtcgacacaaaccttcagctgaaggatatcacctggaagagaatcacggccgtgaataacctgaccggagctgtgaaagtccgcattgaccacctcggccggatcgttgatgtgggggagtataagtga

SEQ ID NO: 4404 - RNA, 4176 nt, synthetic construct
  misc_feature 1..4176: note = Cas9 variant
  source 1..4176: mol_type = other RNA
atgaagaactaccacatcggcctggacattgggaccagctccgtgggattcgccgctagagatgacgataataacctcatccgggtcaaaggcaagaatgttattggggcccgcctgttttctgagggacagacagcgcaagaaagacggatggctcgcacgagcagacggcgctataacagacggaaatggcgccttagactgctcgacgagatcttccatgatgaaattatccacaaggacgccgagtttttcaatcggctgaaacagtcctttctttctcccaaggatgaacgcaagcagtacttcggcagcctgctctttcctgagaccggggactccgagtattaccataacggaaatcagacaatctatcacctgagacatcggctgattacccaagatgaaaaagccgacatccgcgagatttacctcgctctgagacacatcattaagtatcggggcaacttccttgatgacacaccggtgtctagctttgaagcctccgatctgaaactcgctagcttcgtgcccaccatcaatgacctgtttgagacaattgacgtcaactacgagttctctatggataatatcaacgaaatcgaggacattcttctgaataacaagctcagaaattccgataaaagcaagcagctgaccgacctgctcacggaacctatcgtgaacattgatgacaagtctctggagaaacagtttaacaaggaacgcaccgatatctccaaagagattgccaagagcgttgtgggctctaaaatgaatgtcaacaaacttctgtccttcgagagctccgaagggtctaaaatcgcgttcagcttttccgacgccagctctgaggataagatgatggaactctccgacatcctggatgacagccggatgaatattcttaacatcctgaaggtgatttactctagagttcgcctcaatcagatcattcccagcggaatgggcctgtccgagtctatggtggctgcctatgacagccacaaacaacagctgaaggatctcaaaacactgcttaacgtcctgcctttcaatgaacggtacgctgtgaagatcgcctatgcggcctacatcgggaacattgacaaacagaagtttaccaagtccgagatcaaagctattgataagctcaaagaaaagagcgccatcatgaatgtgctggacttcaaatctggacatattacaaacgaggagctttccaatgtcatcaaggctgttattgtggataagtatctgaacgacgaagattttgagtaccacggcatcgtggaaaagatcaatcaggacattagcaacgggtcttatctcctgaagcaaagaaataaccagaacggaaatatcccccatcagctgcaccaaatggagctcgatcagattatcgagaaccagtccaaatactaccacttcctgggcgaacttaatcctaacagcaatcgcaaccatattgccaagtataaaatctccgagctggtcgcctttcgggtgccgtactatgttggccccctcatcacccctgaggagcaggagaagacgtctggggctagcttcgcgtggatgaagcgcaaaaaggacggagccattacaccctggaattttgaagagaaagtggataaggaagagaccgcttccagattcatcaaacggctgacagtcaaggacacctacctgcttaacgaagatgtgctccctgacaattctctgctgtatgagaaatttaaggttctcaacgagctgaatgtggtcaaggccaacaataaaagacttaccgtggaagagaagcaaggcgccttcgacaacctgtttaaaaagatgaaaacagtcacggctaagcgcctcaagaattacctggtgagcaaccacaaccatattaattccgttgaaatcaccgggctgagcgatggagacaaattcaacaattctctttccacatatattgatttcaagaaaatctttggcgacaagatcgataaccccgggctcctggacgatttcgaggacattatcgaatggagcaccgtgtttgaggatcggaaaattttcgaggaaaaggtcagaaaggacatctcttggatttccgagagcgaaatcaaatctgtggttagcaagcggtactccggatggggccgcctgagcaaaaagctcctgaattgcatcacaaacaatgagggcagaaacattatcgatgaactttgggaggagtctgaaacctttatggaggccgtgtccaaaccggaagtcaaggagcagattgacgggatcaatagcgatttcattaagaacacggacatcgagtccgtgctggcggacgcttacacatctcctcagaataaaaaggccattcgggaaacccacaaactcgtgaaggatatccagaaagccatgggaggccaagctcccgccagcatctccattgagtttaccagaaaccctcaggacaaggggcagctgacacgctctcggcatagcgaagtttccagaaaatataaggagatctctaaggaaattagcaaaaccctgaatgatgagcttaagtccaaaaagaacagcatggacgtcgataaatactatctctacttcatgcagatgggaatcgacctgtatgatgggtcttccattgacatcgatgacctgaataactaccaaatcgatcacattatcccccagagcttttataaggacgactctttcgataaccgcgtgctcacacactactccaataaccagaagaaaggcaataacacgcccctgaatggccttaacattaatgacaagaccagagctatctggaaccatctgcgggatctcggactgattaccaaaaagaaatacaatggcctgacccttaaggggatggaccagctcagcaagtatacaaaacacggatttatccgcagacaactggtggagacctctcaggtcatcaagctggtggccaacattctctccgatgagttcagcacggacgataccaaaatcattgaagttaaggcgaaaatgaactcccagatccggcaagtgtttaatctgtacaaggtccgcgaacttaatgactatcatcacgccgtggatgcttacctgacaaccttcattggcgggtatctctacaacagatatcctaatctgcggaacatgttcgtttacggagactttaagaaattcagcgccgatgtggacaatctgaagacatttaacttccttcacgagatcaccaacccgtctgataaatttgaagaccgcattttcgacgaaaagagcggcgagctgatcctcgatagaaaacatgctatcgaaacgattaagaagatctaccagtataaatacatgctgattacacgggaggtctccaccaagaatgggcagctctctgaccagacagtgtatagcgccaaacgcatcaacaatgttaaggcgcccattcctgtgaaaaaggattttaaccccgaactgtacggcttcagaaccggaaatgtcgaccaccatatggtgatcgtgaaatatcctaagaaggattcctacgactataaagtcgttggcatcccccttcggtttgtgcaaaagctgaaagagaccaaggataacaaagactacgaaaatctcctgaaccagattgtgcagatgaagctgaatagaaagaaacaggatttcatcgtcgtggttgacaacgtgatgtacgggcaacttattcaggatggaggccagaagtttacactggggtctagcacgtatcgctacaatgccaaacagctcgtcatcgacaacggatatctgaagctcattgctgatgagcggtacaaaaattccctgaccgacgaggaaaagtctaaccaatatatcacactttacaatgagatcctgaaggtggttaacggcagattcgacgtgttcgatgtcaacagctttcgcaaaaagctcaataacggggtggacaaattcattaagctgaataccgttgataaacggatcattatcatgaagattctgtccggccttcactgtggaccgagcatcgtgcctctgaaggaactcggcctgacaacacccctcgggcagctgcagtctacgtccggaattagcctttctgagaacacaatcatcatttatcaatcccctagcggcctgtttgagagaaaagtccgcctgggggacctctga

SEQ ID NO: 4405 - RNA, 4176 nt, synthetic construct
  misc_feature 1..4176: note = Cas9 variant
  source 1..4176: mol_type = other RNA
atgaagaactaccacatcggcctggacattgggaccagctccgtgggattcgccgctagagatgacgataataacctcatccgggtcaaaggcaagaatgttattggggcccgcctgttttctgagggaaaaacagcgcaggaaagacggatcagccgcacgtccagacggcgctataacagacggaagtggcgccttagactgctcgacgagattttccatgatgctatcgtgcacaaagacgccgaatttttcaatcggctgaagcaatctagcctttcccccaaggatgagcgcaaacagtactttggctctctcctgttccctgaagtgggggacggagattattttagagacggcaaccagaccatctaccatctgcggcaccgcctgatgacacaggatgagaaggccgacattagagaggtctatctcgctctgcggcatatcattaaatacagaggcaatttccttgatgacaccccggtgagctcctttgaagccagcgacctgaagctcgcttctttcgttcccacactgaacgatctttttgagaccatcaatgtgaactatgaactgtccattgacaatgtcaaccaaatcgagaatattctcctgaacaataaactgcgcaacagcgataagtctaagcagctcacagacctgatcgccgagcctgtgaccaacatcgatgacaaatcccttaagaaacagttcgataaggaacggaaagacattagcaaggagatcgcgaaagccgttgtggggtctaagatgaatgtcaacaagctgctctcctttgaaagctccgatggatctaaaattagcttctccttcagcgacgcttcttccgaggataagatgctggaacttagcgacatcctggacgattctagaatgaatattctcaacgtgctgaaagtgatctacagccgcgtccggctgaatcagatcattccctccggcatggggctctctgagagcatgatcgccgcttacgacctgcacaagcaacagcttaaagatctgaagacgctcctggacgttgtgccttttaacgagaagtatgccgtgaaaattgcgtacgccgcttatatcggaaatattgataagcagagattcaccaaagccgaagtcaagacaatcgacaaacttcgcgataagaagtccatcaccagcgtgctggactttaaatctggccacattacaaacgaggaactcaataacgttatcaaggaggtgattgtcgataaatacctgaatgacgaaaccttcgagtatcatgatatcgtggagaagattaaccaggacatctccaatgggaactacctgctcaaacaacggaataaccagaacggaaatattccccaccagctgcatcaaatggaacttgatcagatcatcgagaagcagagcaagtattacccttttctgggcaaactcaaccccaattctaagagatcccacattgctaaatacaagatcagcgaactggttgccttccgcgtgccgtattacgtcggccctctgattacgcccgaggaacaggagaaaacatccggggcctcttttgcttggatgaagcggaaagaggacggagcgatcaccccttggaacttcgaaaagatggtggacaaggagagcacagcctccagatttattaaacgccttaccgtcaaggatacctatctcctgaatgaagacgtgctgcccgataactctctcctgtacgagaaattcaaggttcttaatgagctgaacgtggtcaaagctaataacaagcggctcacagtggaagagaagcaaggcgcctttgacaatctgttcaaacagatgaagacggttaccgccaaaagactgaagaactatcttgtgagcaatcacaaccatatcaattccgtcaaaatcacagggctcagcgatggagaaaagtttaacaactctctgtccgtgtacattgacttcaagaaaatcttcggcgataagattgacgatagcaaactgtttgacgatttcgagaatatcattgaatggtctaccgtgtttgaggaccgggatatcttcgaggaaaaggttcgcaaagacatctcctggattagcgagtctgaaatcaacgctgtcgtgagcaagagatattccgggtggggacggctcagcaagaaactgcttaatggcattacaaacgacgagggcagaaatatcattgatgaactgtgggaggagtctgaaacctttatggaggccgtgtccaagccggaagtcaaagagaagatcgacgaaatcaacagcaatttcattaaaaacacggatatcgagtccgtgctcgcggacgcttacacatctcctcagaataagaaagccattcgcgagacctacaagctggttaaggatatccagaaagccatgggagggcaagctcccagctccatttctatcgaatttacccggaaccctcaggacaagggcgagctgacaagaagccgccactccgaaattgccaaaaagtataaagagctttctaaggaggtgagcaagaaactcaatgatgaactgaagtccaaaaagaacagcatggacgtcgataaatactatctgtacttcatgcagatggggatcgacctctatgatggaacctctatcgacattgacgatctgaataactaccagatcgaccatattgtgccccaatccttttataaggatgacagcttcgataatagagttcttacacactactctaacaaccagaagaaaggcaataacacgcccctgaatgggctcaacatcgactccaatacccgggaggtgtggaaccatctgattggcctgggacttatcacaaagcgcaaatacaataacctcaccctgaagggcatggatcagctgagcaaatatacaaagcacgggtttatcagacggcagctcgtcgaaacctctcaagtgattaagctggttgctaatatcctttccgacgagtacagcaaagatgacacgaagattatcgaagtgaaagccaagctgaactcccagattcgccaggtcttcaatctctataaaatcagagagctgaacgattaccaccatgcgctggacgcctatcttaccacatttatcggaggctacctgtataatcggtaccctaacctccgcaatatgttcgtgtacggggatttcaagaagtttagcgctaaaattgacaacctggagaccttcaattttctccacgacatcacaaacccgtctgataagttcgaagacagaattatcgatgagaaaagcggagaagtgattctggaccggcgccatgccatcgagaccattaagaaaatctatcaatacaactatatgcttatcacgagagaagtctccacaaagaatggccagctgtctgatcagaccgtttacagcgctcggagaattaacaaagtcaattcccccatccctgtgaagaaggactctaaccccgagctctatgggtttcgcacaggcaatgtggatcaccacatggtgattgttaaatacctgaacaaggacaaatatgattacaagatcattggaatccctctgcggttcgtgcaggtccttaaaaatagcaacgacaataccgagtacaagaacatcctgaataagattgtgcaatccaaactcaagggcaaatctaccgattttagagttatcctggacaacgtgatgtatgggcagctcattcaggatggaggccagaagttcacactggggagctccacgtacaaatataatgccaagcaacttgtcatcaacatggacgacattcgcatcctggtggataatcggtactttaacagcctctctgacgatgacgcgtccggagagttcatcaagatttataacgaaatcctgaaagttattaatgccagatttgatctgttcgacatcaacaagttccgcgaaaaacttaataacggcaaggagtactttgaaaatctgagcattgatgagaaaaaccaggtgctcctgaagatgctctctgggctgcattgcggctccgctaatgtccccatcaaggagcttggactgaccacaccgctgggcaaactccagattcctagcgggatcgtgctgtccgaagacgccatcgtgatttatcagtctcccagcggacttttcgagcggaagatcagactgaaagatatttga

SEQ ID NO: 4406 - RNA, 4176 nt, synthetic construct
  misc_feature 1..4176: note = Cas9 variant
  source 1..4176: mol_type = other RNA
atgaacctgagaaattaccccggcgagtatagcatcgggctcgacatgggaaccggctccgtggggtggtctgtcgttgatgaaaagggaaacctgcttcacttcaaaaagaaacctacatggggcagccggctgtttgactccgtgatgccggcctctgaggctcgcgtgcatagagggcagcggcgcagatacgaacggcgcagatggcggctcgatctgcttcaaggactgttcaagaatgagatgaacaaagtcgaccccgaatttttcatgcgcctcaatcagagcagaacgattgagggcgatcctatctttaccaagtccttcacaaaggccgactattacgatcggtttcccaccatttatcaccttcgcgcgtacctgatggagtctaacgaacctgctgacctcagactgatctatcttgccatgcataatattatcaaacaccggggcaacttcctgcgcgaggaagaaaagagcctctccgccaaacatgctgatagcaagaaagccgtgacacagtttgttgacgctctgaaggagtggtgcttctctagagggtacgaatttggaaaggatcccgccaaatccatcgagaagtgtcttagcgactctaaatccagccggtctcagctggcgtccgaaattgccaaggctctcgccgtgagcaccgatgctgccgcggccgacaaaaagctggctgacaatctggccaaagctatggtcggcctccaatgcgagttcaagtacgtgtttggggagttcgattgtgagtccacaaagctggccctttctgacgatgagaaactggaactcctgagagccgcttgccctgacgatagcgttgagcttctggacgcgctctgtgccgtgtattccgcttacgtcctgcagggactgctcagctatgccccgggccagaccatctctcacaacatgattgccaagtacgatctgtataaaacggaccttaagaccctgcgcgctctcgtgcgggaatacgcccccggggcgtatgatgagttctttagaggagctacataccacgacgccaatcctgatgactccagcaaagactactcttatgccgatgctgaaggctacaccgcctataacctgcataagctgagctacgacgatttcgctaaggccgtgaaaaagctgctcggcgggacagacgcggtcaccgatgagcgctatctgaatatgatggagcggtttgaaaaacagcaattcctgagacgcctcaagacgtccgacaacggagccatctactatcagctgcaccttgaggaactgacagctattatcaaaaatcagggccggttttactctttcctcaaggagtacgaagggaagtttgagagcctggtttccttccgcattccctattacgtgggacctctgaccagcgtgaacgccgctcaggattctcataaccacaatagatttcaatggtccgagcggaaacccggcatggaaagagaggtcatcacaccgtggaactgggacaccatcattgataagaataaaagcgccgaaaacttcatcatgcgcatgaccggggactgcacatatcttgcgggagagaaggtgctccctaaacagtctctgctgtacgaggaattttgtgttctcaatgagctgaacggcgtgcggtggtccgatgacggcgatgactggcagagattcgacgccgctcaacgggaagggattgtccgcgagctttttcacaagtatagacgggtgacgtacaagatgctggaagattggctcgttagagagggagacgccaatcatcccatcgtgaaaggcgggcagggagagaccggcctggaaagcaagatggggtcctatctgttcttcgctaaaggcatttttggacttggcgagctctctcctgccgaataccccgccatcgagaagatgatcaaatggaacacactgttcgaagatcgcagcattctgaaggagaaactcgaggacgaatttggggagcggggaaatggcatgctggatgcttcccagatcaaggcgatttgcaagaaaagattcaccgggtggggacgcctttctgaacagtttctgacaggcctcaaggtcgagagccccgccgggagagctgtgtccatcatggacgtcctgcgggaaggcaacccttgtagcgagcgcagacaaggagagaccgtggttatgatggaagccctgcgggatgagggccttgggttccagaaaaagattgacgaacacaatcgcaactactatggacagcatggcaaagatctcggggtgaatgagctgccgggatctcccgccatcagacggtccctgaaccaggctatccgcattgtcgaggaaatcgccagcattgcgggccacgctcctgccaatatctttattgaggtgacgagaggggaagacgccggcaagaagggaaaacggacagttaagcgctgggataaaatcggcgaggctctcaagaaactgaaggaagagggggtggccgtcgaggtgatggacgatttcaaggaacaaaaagcgattaacgctaaccttgacgagagactgtctctctacctgatgcagaatggaaagtgcctgtattccggcaaagccatcaaccttgaaaagctcctggccgggagcggagagtacgaagtggaccatatcattccccgggcttatatcaaagatgactctattgagaataaggccctggttctcagagaggaaaaccagcacaagaccgatcagctgcttatcgacaaaagcattcgctggaagatgcgggagacctggtcccaactgcacgatgctggcctcatcggggacaaaaagtaccataatctgctgagaagcaacatcaatgaaaaccagcttcgcggctttattgcccggcagctggtcgagacatctcagatggtgaaactcgcgcaagccctgctcgaagctagattcgccaatgaggagacccgcatcgtgcctgtcaaggcttccatgagccacaacctgcgggaagccgccgatcttgctaaatgtagagaggcgaatgactttcatcacgcccacgatgctttcctggcctcccgcattggactctttgtgcagatgcggcatcccggcatctatgaaaacccgattgggtactctcacgttatcaagaagtacgtgcaggagcaaagcgaggtcttcaaaaagacacatagaatgcctggatccgccggcttcgtgatcaattcttttatgagctccgggttcgacaaagatacgggagaagtttttaaggactcttgggacgctgaggccgaagtggatggcattcggaaagcgctgaactatcgccagtgctacatcagcagaatgccccagcaggacaccggcgctttctggaatgccacagtctattcccctcgggatcccaagatggggcctaagctggcccttagcaccaaacaaggactggaccccaagctctacggcgggttttcttcccagcagttcgcttactttttcatttatgaggccaaaaagaaaggaaagccgacatttcgcttcagccaggtgcctgtttggctggcggctagaatcgaagccaaccccctcgccctggaggagtatgctcggggccttgccaagggggaaggactggagtttgtgtctattcaaagacccaaaatctacaagaaacagctcatcgaagtcaacggcgataagctgattatcaccggcgctaaagaggtgcgctccggggccgaactggcgttcaatcaggacgagattagcgccatctctatgtgctccaaacttcgggctgccgaggctggactggatggcgccttcagcgaagaggtgtccgccatttggaacagaatcagcaatgctcctgtccagtcttgtgggcgcctcctgcggcaactcacgctgccgaagtaccagagcaactttgactcctctagcaatgaagagaaggcggccgttgtgcttggactgattgctctgctcaacggcaataacagaatcgtggatctgtccggggtcggaggctctagccacgccggcgccatgatgatgtcctatcccaaacttctggacgatcctaaggtgcccttctttatcattgaccagtctgttaccgggatgttcgaacgcaagacacgggtgggactctga

SEQ ID NO: 4407 - RNA, 4176 nt, synthetic construct
  misc_feature 1..4176: note = Cas9 variant
  source 1..4176: mol_type = other RNA
atgaagaaaatcctgggcctcgacctggggaccacaagcattggatgggcccttgtgaacgagaaggaaaataacgaggaacagtcctctatcattagactgggcgtccgggttaatcccctcacggtggatgagaaaagcaacttcgaaaaggggaaagacatcaccacaaatgctgatcgcaccaagtgcagatccgcccggcgcaacctgcaaagatttaaacttcggcgcgaggcgctggctgactgtctcaagagacacggactgatgacagatgagacccctctgtgcgaaacaaataactctattatcttcaagacctacagcaatcgggccaaagccgtgtgtgagaagatcgctctcgacgattttgtccgcgtgctgttcatgattaacaaaaagagaggctataagtcctctcggaaacttaatacggacgatgaagggaccctggttgacggaatggatgtggccaagctcctgtacaacgagcagatcacaccgggcgagtatcttctgcgcctctttaaaaagggcaaaaagaccagacccgacttctacctgagcgatctgaaagctgaactcgagcggatttgggactttcagcgcacattctatcctgaaatcctgtgcgacgcccttaaggaggatctgaaggggaaatccagaacccagagctctgcgattttctacgccaagtataaagtctccacggctaagatcgccggaaaagacaagcggctccaagaactgacatggagaaccgatgcccttcgcaagcagctgacaattgacgaggtggcttacgttatctgtagcatcaatggcgagattaacgggtcttcccagcggctcagcatgatctctgatagatccaaactgctgtacttcaatcatcagaccattggacaatatctcatgcagcgcctggaagagaaccccaacgcgggccttaagaatatcattttctaccggcaggactatgaagatgagttcaacgacatctggaatagccaggccacctaccacaaagaactgacacctgagctcaagaaagagctgaaggatatcatcttttatcaaagagggcttaagtcctgcaaatggctgattaactactgtgaactcgagcatgaagagattgaagtgaagacgcccgagggaaaactgcgcaagatcaccattggctctaaaacatgccctaagagctccccgctgttccaggagttcaagatctggcaggtcctcaataacctgcaagtgagcccccttaattctcggagaaaagctaagcgcaaaaaggacgaggaaccttccctgtttagcgatgaagacatgaacaccgcctgtcggtatctcaatgaggaggaaaaactgacactgttcaaggagctttctatcaaaaaggaactcaagaaaaaggacgctctgaaactgctctttgagaactacaaggaactggatcttaattacaaagtgattagcggcaacgtcaccatggcctccctgtatagagccttccaggacatcatttctctcacggggaatggagagtttgatttccaggctatgcccgcggaggaagccgagaagacagttgaagagatctttggcgggctgggatacaagaccgctttcctgcactttgacgccagccttcatggcaaagaatttgagcgccagcctgcctatcggctctggcatctgctgtactcctatgctggggatcaaagcaagaccggaattgaggccctcgtgaaaagaatccaggaactgtgcggctttgagcccgaatacgcgcggattcttgctaacatctctttcatcccggactatggcaatctgtccagcaaggccatgcgcaaaattctcccttacatgcaggatgggtacgagtattctgaagcctgttccaaggctggatacagacacagcgcctcctctctgacaaaggaggagatcaacaaaaagacctataaaacacacctggacgaaattaagcggaacagccttagaaatcccatcgtggagaaaattctcaaccagatggtcaatgtggttaactccgtgatcgatacgtacggctctatcgacgaaattcgcatcgagatggctcgggagctgaaaaagagcaagcctgaaagagaggatatgtcctttgccattaataaggcgaccaaagaaacagagcgcatcaaggggattctggaacaagagttcaaaatccagcacgtcaccagaaacgacatcattcggtatcgcctctacgaggaactgaagcccaatggatataaaacactttacagcaacacctacatccccagagaggatctgttctctaagaagtttgacattgaacatatcattcctaaagcccgcctcttcgacgattcctatagcaataagacgctggagctgcgggacatcaacatcgaaaaaggcaatcagaccgcttacgattttgtgctttctaagtatggggaggagggcctctacaaatatgaacagagagttgaggaatttaagaagaacaatgagcaagccggatccaaatgccggaagctgctgatgcgcgaagctgacattccgagcgattttctcaacagagacctgaatgattctcagtacatcgccaaaaaggcgcacgagcttctgcgggagattgtgcccacagtcaccgccacaaccggcagcatcacgaaccgcctcagagaagactggaaactggtgaacgtcatgaaggagctgaattgggaaaagtatgataaacttgggctgacagaggagtacaaggacaaagatggaaacaccgtgcggcacattaaggactggacaaaaagaaatgatcatcgccaccatgctatggacgccctcaccatcgctttcaccaagccttcctttattcagtacctgaacaatctcaacgcccggagcaataagggcgggtctatctatggaatcgaacagaaagagctggaaagagagaacaataaacttgttttcattccccctatcgaccccaagatttttcgcaagcaagccaaagaacacctgtccaacatcctcattagcatcaaggctaagaataaagtggtcacaaagaacgtgaataaaacgaagtccaaatctggcaccaaccggaaggttcagctgacaccgagagggcagctgcatcttgagaccgtgtacggcaaaatccgcacatataagaccgaggaaattaaggtcggaacgaaactgacagaggaactcatcgcgaaggtggccgataaaaagattcgggaggctctgatgcaaagactcagcgaatacggcgggaatatcaaaaaggccttccagaacatttccaagcaccctatctggctgaactctagccacaccaaacatgtgcccgagaaggttaaaatcgtctttttcgaggacgtgtttaccattcgcaaggccatcacacctgatattaaaatcgacaaggtgattaattccaagatccggaacattcttcaggaaagactgaatgagttcggaggcgaagctgccaaagcgttctctaacctcgatcagaatcccatctggtttaacaaggacaaagggatcgctattaagagcgtcaaaatccggggaattgccaatggcaccgccatccgcgtgaagaaggatattcacgggaacacaatcatcggcaataacggatatcctattcccaatgactacgttaacacgggcaataaccatcacgtggctatcttcagagatcgggacgggaatctgcaagagcacattgtctccttttatgaagccaccgcgcgcgctatccagaacctgccgattgtggatagaaattacaacagcgagaaagactgggagttcctgttttctatgaagcagaacgaatacttcgtttttcctaatcccaacacaggattcaatccccttgagatcgacctccggaacgaagagaattatgccctgatctcccctaacctctttagagtgcagaaactgagccattactattacgtcttccgccaccatcttgagaccaatgtggatacaaacctgcaactgaaggacattacctggaaacggatcaaggccattaataacctcacgggcgttgtgaaagtcagaatcgatcacctggggcgcattgtggacgtgggagaatataagtga

SEQ ID NO: 4408 - RNA, 4176 nt, synthetic construct
  misc_feature 1..4176: note = Cas9 variant
  source 1..4176: mol_type = other RNA
atgaagaaaagaatcgacgattacattctgggcctcgacatcgggaccaacagctgcggatgggccgtgacagataagaaaaataacctgcttaagctgcggggcaaaacggctattgggtcccacctcttcgaggaaggacataccgccgcggaccgcagaggctttcggacaacccgcagacggctgaagcgcagaaagtggcggcttcgcctgctcgaggaaatcttcgctgagcccatggccgaagtcgatcctgggtttttcgttagactgcaccagtcttgggtgagcccgctggacaaatcccggaagaaatatcaagccattgtgtttcccacagctaaggaggatcaggagtactatcagaaataccctaccatctatcatctccgcgacgccctgatgacacaggatagacaattcgaccttcgggaaatctttctggctattcaccatatcgtcaagtaccgcggaaatttcctccaggataccgccgtgaaggactttgaggcgtctaaaattgaagttggccccatcctgacgaacattaataacgccttcgctgataagatcgtggagggccaggaccttattgagctgaatgtcgccaacgctgccgaaatcgaggcggtgatcagagggaaagacgccgataagaccctctataaaatggacaaggttaaaaagattgctaagctgctgacagatagcaccgccaaagaacagaagaatgtggctaaacaaatcgccaacgccattatgggatacaagacacagctcgagaccatcctgggcaaagaaattgacaagaatgataaggctcagtgggagtttaaactttccgacgcggatgacaagctggatgccctcctgcctgaccttgatgagtctgaccagacggtcgtggctgaaatcgagaaactgttcagcgccatcacactctccaccattgtggacgaaaacaagagcctgtctcaatccatggtcgagaaatacaataagcaccaccaggattataagctgctcaaagcctacatcgaaagcctgcccgaccgggctcaggccaagaaacttctgctcgcgtatgatctgtacgttaacaatagacatgggcaccttctggaggctaagacagagtttaaacaagactctaccctcaccaaggaagatttctataagacagtgaaagacaacctggatgactccgagctggcccataagattgcccaggaaatcgctgccgataacttcatgcctaaacagcgcacgaatagcaacggagtgattccgtttcagctccaccaaatcgagctggacaagatcattgctaatcagtctaaatactatcccttccttgccgcggaaaaccctgtcgaggatcaccggaagcaggccccctacaaactggacgagctcgtgagatttcgcgttccttactatgtgggccccatgatcaccgctgatgaacaggagaagacatccggaaagagcttcgcctggatggtccggaaagaacaagggcagattaccccgtggaattttgagcagaaggtggacagacaggagtccgctaacaaattcatcaagcgcatgacaattaaagacacctacctgctgggcgaagatgttcttcctgccaattctctcctgtatcaacggtttgaggtgctgaacgaactcaataacatcagagtcaatggcagccgcatttccgtggacctgaagcagcagatcttcaacgatctttttgaggaaaagaaaacggtcacagagaaggcgctgatcagctacctcaaacagaatctgcatctgcccaccgtggagattaaggggcttgccgaccctaccaaattcaactcttccctcgctagctattaccacctgaagaatctgcatgtttttgataaggaactcgccgacccccaatatcagaaagagttcgaaaagatcattgagtactctagcatctttgaagataaaaagattttccaggacaaactgcacgctgagttcaagtggcttacacccgcccaatttaaggccatctccacctggcggctgcagggatggggcagactctctcgcaaactgctggtggagcttcatgatacaaacgggcagaacatcattgaacagctctgggacagccaaaagaatttcatgcagatcgtcacggagcctgattttaaagaagctattgcgaaggagaaccagaatatcacccaggaaaacggagtggaggagattctggccgacgcttacacatccccggccaataaaaaggccatccggcaagttgtgaaagtcgtggctgatgtggttaaggccgcgagcggcaaggctcccgcccagttcgccatcgaatttaccagagaccctgacaaaaacccccagctgtctcacattcgggggacaaagctcctgaaggcttatcaggagaccgccggagaacttgtcgatcaaaatctgacgaactccctcaaggaggcgatgaccagccgcaaactgctgaaggacaagtacttcctttattttatgcagacaggcagagatgcttacaccggcaaaaagatcaatattgacgaggtgtctacaaactatcagatcgatcacattctccctcaatccttcatcaaagacgatagctttgacaatcgggtgctgaccgccacgcccctgaacgccgaaaagtccgatgacgtcccgtacaaaagattcgctaataactatgtgtctgatctcaagatgacagttggggagatgtggaagcattggcagaaagccggaatcattaataagcacaaactgggcaaccttctgctcgaccctgaccgcctgagcaagtttcagaaatccgggttcatcaaccggcagctggtggaaacctctcaaattgtcaaacttgtgagcgttatcctgcagaataagtaccccgatgctgagattatcacagtgaaagccggagacaactccgcgctcagacagcgcctggatctctacaagagcagagacgtcaatgattatcatcacgccattgacgcttacctgtctatcgtgtgtggcaactttctttatcaggtttaccctaaatatcggccctacttcgtgtatgggcaattcaagaaattttcccaggatcctgacctgcagaaggatctcatcaagcacttcaaaggctttaccttcatgtggcccctgctgcagaaggacaatagcgaacgcaaagcccttgaggagattaaggaaaacaattctgatagaatcgtcttttacaaacatccggacattttcgataagctgcggaaggcttacaactataaatacatgctcgtgtcccgcgagaccagcacagaatctagctccatgtttaatatgacgatctatcctagaggagagcgggaccgcaagaaaaccagaaagctgattcccaaaggcaacgggctcgaccccaagatctacggaggctatagcgggaatacagatgcctacatggtgatcgtcaaaattgaaaaggccaaggagtctatctataaagttattggaatccctatgcgggctctggcgggccttaagcaagccaaaaaccaggggaattacaaggaggaactgcacaaagtggtggagccgcagattatgctcgacaagaacggcaagcccaaacgcggagtcgaaggcttcagagtggttaaggatcatgtgccttttaaacaggtcgtgctggacggggataagaaattcatgctgtactccgctaagtatgagaccaatgccaagcaacttacactgagccaggaaaccatgcggatcgttacggacaacctcaaaaagtccgaggatcaggacaaactgctcgtgaaggcctacgatgagatcctgcaaaaagtcgaccagtatcttcccctgtttgatgtgaacaagttcagaaattctctgcacctcggacgcgctaaattcctggaccttgccgttaacgataagaagattacactgagcaatatcctcaacggcctgcatgacaatctcgtggtccctaacctgaaaaatattgggatcaagaccccctttggacttatgcagtccccttctggcattaccctgagctccaacgcgatcctgattttccagtctcccacagggctctttgaaaaacgggtgagaatcgctgacctgtga

SEQ ID NO: 4409 - RNA, 4176 nt, synthetic construct
  misc_feature 1..4176: note = Cas9 variant
  source 1..4176: mol_type = other RNA
atggagaacaagcagtactatatcggcctggacgtggggaccaatagcgtcggatgggccgttacagatacgtcctacaacctcctgagagctaaaggcaaggacatgtggggagcccggcttttcgatgaagcgaaaaccgctgtggagcgcagaacaaagcggacctctcgcagacggagcgaacgcgagaaagccagaaaggccatgctgaaggaactctttgctgacgagattaataaagtggatcccaacttctttatccggctggaggaatccaagttctttcttgacgatcgctctgagaataacagacaacggtatacactgttcaatgacgccaaatttaccgataaggactactatgaaaaatacaagacaattttccacctccgcagcgctctgatcaactccgatgagaagtttgacgtcagactggtgttcctcgccattctgaatcttttctctcatcgggggcacttcctgaacgcgagcctcaaaggcgatggggagatccagggagttgacatcttttataatgacctgtacgaagtgtgcgaggaatttgagattgatcttcctcagatctccaacattgacaatttcgaaaagatcctgagccagaaaggcaagtctcgcaccaaaattctcgaggagctgtccgaagaactgagcatctctaagaaagaaaagattaagtactccctcctgaaacttatctgtggcatgaagatcaaagtcgtggatatttatgccgacgaggatatccaagaagacgataagaaaaaggacctggggtttagagagagcgattacgagaagtcttccctcgaagttaaagagattatcggagacgatcatttcgaactgattgagcgggctaaggccgtgcacgacatcggccttctggctaacatcattgggaatagcaaatatctctgcgaagccagagtcgaggcgtacgacaaccatcacaaggatctgcagaaaatcaaggagctgctcaagaaatatgacattaaggcctacacggatatgtttcgcaaaatgaccgacaagaactattccgcttacgtgggatctgtgaatagcaacatcgccaaagaacggagatccgtcgataatcgcaagattgaggacctgtacgaatatatcaagaaaatcgctcttaagaacattagcgatgacaatgaggataaaatcgagattctgaagaaaatcgaaacaggcgagttcctcaagaaacagctgaccgcctctaacggggttattccgaatcagcttcaatcccgggaactgagagccatcctcaagaaggctgagaactacctgccctttctgaaagaaaagggagagaaaaatctcacagtgagcgagatgattatccagctgttcgaatttcagatcccttattacgtgggcccccttgacaagaaccctaaaaaggataagaatgcgaactcttgggccgtcattcccagcggcgggcgcatcctgccttggaatttcgaggacaaagtggatgttaagggatcccggaaagaatttattgagaagatggtgagaaaatgtacctatctctctgaggagcacacgctgccgaagcagagcctgctttacgagaagttcatggtcctcaacgaaatcaataacattaaaatcgacggcgagaagatctccgtggaagctaaacaaaagatttataacgacctgtttatgaaagggaagaaggttagccagaaagccatcaagcaggagctgatttctctcaatatcatgtccaaagatagcgtgctgtctggaattgacacagtctgcaacgcctacctttccagcatcgctaagttccgcggcgtgtttgatgaaaatgtcaacaatcaatccaccatcgacatgattgaggatatcattttcctgaaaacagtgtactctgacgagaagcggttcgttaaagaagagatcgtggaaaagtatggggatgagattgacaaggataaaatcaagagaatcctcggatttaaattcagcaactggggcaatatttccaagtcttttctggagctggaaggcgccgacgtcgggaccggagagatccgcagcattatccagtccctttgggaaaccaacttcaatctcatggagctgctgagctctcggtttacatacatggatgaactcgagaaaagagtgaagaagctggagaaacccctttccgaatggacgattgaggacctggatgacatgtatctcagctctcctgttaagcggatgatctggcagtccatgaaaattgtggacgaaatccagaccgtcatcggctacgcgcccaagcgcattttcgtggagatgacaagaagcgaaggggagaaagtgcggaccaagtctagaaaggatcgcctgaaagagctgtatagcgctatcaaggaagactccaaacaatgggttaaggagcttgatgccaaagacgaaagctactttcggtctaagaagatgtatctctactacctgcagaaaggaagatgtatgtattccggcgaggtcattgaactggataagctcatggacgataacctgtacgacatcgatcatatttatcctcgcagcttcgtgaaagacgattcccttgacaatctggtgctcgtcaagaaagagatcaacaatagaaagcagaacgaccccatcacaccgcagattcaagcctcttgccaggggttttggaaggtgctgcacgagcagggcttcatcagcaatgaaaaatactcccggctgacccgcaagacgcaggagttttctgatgaagagaaacttagcttcattaacagacaaatcgttgagacaggacaggctaccaagtgtatggcccagattctccagaaatccatgggcgaagacgtggatgtcgtgttttctaaggctcggctggttagcgagttccgccataaattcgaactgtttaagtccagactcatcaacgacttccaccacgccaatgatgcgtatctgaacatcgtggtcgggaatagctactttgtgaagttcacccggaaccctgccaattttattaaagacgctcgcaagaaccccgataatcctgcctataaataccatatggacagattctttgagcgggatgttaagtctaaatccgaagtggcttggatcggacaaagcgagggcaacgccgggacaattgcgatcgtcaagaagaccatgtctaaaaatagcccccttattacaaagaaagtggaggaaggacacggctccatcacgaaggagaccattgtgggggtcaaagaaatcaagttcggccgcaacaaggttgagaaagccgacaagacacccaaaaaggctaatctgcaggcctacagacctatcaaaacctctgatgaacggctctgcaacattctgagatatggaggccgcacatccatcagcatttccgggtactgtctggtggagtatgtgaagaagcggaaaaccatcagaagccttgaggctattccggtctacctgggacgcaaggactctctcagcgaagagaaactgctcaattattttcggtacaacctgaatgatggcgggaaggactccgtgtctgacatcagactttgcctgcccttcatcagcacgaactccctcgttaaaattgatggatatctgtactacctgggcgggaagaacgacgatcgcatccagctttataatgcctaccaactgaaaatgaagaaggaagaggtggaatatattcggaaaatcgagaaggccgtctctatgagcaaatttgacgagattgatagagaaaagaaccctgtgctcaccgaggagaaaaatatcgaactgtacaacaagatccaggacaagttcgagaatacagttttctccaaacgcatgtctctcgtgaagtataacaaaaaggatctgagctttggcgacttccttaaaaataagaagtccaaatttgaagagattgatctggaaaagcagtgtaaagtcctctacaacatcattttcaatctgagcaacctgaaggaggtggacctttctgatatcggaggctccaaaagcaccgggaagtgccggtgcaagaaaaatattacaaactataaggaatttaaactgatccagcaatctattaccggactctactcctgtgagaaggacctgatgacgatctga

SEQ ID NO: 4410 - RNA, 4176 nt, synthetic construct
  misc_feature 1..4176: note = Cas9 variant
  source 1..4176: mol_type = other RNA
atgaagagaaacaatgactactatatcggcctggatatggggaccaacagcgtgggatgggccacaacgaatccccagggccggctcctgcgcttcaacaaaaaggacatgtgggggtccagactttttgaggaagctaaaaccgccgcgaagacacggaccttccgcacatctagacggcgctacgatagagtccggcaacgcattgagtttctgcaggacatcttcgctcctattatcgccaaaaaggattttgagttctttatgagactcaaggagagcaaattccacctggaagacaagaaaaccgatggaaagtttgcccttttcaatgacgctgattttacagacgttgagtatttcgatcggtacccgaccatttatcatctgcgcgccgctctcatcaaacccaaccacatcacggaccctagactgctgtacctcgccattcatcacatcattaagaatcggggccattttctgttcgcggggaccgatatggagtccatccgctctttccagattgtgtatacacagcttagcgaacacctgaagtccatcaacctcgactttgagctgcccgtggacgcccaagataaattcgctgccattcttctgaatgaaaagctcaacaaaagagacaagaaaaagcagctgaaagagctgtgccctcacaaggataagcggctcgagtacgcttttaatgccatcatcggaggcaaaaccaagctgaaagacattttcggcgtcgaagagtacgatgaagggacaaagaaagcggtggactttgagaaggccgattatgacgaagataaggacgagatcgagtctgttattaaagaaaacatccatgtgcttaatgctctgaaggccgtctacgattggaccattctcacgaacatcctgggagactatgcttacatcagcgagtcccaggtggccctttatgaagcccacaaaaaggacctgcgcattctcaaaagcctgatcaagaagtacgctaaatctcagtatgcggatgccttcagacatgagaatgttaagggcaactacgctaactacgtggggtccacaaattatgacaacaaacaacccgtcattgataatcctagcgtgacccaggaagacatcaacaagtactttgccgatattctgctctctatcacaccggacgagtccgatcgggagagctatcagtacatcaccgaaagactgcacaaaggagaggcccttcccaagctgcgcaccaaggctaattctgtgctccctcaccagattcataaaatcgaactggagaagattcttgccaacgcggctaaaaatttcccctttctgcaagaaaaggactccagcggctatacagccgcccagaaaatcgtcaagattatgatgttccggatcgagtactatgttgggcctctcaacacgtaccaccatgtggatcagggaggccacgcttggatggtgagaaaagccgagggcaagattaccccctggaattttgacgaaaaggtcgataaagaggcttccgccgaaaagttcatccgcaacatgacaaataaatgtacctacctgatcgggaaggacgtgattccgaaacaatctctgctctatagccggtacaaggttctgaacgagcttaataacctgaaggtgaatggagcgcctatctccgtcgccctcaaacagaagatttatgaggaactgtttaaaaagcaagtgaacgttacattcaaccagctgaaaaccttccttaagacgcagggcgaggatgctgacgaaatcattctcagcggggtggacgaggccgctcataagtttacaaataacctgcagacctaccacaaattcagagccatcctgcgcgataagatcgaatttgagccccagcggtctatggtcgaggacattatcagatggaaatgcctcatgggagatgacattaccatgtggaagcacaaaatcgaaaaggagtatggcgatcagctgtccgaagaacaacttaagaaaattacacgcctgaatttcaacgggtggagccggctctctcaggaatttctgaccgacgtgcctggagtcgatatcgagagcggcgaggtgtactccggcatcatggacgcgctgtggagaacaaatgaaaacattatgcagcttctctctagccggttcacgtttgccgctgaggttaagaaacagaatcaagggaccggacgcatcgaaaagattacatatgatgaggtgatgaaagacacctacctgtcccccgccgtcaagagaagcgtgtggcaggctatcacactggttgaagagattcggaaaatcagaaaggccgatcccaagcgcatcttcgtggagatgacccggcagcctgacgccaaaaaggaaagaaaactctctcgcagaacgcagctgcttaacgcttaccgggcgattggcaatgatatcgccgagtatgaaaaggagcatgtctccaccctgattacacaactcgagagcaaaaaggacgaagacctgcgcagaaagaaactgtacctttattttacccagatggggcggtgtatgtacacaggagagcgcatcgatctctcttccctgctgagagacaccaacagcaatatttatgatatcgaccacatttacccgcggtccctcacgaaggatgactctctggataacacagtgctttgcaaaaaggaaatcaatctgaaaaagggcaacaagtatatccatcgcgtgttcaccgacaaagagctcaagaaacagtacgggtactggaaggctctgaaagaaaagaagctgattagcgagagaaaattttcccggcttatgcgcacaaccgatctcaccgccgacgagctggccggcttcatctctagacaactggttgaaacaagccagatggtcaaggctacggccgatattctcgagaaaatctatcccaatgtgaccattgtgtacgtcaaggcgcggacagtgtccgactttagacacgactatgaactgcctaaagttcgcgctcttaacgattgtcaccatgcccacgacgcctacctgaacatcgtggtcggaaatgtgtattacgagaagttcaccaagagccccttccggtttatcgctaaccagaaaggcaagggggatattaaatataatctctacagactgttcgacaaggatgttaaagtgggagaccgcatcatttggaacgccaaggaagatctggcgcgggtcaaagctacacttgagagagacaccgtgaatgttgtgcgcatgcctgtcgagcagcggggccaatttttcgatgccacgatccagaagaaggggacaaccaaaaacatgctggtgctccccctgaagggatctgacgaaagactccaggatacctccaaatacggctattacgtgcgcccgagcgggatgtcttttatggtcgttcagcatgaggtgaagggcaaatcccgggtgacaattgaacctgccctgcttgtctataagaataagctgaaaagcgaggacgattacgctaagtattgcgaagacgtgctcaaactgcaaaagcccaaagttctgttcaagaacatcaagtttggatctaaaatccttttcgacggctacccttttctgctcaaggggagaaccgagaatcggattatcatggccgatgctcagagcctgttcctcggaaaccaggagctgaaaattcttaagcgcgtgacaaaaatctccgacgatattgaccacaaggtcgaaagcagaatcaagattacggatgaggaatggaccacactgtggaaatctgtggttgagcagatcgtgaccggcaagtttcggaatcgcctcgggacactgaacggaatcctgcaaggcagaaaaattaaactttccaaggacgaggaagcccggctgaatgagctcgatagcaaggaccaggaaaccttcctgtcccagatcctcctggagagattccttcaattttctacggaagagaaaacccgcctgctgctccaggtcattagcttctccgggaacacaaccggcgtggatctgcggcttatcggaggctctagcgggacaggaaccattaagacaaataagaacatcaccgaccattccgttatcctgattaacgagtctcccacgggcctctttacaaatagaaccgtgctgaaccagccttga

SEQ ID NO: 4411 - RNA, 4176 nt, synthetic construct
  misc_feature 1..4176: note = Cas9 variant
  source 1..4176: mol_type = other RNA
atgaagagaaacaatgactactatatcggcctggatatggggaccaacagcgtgggatgggccacaacgaatccccagggccggctcctgcgcttcaacaaaaaggacatgtgggggtccagactttttgaggaagctaaaaccgccgcgaagacacggaccttccgcacatctagacggcgctacgatagagtccggcaacgcattgagtttctgcaggacatcttcgctcctattatcgccaaaaaggattttgagttctttatgagactcaaggagagcaaattccacctggaagacaagaaaaccgatggaaagtttgcccttttcaatgacgctgattttacagacgttgagtatttcgatcggtacccgaccatttatcatctgcgcgccgctctcatcaaacccaaccacatcacggaccctagactgctgtacctcgccattcatcacatcattaagaatcggggccattttctgttcgcggggaccgatatggagtccatccgctctttccagattgtgtatacacagcttagcgaacacctgaagtccatcaacctcgactttgagctgcccgtggacgcccaagataaattcgctgccattcttctgaatgaaaagctcaacaaaagagacaagaaaaagcagctgaaagagctgtgccctcacaaggataagcggctcgagtacgcttttaatgccatcatcggaggcaaaaccaagctgaaagacattttcggcgtcgaagagtacgatgaagggacaaagaaagcggtggactttgagaaggccgattatgacgaagataaggacgagatcgagtctgttattaaagaaaacatccatgtgcttaatgctctgaaggccgtctacgattggaccattctcacgaacatcctgggagactatgcttacatcagcgagtcccaggtggccctttatgaagcccacaaaaaggacctgcgcattctcaaaagcctgatcaagaagtacgctaaatctcagtatgcggatgccttcagacatgagaatgttaagggcaactacgctaactacgtggggtccacaaattatgacaacaaacaacccgtcattgataatcctagcgtgacccaggaagacatcaacaagtactttgccgatattctgctctctatcacaccggacgagtccgatcgggagagctatcagtacatcaccgaaagactgcacaaaggagaggcccttcccaagctgcgcaccaaggctaattctgtgctccctcaccagattcataaaatcgaactggagaagattcttgccaacgcggctaaaaatttcccctttctgcaagaaaaggactccagcggctatacagccgcccagaaaatcgtcaagattatgatgttccggatcgagtactatgttgggcctctcaacacgtaccaccatgtggatcagggaggccacgcttggatggtgagaaaagccgagggcaagattaccccctggaattttgacgaaaaggtcgataaagaggcttccgccgaaaagttcatccgcaacatgacaaataaatgtacctacctgatcgggaaggacgtgattccgaaacaatctctgctctatagccggtacaaggttctgaacgagcttaataacctgaaggtgaatggagtccctatctccgtggcgctcaaacagaagatttatgaggaactgtttaaaaagcaggttaacgtgacattcaaccagctgaaaaccttccttaagacgcaaggcgaggatgccgacgaaatcattctcagcggggtcgacgaggctgcccataagtttacaaataacctgcagacctaccacaaattcagagctatcctgcgcgataagatcgaatttgagccccagcggtctatggtggaggacattatcagatggaaatgcctcatgggagatgacattaccatgtggaagcacaaaatcgaaaaggagtatggcgatcagctgtccgaagaacaacttaagaaaattacacgcctgaatttcaacgggtggagccggctctctcaggaatttctgaccgacgtccctggagtggatatcgagagcggcgaggtttactccggcatcatggacgccctgtggagaacaaatgaaaacattatgcagcttctctctagccggttcacgtttgcggccgaggtgaagaaacagaatcaagggaccggacgcatcgaaaagattacatatgatgaggtcatgaaagacacctacctgtcccccgctgtgaagagaagcgtttggcaggccatcacactggtggaagagattcggaaaatcagaaaggctgatcccaagcgcatcttcgtcgagatgacccggcagcctgacgccaaaaaggaaagaaaactctctcgcagaacgcagctgcttaacgcctaccgggctattggcaatgatatcgcggagtatgaaaaggagcatgtgtccaccctgattacacaactcgagagcaaaaaggacgaagacctgcgcagaaagaaactgtacctttattttacccagatggggcggtgtatgtacacaggagagcgcatcgatctctcttccctgctgagagacaccaacagcaatatttatgatatcgaccacatttacccgcggtccctcacgaaggatgactctctggataacacagtgctttgcaaaaaggaaatcaatctgaaaaagggcaacaagtatatccatcgcgttttcaccgacaaagagctcaagaaacagtacgggtactggaaggccctgaaagaaaagaagctgattagcgagagaaaattttcccggcttatgcgcacaaccgatctcaccgctgacgagctggccggcttcatctctagacaactggtcgaaacaagccagatggtgaaggccacggctgatattctcgagaaaatctatcccaatgtgaccattgtctacgtgaaggcccggacagtttccgactttagacacgactatgaactgcctaaagtgcgcgcgcttaacgattgtcaccatgctcacgacgcctacctgaacatcgtcgtgggaaatgtttattacgagaagttcaccaagagccccttccggtttatcgccaaccagaaaggcaagggggatattaaatataatctctacagactgttcgacaaggatgtgaaagtcggagaccgcatcatttggaacgctaaggaagatctggcccgggtgaaagcgacacttgagagagacaccgttaatgtggtccgcatgcctgtggagcagcggggccaatttttcgatgctacgatccagaagaaggggacaaccaaaaacatgctggtgctccccctgaagggatctgacgaaagactccaggatacctccaaatacggctattacgtccgcccgagcgggatgtcttttatggttgtgcagcatgaggtgaagggcaaatcccgggtcacaattgaacctgccctgcttgtgtataagaataagctgaaaagcgaggacgattacgccaagtattgcgaagacgttctcaaactgcaaaagcccaaagtgctgttcaagaacatcaagtttggatctaaaatccttttcgacggctacccttttctgctcaaggggagaaccgagaatcggattatcatggctgatgcccagagcctgttcctcggaaaccaggagctgaaaattcttaagcgcgtcacaaaaatctccgacgatattgaccacaaggtggaaagcagaatcaagattacggatgaggaatggaccacactgtggaaatctgttgtggagcagatcgtcaccggcaagtttcggaatcgcctcgggacactgaacggaatcctgcaaggcagaaaaattaaactttccaaggacgaggaagctcggctgaatgagctcgatagcaaggaccaggaaaccttcctgtcccagatcctcctggagagattccttcaattttctacggaagagaaaacccgcctgctgctccaggtgattagcttctccgggaacacaaccggcgttgatctgcggcttatcggaggctctagcgggacaggaaccattaagacaaataagaacatcaccgaccattccgtgatcctgattaacgagtctcccacgggcctctttacaaatagaaccgtcctgaaccagccttga

SEQ ID NO: 4412 - RNA, 4179 nt, synthetic construct
  misc_feature 1..4179: note = Cas9 variant
  source 1..4179: mol_type = other RNA
atgaaaagcatcctgggcctcgacctggggaccacatccattggatgggcccttgtgaaagagtctgaaaacgataatgaaaagagcgaaatcgtcaaactgggcgttagactcgtgcccctgacgaccgacgagcggacagatttcgaaaaggggaaatccattaccacaaacgctgaccgcacctctaagagaagcatgcggcgcaatcttcagagatacaagctgcggcgcgaggccctcgtgtccgagctgaaaaaggaacactggatcgatgagggatatagattttctgaagacggccctgggagcacattctccaccctgcggctccgcgcgaaagctgccgaggaggaaattagcctgcaagatcttgccaaggtcctgctccagatcaacaaaaagagaggatacaagtcttcccggaaactgaatagcgctgaggacggccaggccatcgatggcatgtctgtggctaaggttctttatgaccgcgggctgacgccgggagaatacgtgtatcagagaatgctcgatggccaatacgccattcccgagttttataaatccgacctgcaggcggaatttgataagatctggaacctgcagaaaagctactaccctgagctcaccgccgagctgtatgacaaacttacagacaaaaataagtctcagacctgggctatttgccgggatgaactgggggtccaaggatttaagtccagcttcacaggcaaagagcgcctcaaggaagcctactttaacagacagcaggcttccaaacagaaggtggacctggaggttcttacctgtgtgctgcaagatatcaatgggcagaaagcctctctcagcggactgctgtccgcgattagcgaccggtctaaggaactctatttcaacagaatgacggtcggccagatgctggtgcgccaaatccaggaggatcccaatcggtcccttagaaacacagtgttttaccgccaggactatattgatgagttcgaaaagatctggagcgtccagtctcggtttcatcctgagctgacccaagaaagaaagaagaaactcaaggacatcattatcttctaccagcgccccctgaaaagccagaagggccttatttccctgtgcgagtttgaatctcgggaggttgatatcagcgtggacggggtgattaagaaaaagaaaatcggacctagagtctgtccgcgctccagccccctcttccaggagttcaaggtgtatcaaacagttaataacatcctggtgaatggcgaacctctggatgacaacgaccgggagaaactcgtcggggaactggcctttagagagaagatgaagggacaggatgtgcttaaactgctctacaagacctctaaaggcatgcgcattaacttcgaggaagttgaggggaatcggaccatggctacaatcctgaaggcctgcgagaaaattgtggagggactgggctacgacacgagagatctttccaagatcaccgctagcgaaaaagtctctcggattgaggagatctttgccaaggaaggcttcaagtccgactttctccacttcgatagctccctgccctctcctgagtttgaaagccaggcctcctattctctgtggcatctcctgtacagctatgagaacgacaaatccgtgagcgggaatgaatctcttgtcgagaagatcaaaaagctgtgttccatggatgaggctagcgcgaaaattctctctggatgcacattcctgtccgactacggcagcctgtctgcccgcgctatgagaaagatccttccctatatgaaggatgggctcgaatacagcgccgcctgtgctatggccggatatcggcactccaaaagaagcctgaccaaggaggaactggactctcgcgtgtacgttgatcggctcgagctgcttccgaaaaactccctgagaaatcctgtggtcgaaaagattctcaaccagatgatcaatgtggttaacagcgtggtcgacacatacggcaaacccgatgagattcgcatcgagatggcgagagaactgaagaagtccgcttctgagcgggaaaaagcccaaaaggacattgccgctgccagcaaagtgaatgagtccatcgtggctaccctgaaggggtctcctttcttcatcgacagcccctcccgcaacgatattatcagatatcggctttgggaggaactcaaacccaatggctacaagacgctgtattctggaacatacattcctaaggagcgcctgtttagcaaagacttcgatatcgaacatattatcccgcaggccctcctgtttgacgattccttcgcgaacaagaccatcgagagcagacagtgcaatattgaaaaatctaaccggaccgccatggactatgttaagtccaaatacgatagcttcggcgtccaggcttatatcgaccgcgtgaaggggcttacaggagtgtctaaaaccaagattacaagactgctcatggagtccaaggatatccccgaggactttattaatcgggaactgcgcgatagccaatacatcgccagaaaagctcgggagatcctggaatctatggtcaagttcgtggttcctacgaccggctccgtgacagccagacttcgcgaggactggcagctcgtcaacgtgatgcgggaactgaactgggataaatacgagaagctggggctcaccagctttagagaggaccgcgacggacgggaaattcccgttatcgaggattggacaaaaagaaatgaccaccgccaccatgcgatggatgccctgaccattgctttcacgcggagacagtttatccaatatcttaaccacctgaatgccaagattgacaccgtggataagacagacatcgatctccgcgactacaacctggaagatatctccttcgacggcctgcgggatggggacaaatttggcattgtcaaggcccttcagaaaaagtatctgtacaaagacgataagcagaagtatagattcgtgcctcccatgccgctcgacgagtttcggatcgaagctaaacgccagattgaggatgttctggtgagcttcaaggccaaaaataaggtctgtaccaaaaacgtgaatacaaccaaggtgagaggaggccaacagcggaagatccagctcacgcctcgcgggcccctgcatgaggacacaatttacggaaaaagacttcagtatgtcaccaaggaagagaaagttggcgggtcttttgatgaagctaagatcgcgagcgtgtgcaaaaagtcctaccgggaggccctgatgagacgcctcatggagtgtggaggcgaccctaagaaggctttcacagggaagaactctctggagaaaaatcccgtgtgggtcgatgaatttcacagcggcgaagtgcctctgcgggttagaaccgtgtccatggcctctgtctacaccgtgcgcaagagcgttggacaatcccttaacattgagaaagtgctggacaagcacatcaaagaaatcctccgggccagactggaggagtatggcgggaatgcttctaaggccttcagcaacctcgatgaaaatcccatttggctgaacaaggagaaaggaatcgcggtcaagcgcgtgacaattgactccggcaaaaatccgatccctcttcggagcaagctggataaagacgggcagattatctacggagaaggccagaacccccaggagtctgatttcgttgtgcccgggggcaaccatcacgctgccatctatagaacgccttccggaaagctccaagacgtcgtggtgagcttttacgaagccgtctctcgcaagaatctgggcctggaggttattgacagaaacttcaaaaaggatgaggggtgggaatttcttttcaccctgaaacagaatgagtattttgtgttcccgaaccccgctacaggattttcccctgaagactacgatctcaccgaccccgccaataacgcgatcattagccctaatctgtatcgggtgcagacagtctccgtgggcgattaccgcttcagacatcacctcgagaccacggttgaagacaacgagaagctgcgggatatcgcttggaaacgcattgggccctctggacttgtgggcgccgtcaaggtgagaatcgacaatctgggccggatcctggccgttggggagtacgattga

SEQ ID NO: 4413 - RNA, 4179 nt, synthetic construct
  misc_feature 1..4179: note = Cas9 variant
  source 1..4179: mol_type = other RNA
atggagaacaagaattacagcatcggcctggacattgggaccaactccgtgggatgggccgtcatcacagatgactataaagttccctctaagaaaatgaaggtgttcggcaatacggataaacactttattaagaagaacctcatcggggctctgcttttcgacgaaggagccaccgcggaggatagacggctgaaacgcacagctagacggcgctacaccagacggaagaatcgcctcagatatctgcaggaaatttttagcgaggaaatctccaaacttgactctagcttctttcatcggctggatgactccttcctcgtgcctaaggataaacgcggctctaagtacccgatctttgccacactggaggaggaaaaggagtatcacaaaaagttccccaccatttaccatctgagaaaacacctcgccgacagcaaggagaaaacagatctgcggcttatctatctggctctcgcccatatgattaagtaccgcgggcactttctgtacgaagagtccttcgacatcaaaaacaatgatattcaaaagatctttaacgagttcattagcatctatgacaatacctttgaaggatcttcccttagcggccagaacgctcaggtcgaagccatcttcacggacaagatttctaaatccgcgaagagagagcgggtgctgaaactcttcagcgatgaaaagtctacctccctgtttagcgagttcctgaaactcatcgttggcaatcaggccgactttaagaagcacttcgatctggaggaaaaagctcctcttcaattttccaaggacacatacgatgaggacctggaaaacctcctggggcagattggagatggcttcaccgacctttttctggtggccaaaaagctctatgatgctatcctgctgtctgggattctcacagtcaccgaccccagcacgaaagcccctctgtccgcgagcatgatcgagcgctacgaatctcatcagaaggatcttgccgctctgaagcagttcatcaaaaataacctccccaagagatataatgaggtgttttccgaccaaagcaaagacggatacgccggctatattgatgggaagacaacccaggaggctttctacaaatacatcaagaacctgctttctaagtttgaaggagccgactatttcctggataaaattgagcgggaagactttctcagaaagcagcgcacattcgataacggcagcatccctcaccagattcatctgcaagagatgaatgccatcctgcggagacagggcgaacactacccgttcctcaaagagaaccgcgagaagatcgagaaaattctgacctttcggatcccctattacgttgggcctcttgctagaggaaatcgcgacttcgcgtggctgacccggaactccgatcaggccattagaccctggaattttgaagaaatcgtggacaaggcttctagcgccgaggagttcattaacaaaatgacaaattatgatctctacctgcctgaagagaaggtcctgcccaagcactcccttctctatgaaacgtttgccgtgtacaacgagctgaccaaagtgaagttcatcgctgaaggcctgcgcgactaccaatttctcgatagcgggcagaaaaagcagattgtcaatcagctgttcaaagagaagcggaaggttacagagaaagacatcatccattatcttcacaacgtggatggatacgacggcattgaactgaaggggatcgagaaacaatttaatgcctctctctccacctatcatgacctgctgaagattatcaaagataaggagttcatggacgatccgaagaacgaagaaattcttgagaatatcgtgcacacactcaccatctttgaggacagagaaatgattaaacagcgcctggcgcagtacgatagcatcttcgacgagaaggtcattaaagctctgacgcggagacattatacaggatggggcaagctctctgccaaactgatcaacggcatttgcgataagcagaccggggacaccatccttgattacctgatcgacgatggaaagattaatcggaactttatgcaactcatcaacgacgatggcctgtccttcaaagaaattatccagaaggcccaggtggttgggaaaacagacgacgtgaagcaggtcgtgcaagagctgcctggaagccccgctattaaaaagggcatccttcagtccatcaaaattgttgatgaactcgtgaaggtcatggggtatgcccctgagtctatcgtgattgagatggctcgcgaaaatcagaccacagccagaggcaagaaaaacagccagcaacggtacaagagaatcgaggactccctgaaaaatctggcgcccggactcgattctaacattctgaaggaaaatcccacggacaacatccagcttcagaatgatcgcctgttcctctactatctgcaaaacggcaaagacatgtacaccgggaagcctctggatattgaccagcttagctcctatgatatcgaccacatcattccgcaggcctttatcaaggatgacagcattgacaatcgggtcctcacatcttccaaagataacagaggaaagagcgacaatgtgccctctctggaggttgtgcagaaacgcaaggctttctggcaacagctgctcgattccaaactgatcagcgagagaaagtttaacaatcttaccaaggccgaacggggcgggctggacgagcgcgataaagtcggattcattagacggcagctcgtggaaacacgccagatcaccaagcacgttgctcaaatcctggacgcctcttttaacacggaggtgaatgagaaaaaccagaagattagaaccgtcaaaatcattacacttaagagcaacctggtgtccaatttccggaaggaatttgagctgtacaaagtgcgcgaaatcaacgattatcatcacgcgcatgacgcctacctcaatgctgttgtcgccaaggctattctgaaaaagtatcctaaactcgagcccgagttcgtgtacggcgattaccagaagtatgacctgaagagatacatcagccggtttaaaccttctaaggaaatcgaaaaagccaccgagaagtatttcttttactccaaccttctgaatttcttcaaagaggaagtgcactatgccgatgggattatcgtcaagcgcgagaacattgaatacagcaaagacacaggcgagatcgcttggaataaggaaaaggattttgcgaccattaaaaaggtgctctcctatccccaggttaacatcgtgaaaaagacggagattcaaacacacggactggacagaggcaaaccgaaggggctgttcaattctaaccctagccccaagccttccgaggactctaaagaaaatcttgtccccatcaagcagggactggatcctcggaaatacggcgggtacgccggaatcagcaactcctatgctgtgctcgttaaggccattgtggagaaaggcgccaagaagcagcagaaaaccatcctggaatttcaagggatttctatcctcgacaagattaatttcgagaacaataaagagaactacctgcttaagaaaagatatatcgaaatcctgagcacaattaccctccccaagtactccctgtttgagttcccggatggcacccgccggagactggctagcatcctttctacaaacaataagcgcggagaaattcataaaggcaacgagctggtcctccctgggaagtatacgaccctgctctaccacgccaaaaatatcaacaagaaactggaacccgagcatcttgagtatgtggaaaagcaccggaatgactttgcgaaactgctggagtgtgttctcaacttcaatgataagtacgtgggagctctgaagaacggcgaacgcattagacaggcctttacagactgggagaccgtcgatatcgaaaaactttgcttctcctttatcgggcccgagaatagcaagaacgccggactgttcgagctcacatctcagggctccgctagcgactttgagttcctgggggtgaaaattcctcggtacagagattatgccccgtcttccctcctgaaggcgacccttatccatcaaagcattacgggcctgtacgaaacacgcatcgacctgtccaaactcggagaagattga

SEQ ID NO: 4414 - RNA, 4179 nt, synthetic construct
  misc_feature 1..4179: note = Cas9 variant
  source 1..4179: mol_type = other RNA
atgaacaataacaattacagcatcggcctggacattgggaccaactccgtgggatgggccgtcatcacagatgactataaggttccctctaaaaagatgaaagtgctcggcaatacggataagcacttcattaaaaagaacctgatcggggcccttctgtttgacgagggagctaccgcggaagatagacggttcaagcgcacagctagacggcgctacaccagacggaaaaatcgcctcagatatctgcaggagatttttagcgaagagatgtccaaggtggactctagcttctttcatcggcttgatgactccttcctggtccctgaagataaacgcggctctaagtacccgatctttgccacactcgccgaggagaaagaatatcacaagaagttccccaccatctaccatctgagaaaacacctggctgacagcaaggagaaaacagatctccggctgatttatcttgccctggctcatatgatcaagtaccgcgggcactttctctacgaagagtccttcgacattaaaaacaatgatatccaaaagatttttagcgagttcatctctatttatgacaacacctttgaaggatccagcctgtctggccagaatgcccaggtggaggcgatcttcacggacaaaatctccaagagcgccaagagagaacggattcttaaactgttcgcttacgagaagtctaccgatctcttttccgaatttctgaaactgatcgttggcaaccaggccgactttaagaaacacttcgatctcgaggagaaggctcctctgcaatttagcaaggacacatatgatgaagaccttgagaatctgctcgggcagattggagatgacttcgccgatctgtttcttgtggcgaaaaagctgtacgacgccatcctcctgtccggcattctgaccgtcacagattctagcaccaaagctcccctctccgccagcatgatcgaacgctatgagaaccatcagaaggacctggctgcccttaaacagttcatccaaaataacctgcaggaaaagtacgacgaggtgttttctgatcagtccaaggacgggtatgccagatacattaacggaaaaacgacacaggaggctttctacaagtatatcaaaaatctcctgagcaagtttgaaggctctgattacttccttgacaaaattgagcgggaagattttctgagaaagcaacgcaccttcgacaacgggagcatccctcaccagattcatctccaggagatgaatgcgatcatccggagacaaggagaacactatcccttcctgaaggagtacaaagagaagattgaaacaatcctgacctttcgcattccttattacgttggcccgctcgcccggggcaacagaaatttcgcttggctgacccgcaactccgatcaggccatccggccctggaattttgaggaaattgtggaccaggcctctagcgctgaggagttcatcaacaaaatgacaaattatgatctttacctgcctgaagagaaggtcctccccaaacactccctgctgtacgaaacgtttgccgtgtataacgagcttaccaaggtgaaattcattagcgaagggctcagagactaccagtttctggattctggacaaaagaagcagatcgtcaatcagctgttcaaagagaagcgcaaagttacagagaaggacatcattcagtatctccataacgtggatggctacgacgggatcgaactgaaaggaattgagaagcaatttaatgcgtcccttagcacctatcacgacctgctcaagatcattaaagataaggagttcatggacgatcctaaaaacgaagaaatcctggagaatatcgtgcatacactgaccatttttgaggaccgggaaatgatcaagcagagacttgctcagtacgcctctattttcgataaaaaggtcatcaaggccctcacgcgccggcactatacaggctgggggaaactgtccgctaagctgattaacggaatctgcgacaaaaagaccggcaaaaccatcctcgattacctgattgacgatggctacagcaacagaaattttatgcagcttatcaacgacgatgggctgtccttcaaggacattatccaaaaggcccaggtggttggaaaaacaaatgatgtgaagcaggtcgtgcaggagctccccggctctccggctattaaaaaggggatcctgcaaagcatcaaactggttgacgaacttgtgaaggtcatgggacatgcccctgagtccattgtgatcgaaattgcgcgggagaaccagaccacagcccgcggcaaaaagaactctcagcaaagatataagcggatcgaggacgctctcaaaaatctggcccccgggctggatagcaatattctcaaggaacaccctacggacaacatccagctgcagaatgatagacttttcctgtactatctccagaacggcaaagacatgtacaccggagaggctctggatattaatcaactgtccagctatgacatcgatcacatcgtcccccaggcctttattaaggacgattctcttgacaaccgcgtgctcacatccagcaaagataatcggggcaagtctgacaacgttccctccctggaagtggtccagaagagaaaagcgttctggcagcaactgctcgacagcaagctgatctctgagcataaatttaataaccttaccaaggccgagcgcgggggactggatgaaagagacaaagtgggcttcattcggcgccagctcgttgagacaagacagatcaccaagcacgtggctcagattctggatgcccggtttaacacggaagtcaatgagaaggacaaaaagaaccgcaccgtgaaaatcatcacacttaagagcaatctggtgtccaacttcagaaaagaatttaagctgtacaaggttcgggagattaatgattatcatcacgctcacgacgcctacctcaacgccgtcgtggctaaagcgatcctgaagaaataccctaagctcgagccggggttcgtgtatggagattaccaaaaatatgacattaagcgctacatcagcagatctaaggatcccaaagaagtcgagaaggccaccgaaaaatatttcttctactccaatctgcttaactttttcaaggaggaagtgcattatgctgacggcacaattgttaaacgggagaatatcgagtacagcaaggataccggggaaatcgcctggaacaaagagaaggacttcgccacgattaagaaagtgctgtccctccctcaggtcaatatcgtgaagaaaacagaaattcagacccacggcctggatcgcggaaagcccagaggcctgtttaactctaatcctagccccaaaccgtccgaggaccggaaggaaaaccttgttcctatcaagcaagggctggaccccagaaaatacggaggctatgctgggatttctaatagctacgccgtgctcgtcaaggcgatcattgagaaaggagctaagaaacagcagaagacagtgctggagttccagggcatctccatcctcgataagattaactttgagaaaaacaaggaaaattatctgcttgaaaaagggtacatcaagattctgtctaccatcaccctccctaaatatagcctgttcgagtttcccgacggcacacgccggagactggcctccattcttagcacgaacaataagcgcggagagatccataagggcaacgaactggttatccctgagaaatacaccacactcctgtatcacgccaagaatattaacaaaaccctcgaacccgagcatctggaatacgtggagaagcaccggaatgatttcgctaaacttctggagtacgtcctgaactttaatgacaagtatgtgggggccctcaaaaacggagaaagaatccgccaagcgttcattgattgggagacagtggacatcgaaaagctgtgtttttctttcattggcccgagaaattccaagaacgctgggctttttgagctgaccagccagggatctgcctccgatttcgaatttctcggcgtcaaaatccctcggtaccgcgactatacgcccagctctctgctcaatgccacactgatccaccagtccattaccgggctttacgagacccggatcgatctgagcaagctgggcgaggactga

SEQ ID NO: 4415 - RNA, 4179 nt, synthetic construct
  misc_feature 1..4179: note = Cas9 variant
  source 1..4179: mol_type = other RNA
atgaagaactaccacatcggcctggacattgggaccagctccgtgggattcgccgctagagatgacgagaataacctcatccgggtcaaaggcaagaatgttattggggcccgcctgtttgcggaaggaaaaacagctcaggagagacggatggcccgcacgtctagacggcgctataacagacggaagtggcgccttagactgctcaatgatatcttccatgacgaaattgtgcacaaagataaggactttttcaaccggctgaagcaaagctccatctctcccaaagatgaccgcaagaaatactttggcagccttctgttccctgagctctccgattctgaattttatcataatgggaaccagaccatctaccacctgagacatcggctgatgacaagcaatgagaaggccgacattcgcgagatctatctcgctctgagacacattgtgaaataccggggaaacttccttgatgacaccccggtctccagctttgaagcctctgatctgaagctcggctccttcatccccacactgaatgacctttttgagaccattgacgtgaactatgttttcaatagcgaaaacacaaatcagatcgagtctattctgctcaacaacgatctgagaaattccgacaagagcaaacagctggtggatctcctgtaccgcaacgtctctgacgtggatgacaagtcccttgagaaacaatttaataagttccggaaagatatcagcaaggaaatcgctaaatccttcgttggctctaagtttaacgtgaataagctgctcgcctacgagaccgacgatgggagcaaaatttccctgagcttctctgacgcgtccagcgatgacaagatgcttgaactggccgacaacctcgatgacgagagaatcaatattctgaacgctctgaaagtcatctattctcgcgtgcggctcaatcagattatccctaacggaatgggcctgagcgaatccatgatcgcctcttacgagcttcacaagaaacagctgaatgatctcaagaagctgcttaacgtgctgccctttcatgagaaatatgctgtcaaggttgcctacgcggcctatattgggaatatggacgctcagaaattcacgcaagccgaactcagcaccatcgagtccctgaaggaaaaagatagcattaagaaggtgatcgactgcaaaacaggacacattaccaacgagtctctgatctccgtgatcaatcagattgtcgtgaacccttacctcgaaaacagcgattttgagctgatcgacattgttaagaaaatcgatcaggacattaagaatggcgagtatcttctgaaacagagaaacaatcaaaacgggaatatcccccatcagctccaccagatggaaatggatcaaattatcgagaagcagtctaagtactaccctttcctgggagaactgaacccgaatgagaaccgccggcacatcgctaaatataagatttccgaacttgtggcctttagagtcccctactatgtgggccctctcatcacacccgaggagcaggccaaaaccagcggcgcttccttcgcgtggatgaagcgcaaagaagacggggagattacgccttggaattttgatcagaaggttgaccgggaagccacagcttctagattcatcaaacgcctgaccgtgaaggacacatacctgtttaacgaggatgtcctccccgacaatagcctgctttatcaacagttcaaggtgctgaacgagctcaatgtcgtgaaagttaacaataagcggctgtcccaggccgaaaaacagggagcctttaacgatctgttcaaggtgaccaaaaccgtcacagctaagagacttaagaactacctcgtgtctaatttcaaccatctggacacgattgagatcaccggcctgagcgatggggaaaaatttaataacggactcacatcctatgttgacttccaaaagatctttggcgataaaattaataacctggagcttatggacgatttcgaaagcctgatcgagtggtctaccgtgtttgaggaccggcacattttcgaagagaaggtccgcaatgaaatcaactggatttccgagagcgaactcaaacagctggtggccaagagatactctgggtggggacggctgtccagcaaacttctcgtgggcatcaataacgatgagggcagaaatatcattgagcagctgtttgaaacatctgagaccttcatggaagcgatcagccgcccggaggttaaaaagcagattgacgaaatcaactccgattttattaaaaatacggacatcgagagcgtcctggctgacgcctacacatctcctcaaaacaagaaagccatccgggagacctataagattgtgaaggatatccagaaagctatgggagggaaggcccccgaatccattagcatcgagttcaccagaaatcctgaagacaaaggcgagctcacacgctccagacattctgagattagccggaagtacaaagaactgtccaaggagatctctaaagaacttaacgatgagctcaagagcaagaaaaactccatggacattgataagtattacctgtattttatgcagatggggaaagacctgtacgatggaaagtctatcgacatcgatgacctgaataactatcagattgatcacatcgtgccccagagcttctacaaagacgactcctttgataatcgcgtccttacctactatacaaacaatcaaaagaagggcaacaatacgcccctcaacgggctgaatattagcaacgaaaccagaaaactgtggtctcatctccacgacctgggccttatctccaagcggaaatacctgaatctcacaatgcagggactggatagcctgtctaagtataccaaacacggcttcattcgcagacaacttgtggagacatcccaggttatcaagctggtggctaacatcctcagcgacgagttctctgccgataataccaagattatcgaagtcaaagcgaagatgaactcccagatgcggcatagctttaatctgtacaaaattcgcgagctcaacgactatcaccatgccctggatgcttaccttacgaccttcatcgggggatatctgtacaatagataccctaagctccggggcatgtttgtgtatggggacttcaaaaagtttgatgttaacgacgccaacaatgtgaagacactgaacttcctgcacgatattaccaatccgtccgacaaatttgtcaaccagatctacgatgaacaaagcggagagcttatcctggaccgcaagcacgctattgaaacaatcaaaaagatttatcagtacaaattcatgctcatcaccagagaggtgtctacgaaggacgataagctgagcgaccagacagtttattccgccaaacggattaataacgtggcgtctcccatccctgtcaagaaagatagcaatcccgagctctacggctttagaaccgggaacgtggaccatcacatggtgattgtcaagtatcctaaaaaggattccttcgtttacaaagtggtgggcatccccatccgctttatgcaggaactgcggtctagcaagaatcaatccgagtacgaaaacacacttaatcagattgtccaggccaagctgaacagaaagaagttcgacttccgcgtggttgtggataatgtcatgtatggacagctcatccaagacggcgggcagaaatttaccctgggatctagcacctaccggtataacgctaagcagctggtgcttgatatggactccctgcgcattctcagcgatgagaaatacagaaattctctgacagacgatgaaaagaactccgagttcatcaacatttatcaacaggttctcaatgtggtcaacgagaagtttgacgtgttcgacgttcggggcacgagagataaactgaccaaggggcttgacaaatttctgaatatcacaagcaacgataaggaaatcgtgctgctcaaaattctgtctggacttcattgtaatgccgctcgcgtcaagatcaacgagattggcatcaatacctccttcggggaactgcagacaacccacggcattgtgctcagcgagaactcctacatcatctatcagtctccgagcggactgtttgagcggaaggtgagactcaaagacctgtga

SEQ ID NO: 4416 - RNA, 4179 nt, synthetic construct
  misc_feature 1..4179: note = Cas9 variant
  source 1..4179: mol_type = other RNA
atggccaacaagacctggtacctgggcctcgacatcgggagcgcttccgtgggatgggccgcgacagatacgggctataaaattatcagaaagaataaaaagcggctgtggggagtccgccttttcgaggaagctaaaaccgccgaggacagacgggggtaccgctctagcagacggcgcctggccagacggaagtggcgcctcaacctgcttgaagaactgtttacatccgaagttaagaaagtggatgagaatttctttctcagactgaaggagtctcagtatcactacgaagacaaaacccataaggtgccctatgctattttcaacgataaagactacacagataaggactattacaaggattaccctaccatctatcatctgcggagcaaactcatgacagaggaaaatccggacattcgcaaggtctttctggccatccaccacatcattaaaaacagaggccatttccttctgcaagggcagtcctttaaggatggaaatctcaacaatctgatcaaagagcttctggagctcgacattctgcacgtgggcttcgaagttaccgaggaagtggtcgataagatcgctgacatttctctggagaaaaagacgagcaaggacaaactcaacgatatcaaggaactgtaccccaaagagaagcagcttctggaggtgtttcggctcattttcggcgggaaaacctccctggacaaactttttgccatcgatgaatataaggagctggacgcggccatcaaaagcgtttctttcaaggaaaagatttacgaggaagtgcgccacgattatgagcaggtcctctccaattacatcgagctgctggacctcgctaagctggtgtatgatagcattatcctttctgacattaaaaaggaaggaaagacactgtccgagagcaaagtggaactctttgagaagcatagagatgacctgcttaaactgaagaacctcgtcaaaaatgattctaagctgtccgaagacaagaaagttgagctgtacgccctcatcttcaaggaggacaaagataagggcaccaactacgtgaattatatccggaaaagcgaagaggggaagggatgcaactacgaagacttcaaaaagtttctggtgaaggagcttgctaaactggaggaatcctctgtcaagacagagattatcaaagatctcgaactggagcaattcctgcctcttcagagaaccaaggacaacagcgtggttccctatcagattcacaaagaagaactcgtgaagatcctggataatgccgcgcgctaccattcctttctgaacgagaaggacgaaagcggctataatgtccgggagaaagtgattcagctcctggagttcagaatcccttactatgttgggccccttaactcttccaagaaagccaaggagggaggctttgcttggagcgtgcgcaatacgggctacgaaaacacacctgtcaccccgtggaattactctaaagtgatcgatgagagcgcctccgctgagaagttcattacaaacctgaccaataagtgtacctatctcaaaggggaagacgtcctgcccaagtctagcctgctttactccgagtttgccctcctgaacgaactgaatgccctcaaatatgatggaaaccggatcagcctggaggctagaaatacaattatcgaaaaacttttcaaacaacagggcaagaaggtgacgaaaacctctattaagaacctgctcaaagcggaggggtacatcgacggaaagggcgagattacagggatcgatatcaccgttaaaaatgacctgaagtcctatcgcgattttaaaaagattctgggaaacaagttcaacagcgaacacgtggagaatatcattctttggatcacactctacggcgaatctcggaaactgattaaggccaaaatcgagtccgtctatggcgaggtgtacagcaaggacgaaatcaccaaaatgtccagactggtttacaaggactgggggcgcttttctcggaagctcctgacggagcttgtgagcaaaaagctgtataacgaagagacaggagaatgcctcaatattatcggcgctatgagacagaacaatattctgttcatggagctgcttgccgatcgctttgactactccaaacagatcgtcgagttcaacaaggaactccaagaggatgtgaccgaaattgcccctgagatcctggacgatctgtatgtgtctcccgctgttaaacggagcatctggcagaccgtcagaattgtggaggagctcaagaagatcattgggtgtgcccctgcgaaaatcttcgtggagacaacccggtccaatcaggaaaagaaaaagcccacagacagccgcaaaaagcaactggagcttgcttacaaggccgtcaaaaaggatgtgaaagaactggagaaggaaattggaacgatcaactttgacgttctcaatgatagactgtcttccgtggagccgagcaaactgaaggccaagaaactttatctgtactatacccagctcggccggtgcatgtactctgaggaacctatcaacatttccgagctgttcgacaataacaagtacgatatcgaccacatttatccccagagcaaaatcaaggatgactcttttacaaataccgtcctcgtgaaaagagaaagcaacgctgccaagacagaccgctaccctctggggtccgatattcagacccccagcaatcggagattctggaaatttcttaaggagaagggcctgatctctgacgagaaatataaccgcctcgttagaacggaagagttctccgatgaggaactgagcggatttattgctcggcaactggtggaaacctcccagtctgtcaaggccgtggcgagcatccttggcgagctgaaccccgagacatccatctgttactctaaagccgaaaatgttagctccttccgccagaactttgggaagattaaaaagggagacagagattctaagaataacgaccagctcatcaaagtgcgggagattaatgattatcatcacgctaaggacgcctacctgaacgtcgtggtgggcaatgtctatgataccaaattcacacgcaacgtttttaatttcatcaaggacaaaaaggatgggagaaagtacagcctcaacaaagtgttttacgaaaatgtgtccgacagcaagaccgtcgcttgggagatggacaaaacgattcatcaagtggaaaaggttatgaacaataacaatatcatggtgacacggcgcacctctgagcagaaaggaggcctgttcgatgccacagtctataaggcgaaggtggccgctaaagccaaggacggggtttactatcctcttaaaacctccaacagcgtggtcaaggatgtggctaaatacggcggatatacctctatcggcattgcctactattccatcttcgagtacacaattgttaacaagaaaggggaagagaagatcacgagaattatcccgatccccatttacatcagccagaatattaaggactctaccgccctgatcgaatttggaaaatcccagattttctgccgggcttatgagaagatcaaagattttaagctcctgtaccgcaaactgtgtattggcagcaagatcaacatcaataactatcaatactatattgggggaaagtccgacgaaagattctactatgatagcgcgatccaggtgacacttgacaaaaagtctgagaaatacctgaagattctcagcaaataccagaattggaagaaggagaacaaagatggcgaactgtgggagaatatcaccaaggaaaacaatattgagctctataacaaactggtcgagaagatgaactccgaaatctttacaaagaagaagtctaataaatacaatgagcttaacagcgaagagatccggaataacttcattaagatctccgtggaggaacaggccaaagtgctgctggagattctcaatctgcttaccaacaagaaatctatctttgacctcaagagcattgatatcaaagctgccagagggaagatctccttcaacctgacgtctctgattcaatttagcatcattgaacagtccatcacaggcttctatgagaaggaaattaccatcattggagacaaaggcaatgatatggagaacaataacagctga

SEQ ID NO: 4417 - RNA, 4179 nt, synthetic construct
  misc_feature 1..4179: note = Cas9 variant
  source 1..4179: mol_type = other RNA
atgaacaataacaattacagcatcggcctggacattgggaccaactccgtgggatgggccgtcatcacagatgactataaggttccctctaaaaagatgaaagtgctcggcaatacggataagcacttcattaaaaagaacctgatcggggcgcttctgtttgacgagggaaccacagccgaagatagacggctcaagcgcaccgcgagacggcgctacacaagacggaaaaatcgcctgagatatcttcaggagattttcagccctgaaatctccaaggtggactctagctttttccatcggctggatgactcctttctcgtcccggaggataaacgcggctctaagtaccccatcttcgctaccctggccgaagagaaagagtatcacaagaactttcctacaatttaccatctgagaaagcaactcgccgacagcaaagaaaaggctgatctgcggcttatctatctggccctcgctcacatgattaaataccgcgggcatttcctgtacgaggaatcctttgacatcaagaataacgatattcagaaaatcttcaatgagtttattagcatctatgacaacaccttcgagggatcttcccttagcggccagaatgcccaggtggaagcgatctttacggacaagatttctaaatccgccaagagagagcgggttctgaaactcttccccgatgaaaagagcaccggcctgttctctgagtttctgaagctcatcgtggggaaccaagctgagttcaaaaagcactttgacctggaagagaaagcccctcttcagttctccaaggatacatacgacgatgacctggaaaatctcctgggacagattggcgatgggtttgctgagcttttcgtcgccgcgaagaaactgtatgacgccatcctcctgagcggcattctgaccgtgacagatccctccaccaaggctcctctctctgccagcatgatcgaacgctacgagaaccaccagaaagacctggctgcccttaagcaatttatccagaacaatctgcaggaaaaatatgatgaggttttctccgaccagagcaaggacggatacgccgggtatattaacggaaagacgacacaagaggctttttacaaatacatcaagaatctcctgtctaaattcgaaggctccgattattttcttgacaagattgagagagaagatttcctgaaaaagcagcggacctttgacaacggcagcatcccgcatcagattcacctccaagagatgaatgcgatcatcagacgccagggggaacattaccccttcctgcaggagaacaaggagaaaattaagaaaatcctgacattccggattccttattacgtgggacccctcgccagaggcaatggggattttgcttggctgacccgcaactctgaccaggccatccggccttggaatttcgaagagattgtcgatcaagccagctccgctgaagactttatcaacaagatgaccaattatgatctttacctgcccgaggagaaagtgctcccgaagcactctctgctgtatgaaacattcgccgtgtacaacgagcttacgaaagtcaagtttattgcggaaggactcagagactaccagttcctggatagcggccagaagaaacagatcgttaatcaactgtttaaggagaaacgcaaggtgaccgaaaaagacatcacacagtatctccacaacgtggatgggtacgacggaattgagctgaagggcatcgagaagcagttcaatgcttcccttagcacctatcatgacctgctcaaaattatcaaggataaagcctttatggacgatgccgaaaacgaggctacactggaaaacattatccacaccctgacgatcttcgaggaccgggaaatgattaagcagagacttgcccaatacgattctctctttgacgagaaagtcatcaaggctctgattcgccggcattatacaggctgggggaagctgtccgccaaactcatcaatggaatttgcgataagaaaaccggcaagaccatcctggactaccttatcgatgacgggtatagcaacagaaatttcatgcagctgattaacgatgacggactctcttttaaagatatcattcagaaggctcaggtggttggccgcacaaatgacgtgaagcaaatcgtccacgagctgcctgggtcccccgccattaaaaagggcatcctgcagagcatcaaaattgtggacgaacttgttaagatcatgggacatacccctgagtccattgtgatcgaaatggctcgggagaaccagacaacggccagaggcaaaaagaactctcaacagcggtacaaacgcattgaagatgctctcaagaatctggcccccgggctggacagcaatatcctcaaggagtaccccaccgataacattcagctgcagaatgacagacttttcctgtattacctccaaaacggaaaagatatgtatacaggcgagcctctggacatcaatcagctgtcctcttacgatatcgaccacattgtcccgcaggcgttcatcaaggatgacagccttgataaccgggtgctcacctccagcaaagacaatagagggaagtctgacaacgtcccctccctggaagtggttcagaaacgcaaggccttttggcaacagctgctcgatagcaagctgatttctgagcggaaattcaacaatcttacaaaggctgaaagaggaggcctggacgagcgcgataaagtggggtttatcagacggcagctcgtcgagacccgccagattacgaagcacgtggcccaaatcctggacgctagattcaacaccgaagttacagagaaagataagaagaatcggaacgtgaaaatcattaccctgaagtccaatcttgtcagcaactttcgcaaagagttcaagctgtataaagtgagagaaatcaatgactaccatcacgcccatgatgcctatctcaacgctgtggttgcgaaggccattctgaagaaataccctaagctcgaacccgagtttgtctacggcgactatcagaaatacgatctgaagcggtatatctctcgcagcaaagaccctaaggatgtggagaaggctacagaaaaatacttcttttattccaatcttctgaacttctttaaggaggaagtgcactacgccgacggaaccattgtcaaaagagagaatatcgaatatagcaaggatacgggcgagatcgcctggaacaaagagaaggacttcgctacaattaaaaaggtgctctctctgccccaggttaatatcgtgaagaaaaccgaaattcaaacacacgggctggaccggggaaagccgcgcggccttttcaactccaatcctagccccaaaccttccgaggattctaaggaaaacctggtccccatcaaacaggggctcgaccctagaaagtacggaggctacgccgggattagcaactcctatgcggtgctggttaaggctatcattgagaaaggcgccaagaaacagcagaagaccgtgctcgaatttcaaggaatctctatcctggataaaattaatttcgagaagaacaaggagaattaccttctggaaaaaggctatatcaagattctcagcaccatcacactgcccaaatactccctgtttgagttcccggacgggacgcggagacgccttgcctctattctgagcaccaacaataagcggggagaaatccataaaggcaacgagctcgtcatctccgagaagtatacaaccctgctctaccacgctaagaatattaacaaaacactggaacctgagcatcttgaatatgtggagaagcacagaaatgattttgccaaactgctggaaagcgttctcgacttcaacgataagtacgtgggggcgctgaaaaatggagagcgcatccggcaggcttttattgactgggagaccgtcgatatcgaaaaactttgtttctcttttattggccccagaaactccaagaatgccgggctgttcgagctcacgagccagggctctgcctccgactttgagttcctgggagtgaagatcccccgctaccgggattatacacctagctctctcctgaacgctacccttatccatcagtccattaccggcctgtacgaaacaagaatcgacctgagcaagctcggggaagattga

SEQ ID NO: 4418 - RNA, 4179 nt, synthetic construct
  misc_feature 1..4179: note = Cas9 variant
  source 1..4179: mol_type = other RNA
atgaacaataacaattacagcatcggcctggacattgggaccaactccgtgggatgggccgtcatcacagatgactataaggttccctctaaaaagatgaaagtgctcggcaatacggataagcacttcattaaaaagaacctgatcggggctctgctgtttgacgagggagccaccgcggaagatagacggttcaagcgcacagctagacggcgctacaccagacggaaaaatcgcctcagatatctgcaggagatttttagcgaagagatgtccaaggtggactctagcttctttcatcggcttgatgactccttcctggtccctgaagataaacgcggctctaagtacccgatctttgccacactcgccgaggagaaagaatatcacaagaagttccccaccatctaccatctgagaaaacacctggctgacagcaaggagaaaacagatctccggctgatttatcttgccctggctcatatgatcaagtaccgcgggcactttctctacgaagagtccttcgacattaaaaacaatgatatccaaaagatttttagcgagttcatctctatttatgacaacacctttgaaggatccagcctgtctggccagaatgcccaggtggaggcgatcttcacggacaaaatctccaagagcgccaagagagaacggattcttaaactgttcgcttacgagaagtctaccgatctcttttccgagttcctgaaactgatcgttggcaaccaggccgactttaagaaacacttcgatctcgaagagaaggctcctctgcaatttagcaaggacacatatgatgaagaccttgagaatctgctcgggcagattggagatgacttcgccgatctgtttcttgtggcgaaaaagctgtacgacgccatcctcctgtccggcattctgaccgtcacagattctagcaccaaagctcccctctccgccagcatgatcgaacgctatgagaaccatcagaaggacctggctgcccttaaacagttcatccaaaataacctgcaggaaaagtacgacgaggtgttttctgatcagtccaaggacgggtatgccagatacattaacggaaaaacgacacaggaggctttctacaagtatatcaaaaatctcctgagcaagtttgaaggctctgattacttccttgacaaaattgagcgggaagattttctgagaaagcaacgcaccttcgacaacgggagcatccctcaccagattcatctccaggagatgaatgcgatcatccggagacaaggagaacactatcccttcctgaaggagtacaaagagaagattgaaacaatcctgacctttcgcattccttattacgttggcccgctcgcccggggcaacagaaatttcgcttggctgacccgcaactccgatcaggccatccggccctggaattttgaggaaattgtggaccaggcctctagcgctgaggagttcatcaacaaaatgacaaattatgatctttacctgcctgaagagaaggtcctccccaaacactccctgctgtacgaaacgtttgccgtgtataacgagcttaccaaggtgaaattcattagcgaagggctcagagactaccagtttctggattctggacaaaagaagcagatcgtcaatcagctgttcaaagagaagcgcaaagttacagagaaggacatcattcagtatctccataacgtggatggctacgacgggatcgaactgaaaggaattgagaagcaatttaatgcgtcccttagcacctatcacgacctgctcaagatcattaaagataaggagttcatggacgatcctaaaaacgaagaaatcctggagaatatcgtgcatacactgaccatttttgaggaccgggaaatgatcaagcagagacttgctcagtacgcctctattttcgataaaaaggtcatcaaggccctcacgcgccggcactatacaggctgggggaaactgtccgctaagctgattaacggaatctgcgacaaaaagaccggcaaaaccatcctcgattacctgattgacgatggctacagcaacagaaattttatgcagcttatcaacgacgatgggctgtccttcaaggacattatccaaaaggcccaggtggttggaaaaacaaatgatgtgaagcaggtcgtgcaggagctccccggctctccggctattaaaaaggggatcctgcaaagcatcaaactggttgacgaacttgtgaaggtcatgggacatgcccctgagtccattgtgatcgaaattgcgcgggagaaccagaccacagcccgcggcaaaaagaactctcagcaaagatataagcggatcgaggacgctctcaaaaatctggcccccgggctggatagcaatattctcaaggaacaccctacggacaacatccagctgcagaatgatagacttttcctgtactatctccagaacggcaaagacatgtacaccggagaggctctggatattaatcaactgtccagctatgacatcgatcacatcgtcccccaggcctttattaaggacgattctcttgacaaccgcgtgctcacatccagcaaagataatcggggcaagtctgacaacgttccctccctggaagtggtccagaagagaaaagcgttctggcagcaactgctcgacagcaagctgatctctgagcataaatttaataaccttaccaaggccgagcgcgggggactggatgaaagagacaaagtgggcttcattcggcgccagctcgttgagacaagacagatcaccaagcacgtggctcagattctggatgcccggtttaacacggaagtcaatgagaaggacaaaaagaaccgcaccgtgaaaatcatcacacttaagagcaatcttgtgtccaacttcagaaaagaatttaagctgtacaaggttcgggagattaatgattatcatcacgctcacgacgcctacctcaacgccgtcgtggctaaagcgatcctgaagaaataccctaagctcgagccggagttcgtgtatggggattaccaaaaatatgacattaagcgctacatcagcagatctaaggatcccaaagaagtcgaaaaggccaccgagaaatatttcttctactccaatctgcttaactttttcaaggaagaggtgcattatgctgacggaacaattgttaaacgggagaatatcgaatacagcaaggataccggcgagatcgcctggaacaaagaaaaggacttcgccacgattaagaaagtgctgtccctccctcaggtcaatatcgtgaagaaaacagagattcagacccacgggctggatcgcggcaagcccagaggactgtttaactctaatcctagccccaaaccgtccgaagaccggaaggagaaccttgttcctatcaagcaaggcctggaccccagaaaatacgggggatatgctggcatttctaatagctacgccgtgctcgtcaaggcgatcattgagaaaggggctaagaaacagcagaagacagtgctggaatttcagggaatctccatcctcgataagattaactttgagaaaaacaaggaaaattatctgcttgagaaaggctacatcaagattctgtctaccatcaccctccctaaatatagcctgttcgagtttcccgacgggacacgccggagactggcctccattcttagcacgaacaataagcgcggcgaaatccataagggaaacgagctggttatccctgaaaaatacaccacactcctgtatcacgccaagaatattaacaaaaccctcgagcccgaacatctggagtacgtggagaagcaccggaatgatttcgctaaacttctggaatacgtcctgaactttaatgacaagtatgtgggcgccctcaaaaacggggagagaatccgccaagcgttcattgattgggaaacagtggacatcgagaagctgtgtttttctttcattggaccgagaaattccaagaacgctggcctttttgaactgaccagccaggggtctgcctccgatttcgagtttctcggagtcaaaatccctcggtaccgcgactatacgcccagctctctgctcaatgccacactgatccaccagtccattaccggcctttacgagacccggatcgatctgagcaagctgggggaagactga

SEQ ID NO: 4419 - RNA, 4182 nt, synthetic construct
  misc_feature 1..4182: note = Cas9 variant
  source 1..4182: mol_type = other RNA
atgaagagagtgaccgaggactacatcctgggcctcgatattgggacaaacagctgcggatgggccgtcacggacaaaaagaataacctgcttaaactgcggggcaagaccgctatcgggtcccacctcttcgaagagggacatacagccgcggatcgcagaggctttcggaccacacgcagacggctgaaacgcagaaagtggcggcttcgcctgctcgaagagattttcgctgaacccatggccaaggttgaccctgggtttttcgtgagactgcaccagtcttgggtgagcccgctggataaatcccggaagaaatatcatgccatcgtctttcccaccgctaaggaggacaaagccttctaccaaaagtatcctacaatttaccacctccgcgatgctctgatgacccaggacagacagtttgatcttcgggagatcttcctggccatccatcacattgtgaagtttcgcggaaatttcctccaggacacgcccgttaaagattttgaagcgtctaagatcgaggtgggccctattctgagcaaaatcaacggcgccttcgctgaaaagattgtcgaggaccaagatcccatcgagcttaatgtggccaacgctgccgaaattgaggcggttatcagagggaaagacgccgacaagaccctgtataaaatggataaggtgaagaaaatcgctaagctcctgacagactccaccgccaaagaagagaagaatgtcgctaaacagattgccaacgccgtgatgggatacaagacacagtttgaaaccatcctgggcaaggagattgataaatctgacaaggctcagtgggagttcaaactcacggatggggacgcggatgacaagctggaagcccttctgcctgatctcgacgagaatgatcaaacaatcattgctgaaatcaaaaagctgttcagcgccatcaccctttccacaattgtggacgagaacaagagcctgtctcagtccatggtcgccaaatataataagcaccatcaggactacaaactcctgaaggcttacatcgataccctgcaggaccggagcattgccaaaaagctcctgcttgcgtatgatctgtacgttaacaatagacacggacgcctcctggaagctaagaccgagtttaaacaagacggcacacttacgaaggaggatttctataaaaccgtgaaggacaacctggatgactctgaactcgcccggaaaatcgcccagaagattgctgccgataattttatgccgaaacagagaacaaactccaacggggtgatccccttccaactgcatcagatcgagctggacaagattatcgctaatcagagcaagtactatccttttctcgccgcggaaaaccccgtcgaggatcaccgcaaacaggccccttacaagctggacgaacttgtgcggttcagagttccctattacgtgggaccgatgattacccctgatgagcaagagaaaacatctggcaagtcctttgcttggatggtccgcaaagaagacggccagatcaccccctggaatttcgagcagaaggtggaccggcaggaaagcgccaacaagtttattaaaagaatgacgatcaaggatacatacctgctcggggaggacgttctgcctgctaattccctgctttatcaacgcttcgaggtgctcaacgaactgaataacattcggatcaatggatctagaatcagcattgatctgaaacagcagatctttaacgacctcttcgaggaaaagaaaaccgtcaccgagaagtccctgacaagctaccttaagcagaatctgcacctccccaccgtggaaattaaaggcctggccgatcccacaaagtttaactcttccctggcgagctattaccatcttaaatctctccacgtcttcgacaaggagctggccgatcctcaatatcagaaagacttcgagaagatcattgaatacagctccatctttgaggataagaaaatctatcaggacaagctgcatgctgagttcaaatggctcacgccggagcagtttaaggccatttctacctggcgcctgcaagggtggggacggcttagctgtagactgctcgtggaactgcacgatacaaatggccagaacatcatggagcagctgtgggactcccaaaagaatttcatgcagattgttaccgagcccgattttaaggacgctatcgccaaagaaaaccagaacgtgacacaggtcaatggggtggaggaaattcttgccgacgcttacaccagccctgcgaacaagaaggccatccggcaagttgtgaaagtcgtggctgatgtggttaaggccgccggaggcaaaaagcccgctcagttcgccatcgagtttacgcgcgaccctgataaaaatccccagctctctcatattagaggcaccaagctgctgaaggcgtaccaggaaacagctggggagctcgtcgaccaaaaactgaccgattcccttaaggaggccatgacaagccggaaactgctcaaggacaaatatttcctgtactttatgcagaccggaagagatgcctatacgggcaagaagatcaacattgacgaagtgacaaccaattaccagatcgatcacattctgccgcagtctttcatcaaagacgattcctttgacaaccgcgtgcttacagctacccctctcaatgccgaaaagagcgacgatgtcccctataaacggttcgcgaacaattacgtgtccgacctgaagatgaccgttggggaaatgtggaaacactggcaaaaggctggaatcattaacaagcataaactgggcaatctcctgcttgatcctgacagactgaacaagtttcagaaatctgggttcatcaatcgccagctcgtggagacaagccaaattgtcaagctggtgtccgttatcctgcagaacaaatatcccgatgccgagattatcacggtgaaggccggcgacaattctgctcttagacagcggctgaacctctacaagagccgcgatgtcaacgactaccaccatgccattgatgcttatctgtccatcatctgcggaaatttcctctaccaggtgtatcctaaatacagaccctattttgtttacggcaagtataaaaagttcagccaagacccggatctgcagaaagaccttattaagcactttaaagggttcacctttatgtggcctctgctccagaaggataactctgaacggaaggcccccgaggaaatcaaagagaataactccgaacgcattgtgttctacaagcaccccgacatctttgacaaactgagaaaggcgtacaattataaatacatgctggtcagccgggagacaaccacagagtcttccagcatgttcaagatgaccatttttcctcgcggagaaagagatcggaagaaaacgcgcaaacttatcccgaaaggcaacgggctggaccccaagatctatggaggctactctgggaatacagatgcctatatggtgattgtgaaaatcgacaaggctaaggagagcatttacaaagtcatcggcgttcctatgagagccctcacccggctgaaccaggctaagaaacaaggaaattatcaggaggaactccatcaggtgctggaaccccagattatgcttgataagaacggcaaacctaagagaggggtgaagggattccgcgtcatcaaagaccacgtgccctttaagcaagttgtgctggatggcgacaaaaagttcatgctctactccgcccagtacaaaaccaatgccaagcagctggctctgagccaggagacaatgcggatcgtcaccgataaccttaaaaagggggaggaccaagataagctgctcgtgaaagcgtatgacgaaattctgcagaaggttgattgttacctctctctgttcgacacatccaattttagaaacggacttcatctgggccgcaataaattcatcgacctggaggtgaacgataagaaaattacgctcagcaacatcctgaatgggcttcacgacaacatggtcctgggcaatctcaagaacattggaatcggcacccctctggggcagatgcaagaaaagtccggaattacactctctcccgaggccgtgctgatctttcagagcccgaccggccttttcgaaaaacgggttaagatcgctgatctgtga

SEQ ID NO: 4420 - RNA, 4188 nt, synthetic construct
  misc_feature 1..4188: note = Cas9 variant
  source 1..4188: mol_type = other RNA
atgaagaaagagatcaaggactacttcctgggcctcgatgtggggaccggaagcgtcggctgggccgttacagacacggattataaactgcttaaggctaacagaaaagacctgtgggggatgcggtgctttgaaaccgccgagacagcggaagtgcgcagactccaccggggagctcgcagacggattgagcgcagaaagaagcggatcaaactgcttcaggaactgttctcccaagagattgccaagatcgatgagggctttttccagcgcatgaaagaatctcccttttacgccgaggacaagaccattctccaggaaaatgctctgttcaacgataaagactttacagataagacctatcataaggcctaccctacaatcaatcacctgatcaaggcttggattgagaacaaggtgaaaccggaccccagactcctgtatcttgcctgtcataatatcattaagaaacgggggcacttcctgtttgagggagatttcgacagcgaaaaccagtttgatacctccatccaagccctcttcgagtacctgcgcgaagacatggaggtcgacattgatgccgactctcagaaggtgaaagaaatccttaaggatagctccctgaaaaattctgagaaacagagcagactcaacaagattctgggcctgaaaccttccgacaagcagaaaaaggctatcacgaatctcatcagcggcaacaagattaattttgccgatctgtatgacaaccccgatcttaaagacgctgagaaaaattctatctccttcagcaaagatgacttcgatgccctgtctgacgacctcgcgtccattctgggggatagctttgaacttctgctcaaggccaaagctgtttacaactgctctgtgctgtccaaggtcatcggagacgagcaatacctgagcttcgccaaggtgaaaatttatgaaaagcataaaaccgatctcacaaagctgaaagctgttatcaagaagcactttcctaataactacaaaaaggtgttcggctataaccaggacaatgagtccaaaaacaattactctgggtatgtcggagtgtgtaagaccaaaaacaagaaacttgtgatcaataacagcgtcaatcaggaagatttttacaagttcctgaagcccattctctccgccaaaagcgagatcaaggaggttaacgacattctggccgaaatcgagacaggcaattttcttcctaaacagatttctaagtccaacgctgaaatcccgtatcaactgcggaaaatggagctcgaaaagatcctgagcaatgcggagaagcacttctcttttctgaaacagaaggatgagaaagggctcagccattccgaaaagattatcatgctgcttaccttcaaaattccctactacatcggacctattaacgacaatcacaagaagtcttttcccgatcgctgctgggtggtgaaaaaggagaaaagcccttccggcaagacgacaccctggaacttctttgaccatatcgataaagaaaagaccgccgaggagttcattacaagcagaaccaatttctgtacctatctgatcggcgaatctgtcctcccgaagaactccctgctgtacagcgagtatacagtgcttaacgaaatcaataacctccagattatcattgacgggaaaaatatctgcgatacgaagctgaaacaaaagatttacgaggacctgtttaaaaagtataaaaagatcacccagaagcagatctctacattcattaaacacgaaggaatctgtaacaagaccgacgaggttattatcctcggcattgataaagagtgcacatccagcctgaagtcctacatcgaacttaaaaatatctttgggaaacaggtggacgagatttctaccaagaacatgctggaagagatcattcggtgggctacgatctatgatgaaggagagggcaaaacaattctcaagaccaaaatcaaggccgagtacgggaaatactgtagcgacgaacaaatcaagaagattctgaatctgaaattctccggatggggcagactttctcgcaagtttctcgagaccgtcacaagcgaaatgcctggcttctccgagcccgtgaacatcattaccgccatgcgggaaacacagaataacctgatggagctgctcagctctgagtttaaattcacggaaaatatcaagaaaattaactccgggtttgaggatgctgaaaagcagttcagctatgacggactggttaagcctctttttctgtctccctccgtgaaaaagatgctctggcagaccctgaaactggtcaaggagatcagccacattacacaagcgccccctaaaaagatcttcatcgagatggcgaagggcgctgaacttgagccggccagaaccaaaacacgcctcaagattctgcaggatctgtactctagctgcaaaaatgacgccgatgctttttccagcgaaatccagtatctctctgggaagattgagaacgaagacaatctgcggcttagatccgataaactgtacctctattacacccagctgggaaagtgtatgtattgcggcaaacccatcgagattgggcatgtgttcgacacgagcaactacgatatcgaccacatctaccctcaatccaagattaaggacgattctatcagcaaccgcgtcctggtgtgctcctcttgtaataaaaacaaggaggacaaatatccccttaagagcgaaattcagtccaaacagcggggcttctggaattttctccagagaaacaatttcatctctctggagaagctgaaccgcctcacccggacaacccctattagcgatgacgaaacagccaagtttatcgctagacaactggttgagacccgccaggccacgaaagtggcggccaaggtccttgaaaagatgttccccgagacaaagatcgtgtactccaaagctgagaccgttagcatgtttcggaataagttcgatattatcaagtgcagagaaattaacgactttcatcacgcccatgatgcttatctgaatatcgtggtcggaaacgtgtacaatacaaaattcaccaacaatccgtggaactttattaaggagaaacgggacaatcctaagatcgccgatacctataactactataaagtgttcgactacgatgttaagcgcaacaatattacagcgtgggaaaagggcaaaacgatcatcaccgtcaaggacatgctcaaaagaaacacacccatttacacccggcaggccgcttgtaagaaagggggactgtttgaccaaacaatcatgaagaaaggcctggggcagcaccctcttaagaaggagggacccttctctaatatttccaaatatggcgggtacaacaaggtgagcgccgcttattacaccctgatcgaatatgaggagaaaggcaataagattagatctctcgaaacgatccctctgtacctcgtgaaagatatccagaaggaccaggatgtcctgaagtcctatcttacagacctgctcggaaagaaggagttcaaaattctggtgcccaagatcaaaattaacagcctgcttaagatcaatggctttccgtgccacattaccgggaagaccaacgattctttcctgctccgccctgccgttcaattttgttgctccaatgacgaagtgctgtacttcaaaaagatcatccggtttagcgagattagatcccagcgcgagaaaatcggaaagacaattagcccctacgaagatctctctttcagaagctatatcaaagagaacctgtgtaagaagaccaaaaatgacgaaattggcgagaaggaattttacgatcttctgcagaaaaagaacctcgagatctatgacatgctgctgacaaaacataaggatacgatttacaaaaagcggcccaattccgccaccatcgacatccttgtcaaggggaaagagaagttcaaatctctgattatcgaaaaccagtttgaggtgattctcgaaatcctgaaactcttcagcgctacacgcaatgtttccgagctgcaacacattggaggctctaaatatagcggggtggcgaagatcggcaacaagatctcctctcttgataattgcattctgatctaccagagcattaccggaatctttgaaaagagaattgacctgctcaaggtctga

SEQ ID NO: 4421 - RNA, 4188 nt, synthetic construct
  misc_feature 1..4188: note = Cas9 variant
  source 1..4188: mol_type = other RNA
atgaagaaagagatcaaggactacttcctgggcctcgatgtggggaccggaagcgtcggctgggccgttacagacacggattataaactgcttaaggctaacagaaaagacctgtgggggatgcggtgctttgaaaccgccgagacagcggaagtgcgcagactccaccggggagctcgcagacggattgagcgcagaaagaagcggatcaaactgcttcaggaactgttctcccaagagattgccaagatcgatgagggctttttccagcgcatgaaagaatctcccttttacgccgaggacaagaccattctccaggaaaatacactgttcaacgataaagactttaccgataagacatatcataaggcttaccctaccatcaatcacctgatcaaagcctggattgagaacaaggtgaaaccggaccccagactcctgtatcttgcttgtcataatatcattaagaaacgggggcacttcctgtttgagggagatttcgacagcgaaaaccagtttgatacgtccatccaagccctcttcgagtacctgcgcgaagacatggaggtcgacattgatgcggactctcagaaggtgaaagaaatccttaaggatagctccctgaaaaattctgagaaacagagcagactcaacaagattctgggcctgaaaccttccgacaagcagaaaaaggccatcaccaatctcatcagcggcaacaagattaattttgctgatctgtatgacaaccccgatcttaaagacgccgagaaaaattctatctccttcagcaaggatgacttcgatgctctgtctgacgacctcgcctccattctgggggatagctttgaacttctgctcaaggcgaaagccgtttacaactgctctgtgctgtccaaggtcatcggagacgagcaatacctgagcttcgctaaggtgaaaatttatgaaaagcataaaacagatctcaccaagctgaaaaatgttatcaagaagcactttcctaaagactacaagaaagtgttcggctataacaagaacgagaaaaataacaataactactccgggtatgtcggagtgtgtaagacaaaatctaagaaacttatcattaataacagcgtgaatcaggaagatttttacaagttcctgaagaccatcctctccgccaaaagcgagattaaggaggtcaacgacatcctgacggaaattgagacaggcacctttcttcccaaacagatctctaagtccaatgctgaaatcccttatcagctgcggaagatggagctcgaaaagattctgagcaacgccgagaagcacttctcttttctgaaacaaaaggatgagaaagggctcagccattccgaaaagatcattatgctgcttacattcaagatcccgtactacattggacccatcaatgacaaccacaaaaagtcttttcctgatcgctgctgggttattaaaaaggagaaaagcccctccggcaagaccaccccttggaatttctttgaccatatcgataaggacaaaacagccgaggctttcatcacgagcagaaccaacttctgtacatatctggtgggcgaatctgtgctccccaagtccagcctgctgtactctgagtataccgtccttaatgaaattaacaacctccagatcattatcgatgggaaaaatatttgcgacatcaagctgaaacagaagatctacgaggaactgtttaaaaagtataagaaaattacacaaaagcagatctccaccttcattaaacacgagggaatctgtaacaagacggacgaagtgattatcctcggcatcgataaagagtgcacaagctccctgaagtcttacattgagcttaagaatatctttgggaaacaggttgacgaaattagcaccaagaacatgctggaggaaatcattcggtgggcgaccatctatgatgagggagaaggcaaaacaatcctcaagaccaaaattaaggccgagtacgggaagtactgttccgacgagcagatcaaaaagattctgaatctgaaattctctggatggggcagacttagccgcaagtttctcgaaacagtgacgtccgagatgccgggcttcagcgaacctgtcaacatcattaccgctatgcgggagacacaaaataacctgatggaactgctctcttccgagtttaaattcaccgagaatatcaagaagattaacagcgggtttgaagatgccgagaaacagttctcttataatggactggtgaagcccctttttctgtcccctagcgttaaaaagatgctctggcagacactgaaactggtgaaggaaatctctcacatcacccaggcccctcccaagaaaattttcatcgagatggctaagggcgccgagcttgaacccgcgagaacgaaaacccgcctcaagattctgcaagacctgtacaacaattgcaaaaacgatgctgacgcctttagctccgagatcaaggatctcagcgggaaaattgaaaatgaggacaacctgcggcttagatctgataagctgtatctctactatacacagctgggaaagtgtatgtactgcggcaaaccgatcgaaatcgggcatgtcttcgacacctccaactatgatattgaccacatctacccccagagcaagattaaagacgattccatctctaatcgcgtgctggtctgcagctcctgtaacaagaataaagaggacaagtaccctcttaagtctgagattcagagcaaacaacggggcttctggaactttctccagagaaataacttcatctccctggaaaagctgaatcgcctcacacggaccacgcccatctctgatgacgagacagccaaatttattgctagacagctggtggaaacccgccaggccacaaaggttgctgccaaagtgcttgagaagatgttccctgaaaccaagatcgtctatagcaaagcggagaccgtgtccatgtttcggaacaagttcgatattatcaaatgcagagagattaatgactttcatcacgcccatgatgcttacctgaacatcgttgtgggaaatgtctataacacaaagttcacgaataacccctggaattttattaaagaaaagcgggacaacccgaagatcgccgatacctacaactattacaaagtgttcgactatgatgtgaagcgcaataacatcacagcttgggagaaaggcaagaccattatcacagttaaagacatgctcaagagaaatacccctatttacacgcggcaagccgcgtgtaaaaagggagggctgtttgaccagacaatcatgaagaaaggcctggggcagcacccccttaagaaagaaggagccttcagcaacatttctaagtacggcgggtataataaagtctccgctgcctactataccctgatcgagtacgaagagaagggcaacaagatcagaagcctcgagaccattcctctgtatctcgtgaaagatatccaaaaggaccaggatgtgctgaaatcttaccttacagacctgctcggaaagaaagaaattaagatcctggtccccaagattaaaatcaattccctgcttaagatcaacggcttcccttgccacattaccgggaaaacaggagatagctttgtgctgcgccccgctgttcagttctgttgctctaatgacgaggtgctctattttaagaaaatcattcggttcaacgaaatcagatcccagcgcgagaagatgggcaagacgattagcccgtacgaggatctgtcctttagaagctacatcaaagaaaatctctgtaagaaaaccaaggccgacgagattggggaaaaagagttctatgatctgcttcaaaagaaaaacctggaaatctacgacatgctcctgacaaagcataaggataccatctataataaacggcctaactctacaaccctgggaatgcttacgaagggccgctacgagtttattaatctgaaacccaaggaccagatcattgtcatgctcgagatcctgaaactcttctgcaccacaagagaagccattgatctggggcttatcaagggcaagcccgctgcgggagtggccaccctgggcaaaaagatcagcaaccctgacaattgtattctgatctatcagtccattacagggatctttgagaaacggattgacctcctgaaggtttga

SEQ ID NO: 4422 - RNA, 4188 nt, synthetic construct
  misc_feature 1..4188: note = Cas9 variant
  source 1..4188: mol_type = other RNA
atgggcgacaccgtgaagaactaccacatcgggctggatattggaacaagctccgtcggcttcgccgctagagacgatgacaataacctcatccgggttaaagggaagaatgtgattggaacgcgcctgttttctgagggccagaccgcccaagaaagacggatggcgcgcgctagcagacggcgctataacagacggaaatggcgccttagactgctcgatgagatcttccatgacgaaattatccacaaggatgccgagtttttcaatcggctgaaacagtcctctcttagccccaaggacgaacgcaagcagtactttgggtccctcctgttccctgaggtgggagattctgagtattaccatgacggcaaccagacaatctatcacctgagacatcggctgatgacccaagatgaaaaagccgacattcgcgagatctacctcgctctgagacacattatcaagtatcggggcaattttcttgatgacacaccggtcagctccttcgaagccagcgacctgaaactcgcttcttttgtgcccaccctgaacgatcttttcgagacaattgacgttaattacgagttttccatggataacatcaatgaaattgaggacatcctgctcaacaataagctgagaaacagcgataaatctaagcagctgcctgacctcctgaccgaacccatcgtgaatattgatgacaagtcccttgagaaacagttcaacaaggaacgcacggatatcagcaaagagattgccaagtctgtcgtggggtccaaaatgaacgttaataagctgctcagctttgagtcctctggaggctacaaaatcgcgttcagcttctccgacgccagctctgaagataagatgatggagctgtccgacgtgcttgacgatagccggatgaacattctgaatatcctcaaggtcatctattctagagtgcgcctgaaccagattatccctagcgggatgggactgtccgaatctatggtggctgcctacgacctccacaaacaacagctgaaggatcttaaaaagctgctcaatgtcctgccctttaacgagcggtatgctgttaaaattgcctacgcggcctatatcggcaatattgacaagcagaagttcaccaaaagcgaagtgaagacaatcgataaacttaaggagaaatccgctatcatgaacgtgctggactttaagagcgggcatattaccaatgaggaactctctaacgtcatcaaggtggttattgtggataaatacctgaatgacgagaacttcgaatatcactccatcgtcgagaagattaatcaggatatcagcaacggatcttacctgctcaaacaaagaaataaccagaacggcaatattcctcatcagctgcaccaaatggaacttgaccagatcatcgagaaccagtccaagtactatccgtttctgggcgagctcaatcccaacagcaatcgcaaccacattgccaaatacaagatctccgaactggtggctttccgggttccttattacgtggggcccctgattacacctgaggaacaggagaagacctctggagccagctttgcctggatgaaaagaaaggaggatggcgctatcacgccctggaatttcgaagagaaagtcgacaaggaagagacagcgtcccgctttattaaacggcttaccgtgaaggatacatatctcctgaacgaagacgtcctgccggacaattctctcctgtacgagaaattcaaggtgcttaacgagctgaatgttgtgaaggccaacaataaaagactcaccgtcgaagagaagcaaggggcttttgataacctgttcaaaaagatgaaaaccgtgacagccaagaagctgaaaaattatcttgttagcaaccataaccacatcaattccgtggaaatcacgggactcagcgacgtcgataagtttaacaattctctgtccacctacattgacttcaaaaagatcttcgatgacaaaattgataaccctgacctgctcgatgactttgaggatatcattgaatggagcacagtgttcgaggaccgcaagatctttgaggaaaaggtgcggaaagatatctcttggatttccgagagcgaaatcaaggccgttgtctctaaaagatacagcggctgggggcggctgtccaagaaacttctgaatggaattaccaacaatgagggccgcaacatcattgacgaactctgggaggagagcgaaacattcatggaggctgtgtctaagcccgaagtgaaggagcagatcgacggcatcaattccgattttattaaaaacaccgacatcgagagcgtcctggccgatgcgtatacgtcccctcagaataagaaagctattagagaaacacataagctggtgaaagacatccagaaggccatgggagggcaagcccccgcttctattagcatcgagttcacccggaacccccaggataaaggccagcttaccagatcccgccactctgaagttagccggaagtacaaggagatttccaaagaagtgtctaagacactcaatgacgagctgaaaagcaagaaaaactccatggatgtcgacaagtattacctgtattttatgcagatggggatcgatctctacgacggaagctctatcgatattgacgacctgaataactatcaaatcgatcatattatccctcagtccttctacaaggacgatagctttgacaacagagtgcttacccactactctaataaccagaaaaagggcaataacacaccgctgaatgggctcaacattgatgacaaaacgcgcgccatctggaatcacctgagagatctgggccttatcaccaagaaaaagtataacggactcacactgaagggcatggaccagctgtccaaatacaccaagcatgggttcattcggcgccaactcgttgagacaagccaggtgatcaaactggtcgctaatattctttctgatgaattttccaccgacgatacgaagatcattgaggtgaaagccaagatgaacagccagatcagacaagttttcaatctgtataaggtgcgggaactcaacgactaccaccatgcggtcgatgcctatctgaccacatttatcggaggctacctgtataatcgctaccccaaccttagaaatatgttcgtgtacggggacttcaaaaagttttccgctgacgtggataacctgaaaaccttcaattttctccacgacattacaaaccctagcgataagttcgaggaccggatctttgatgaaaaatctggagagctgattctcgaccgcaagcacgccatcgagaccattaagaaaatctatcagtacaagtatatgctgattacgagagaagtcagcaccaaaaacggccagctttccgatcagacagtttactctgctaagcggatcaataacgtgaaagcccccatccctgtgaagaaagacagcaatcccgagctgtatgggttccgcacaggcaacgtcgatcatcacatggtgattgttaagtacccgaagaaagactcctatgattacaaggtggtcggaatccctctcagatttgtgcaaaaactgaaggaaaccaaagacaataaggattacgagaacctgcttaatcagattgttcagatgaagctgaaccggaaaaagcaggacttcatcgtggtcgtggacaatgttatgtatggccaactcattcaggatgggggagaaaaatacaccctgggctctagcacatataagtacaacgcgaaacagctcgtgatcaatatggacaagacgagaatcctggaggataaccgctatcttaattccctggacgagggggaagtctctgagaagctcgtgaacatttacaatgatatcatgaaagtggtcaacagccggtttgacctgttcgatattaacaagtttagagaaaaactgaatgacggacttaacaagttcaaaaatatctccaacgagcagaaggaggaaaccctgctcaagattctgagcggcctccattgcgggtctgccaatgttcccatcaaagagctgggccttacaacccctctgggaaagctgcaactcccctccggcatcgtgctgagcgaagaggctgtggtcatttatcagtctccttccgggcttttcgaaaacaaagtgcgcctgaaggatctctga

SEQ ID NO: 4423 - RNA, 4188 nt, synthetic construct
  misc_feature 1..4188: note = Cas9 variant
  source 1..4188: mol_type = other RNA
atgaagaaagagatcaaggactacttcctgggcctcgatgtggggaccggaagcgtcggctgggccgttacagacacggattataaactgcttaaggctaacagaaaagacctgtgggggatgcggtgctttgaaaccgccgagacagcggaagtgcgcagactccaccggggagctcgcagacggattgagcgcagaaagaagcggatcaaactgcttcaggaactgttctcccaagagattgccaagaccgatgagggctttttccagcgcatgaaagaatctcccttttacgccgaggacaagacaatcctccaggaaaataccctgttcaacgataaagactttgctgataagacatatcataaggcctaccctaccattaatcacctgatcaaagcgtggatcgagaacaaggtgaaaccggaccccagactcctgtatcttgcctgtcataatattatcaagaaacgggggcacttcctgtttgagggagatttcgacagcgaaaaccagtttgatacgtccattcaagctctcttcgagtacctgcgcgaagacatggaggtcgacatcgatgccgactctcagaaggtgaaagaaattcttaaggatagctccctgaaaaattctgagaaacagagcagactcaacaagatcctgggcctgaaaccttccgacaagcagaaaaaggctattaccaatctcatcagcggcaacaagatcaattttgccgatctgtatgacaaccccgatcttaaagacgctgagaaaaattctatttccttcagcaaagatgacttcgatgccctgtctgacgacctcgcgtccatcctgggggatagctttgaacttctgctcaaggccaaagctgtttacaactgctctgtgctgtccaaggtcattggagacgagcaatacctgagcttcgccaaggtgaaaatctatgaaaagcataaaacagatctcaccaagctgaaaaatgttattaagaagcactttcctaaagactacaagaaagtgttcggctataacaagaacgagaaaaataacaataactactccgggtatgtcggagtgtgtaagacaaaatctaagaaacttatcatcaataacagcgtgaatcaggaagatttttacaaattcctgaagaccattctctccgctaaaagcgagatcaaggaggtcaacgacattctgacggaaatcgagacaggcacctttcttcccaaacagatttctaagtccaatgccgaaatcccttatcagctgcggaagatggagctcgaaaagatcctgagcaacgccgagaagcacttctcttttctgaaacaaaaggatgagaaagggctcagccattccgaaaagattatcatgctgcttacattcaagattccgtactacatcggacccattaatgacaaccacaaaaagtttttccctgatcgctgctgggttgtgaaaaaggagaaatctcccagcggcaagaccaccccttggaactttttcgaccatatcgataaggaaaagacagctgaggcgttcattacgtccagaaccaatttttgtacatatctggtgggcgagagcgtcctccccaagtcttccctgctgtacagcgaatataccgtgcttaatgagatcaacaacctccagatcattatcgacgggaaaaatatttgcgatatcaagctgaaacagaagatttacgaagacctgttcaaaaagtataagaaaatcacacaaaagcagatctctacctttattaaacacgagggaatctgtaacaagacggacgaagttattatcctcggcattgataaagagtgcacatccagcctgaagtcctacatcgagcttaagaatatcttcgggaaacaggtggacgaaatttctaccaagaacatgctggaggaaatcattcggtgggccaccatctatgatgagggagaaggcaaaacaattctcaagaccaaaatcaaggctgagtacgggaagtactgtagcgacgagcagatcaaaaagattctgaatctgaaattttccggatggggcagactttctcgcaagttcctcgaaacagtcacgagcgagatgccgggcttttccgaacctgtgaacatcattaccgccatgcgggagacacaaaataacctgatggaactgctcagctctgagttcacctttacagagaatatcaaaaagattaactccgggttcgaagatgccgagaagcagtttagctatgacggactggttaaaccccttttcctgtctccttccgtgaagaaaatgctctggcagaccctgaagctggtcaaagaaatcagccacattacgcaggctcctcccaagaagatctttatcgagatggccaaaggcgcggagcttgaacccgctagaaccaagacacgcctcaaaattctgcaagatctgtacaataactgcaagaatgacgccgatgccttctctagcgagatcaaagacctctccgggaagattgaaaacgaggataatctgcggcttagaagcgacaaactgtatctctactatacccagctgggaaagtgtatgtactgcggcaagccgatcgaaattgggcatgtgttcgatacatctaactatgacatcgaccacatctacccccagtccaaaattaaggatgacagcatctccaaccgcgtcctggtgtgctctagctgtaataaaaacaaggaggataaataccctcttaagtccgagattcagtctaagcaacggggcttttggaatttcctccagagaaacaattttatcagcctggaaaaactgaaccgcctcacccgggctacgcccatttccgacgatgagacagccaagttcatcgctagacagctggttgaaacccgccaggccacaaaagtggcggccaaggtccttgagaaaatgtttcctgaaaccaagatcgtgtattctaaggctgagaccgttagcatgttccggaataaatttgacattgtgaagtgcagagagatcaacgatttccatcacgcccatgacgcttacctgaatattgtcgtgggaaacgtgtataatacaaaatttacgaacaatccctggaacttcatcaaggaaaaacgggataatccgaagattgccgacacctacaactattacaaggtttttgattatgacgtcaaacgcaacaatatcacagcgtgggagaagggcaaaaccattatcacagtgaaggacatgctcaaaagaaacacccctatctacacgcggcaagccgcttgtaagaaaggggaactgttcaatcagacaattatgaagaagggactgggccagcacccccttaaaaaggaggggcctttctccaacatcagcaaatacggaggctataataaggtgtctgccgcttactataccctgattgaatacgaggagaaagggaacaagatcagatccctcgaaaccattcccctgtatctcgtcaaggatatccaaaaagaccaggatgtgcttaagagctacctgacagacctgctcggcaaaaaggagtttaaaatcctggttcctaagattaagatcaattctctgcttaaaattaacggattcccctgccacatcaccggcaagacaaatgattcctttctgctccgcccggccgtgcagttctgttgcagcaacaatgaagtcctgtattttaaaaagattatccggttctctgagatcagatcccagcgcgagaaaattgggaagacgatcagcccttacgaagacctctcctttagaagctacattaaggagaacctgtggaaaaagaccaaaaatgatgaaatcggagagaaggagttctatgaccttctgcaaaagaagaacctcgaaatttacgatatgctgctgacaaaacataaggacaccatctataagaaacggcccaattctgccacaattgatatccttgtgaagggcaaagagaagtttaaaagcctgatcattgaaaaccagttcgaggttatcctcgaaattctgaagctcttttccgctacccgcaatgtgtctgacctgcagcacatcgggggaagcaagtactccggcgtcgcgaaaattgggaacaagatctctagccttgataactgtatcctgatttatcagtccatcacgggcattttcgagaaaagaatcgacctgctcaaggtgtga

SEQ ID NO: 4424 - RNA, 4188 nt, synthetic construct
  misc_feature 1..4188: note = Cas9 variant
  source 1..4188: mol_type = other RNA
atgaacgccaatagagagatggcttactatatcggcattgacatggggaccggaagcgtgggcatggccatcacagatgaaaactacaatctgctcaaggtcaaagggcaggactattggttcgttcgggagtttgaaacggcgaacacccaaattaagcgcagaatgcaccggatctccaaacgcagactgcggcgccatcaggtgagagtggctcttattcggtcttacttcgccgaggaaatcctgaagaatgatcccctctttttcatccgccaggacaacagcatttattacctggaggataaagactccgtccttaagacaaaggattgcctgtttgccgactataattaccacgataaaaactactataaggactaccctaccatcttccatctcagacaggcttttattaaagatacagtgaaggacgatgagaatcacacccggtatgcccgcctgctgtacctcgctatcattaacatgttcgaacatagaggacactttctgcttaattctgttagcgaggacatcaacaaagaaatggtgaaggacgccggcgaggggttcacactgtatctccaagagcggattaaggaaatcaaaccggtctcctactctgatatcctggacgtgcttgttgagaagaatattagccgctccgaaaagaaggagagaatcgtggaactgtttggaattaaaaagagctgtaaaaacggcatggagatcattaagtgcctctgtggcctggaggcgaatgtcgccatcatgttcaacctggatgacatcgaaaacaagctcaccattgtggtgtctaaagatgactatgaggataagctggctgaagtccagccccttgttgacgaggaatcctttgagctgctcagccggatcaaacagctgtacgattactctcagcttcaatccattctgaaggggtataaagagaaggaagacggagaggataagtacctcagcgacgtgagagtggaactgtatgagaaacacaaggccgacctgaaactcctgaagaaagtctacaagcgcgatcttgacaagaaaggcaagatctgcgaagggaaaaatattcagcggtcttccaagtataacttcatgttcagaagcggaaaagatggcacgtactccgcttataccaattctctgaacagcttttgttccaagacaatcgagaataagtaccgccggaacatgaaaaatagagaccgcgccagcctctacgataccatcaagaaagacctgtctgggattgagaacgatgacgtgaagaaaatccttcgggatattgaaacagagaagttcctgcctaaacagatcaccggagaaaatggcgttattcccaaccagatccatgcgaaggagctcaaggccattctgaaaaatgctgagaagcatctgccttttctcacggaaaaagacgattccggcctgacagtgagcgagagaatcatctctcttttccgctattgcattccctactatatcgggcctgtcggaaaggacagccggaccggctgggcctccattaaagaagaggggcaaatctttccgtggaacattgaacagaagatcgatgtggacaagacatctgaggagttcatcaccagactgattaaaacctgtacatacctcagcaatgaaaaggttgtgcccaaacagtccctggtctatgagcgctactgcgtgctgaacgaaatcaataacattaagatccggggaaaaagaattgaccctcaacttaagcaggagatctttaaggaactctatatcggcagcaaatgtgggaagaaagtcacgcggaagaacctgtgccagtacctggtgaataaaggagctattgaggaggattctgaaatctccggcattgacaaggatctcaacacctacatgagctcttatggcaagatgtaccagatcttcggggacaaaattaagcgcgatgacatcaaagaggttgccgaagagatcatttattacggaacaatctatggcggggccaaggaaatgtttaaaaagaaaattgagcaatacgtgtccgaggatatcctggacgaagctcagatgaatcggattcttggattcaagtttaaggattgggcgagactgagcaaaaagttcctctatctggagggctacgacaaagggaaccagaatcagctgaccacacttatgcaagccctctgggattacaacctgaataccatggaactgatgaactcccccatgtttacgttcaaggagacactcgagaaacagaagaataagatggaaaaagtcctgtgtgacttcgagtatgaagatcttgacgagtactatttttctgctcctgtgaagagaatggtttggcagaccatcgcctgcctgaaagaagtggtccagattatgggccacaaccccaagcgcatcttcatcgagatgccgcgggccgacgaggaaaaaggagagcaaggcagaaaggctagccgcaagaatagactcctgtccctgtacgaagagattgaagatgagcggccttggaaaaaggagatcgaaaacgccgcggagtctgggcgccttaatagcaaaagaatgtatctctactatctgcagatgggaaaggacgcttacaccggcgaagatattgacatcgaggatctgtttgacaactccaaatacgatattgaccacatctatccccggagcctcacagatgacaattctctggaaaacaaccttgtgctggtgtccgccaccatcaatcaggatgttaagaagaacgactaccctattccctatgacaaaatccgcgggaatagcaaggtcagagagctctggcggttcctgcacgagaaaaagtttatgaacgatgaaaaatacaatcgcctgatgtctgacgtgccccttacacaggagcaactcgccggatatattgctagacagctggtggaaacggcccagggcaccaaggggatcgctgatattatcaagtccgtcatccctgacgccgatattatctacagcaaagcgaagaacgtgtctgacttccggaaacgctatggcatgctcaagagcagactgacaaatgattttcatcacgccaaagacgcttacctgaacgttgtggtcggaaatgtgtacttcaccaagtttacacaaaacccgcggaaatatattaaggatgagaatgacatcgagaacaagaaatacaattataacctttccaagatgtacgataaagacgttattagaaatggcaaggtggcctggatcgctcagaacgggaaaaaggccggaaccattcagacgatcaagaaagtcatggatcgcaacacccccatcattacacggcaggcgttcgaacaaagaggcgagctgtatgacctccagcctatcagcaagcataaagccaagaaagaaaattacgtgcccattaaggctaccaacgagaagatgaaagacgttacaaagtatgggggatttacctctctgaatcctgcctacttcgtgtttgtcgaatacggctccgctaaaaagcgccagcggtgcttcgccgtggtgcacagctattgggcctcctctatcaaaaacaatgaggatctggtcacgcatcttaaggacagagggtacgagaaccccattgttatcgctgataagatcaaaaagaatagcctgattaaatataacggctacttcctctatatcgtgggaatggacgcgcgcaaacaggtggaattttccaatgccacatctatgtgtctgaacaataacttcattcaatacatccagaaaattgagaaggctaataccctcatcgccgaagccaaaaagcggagaccgtatatcgatgagagcattacagctgaacgcaacatcgccctgtacaatgagcttaagaaaaagcacctggactccatttttaaaaaccaccctaagggcatcgggtctgtcctcgagagcggagaaggcgcgttcgtgcagctgtccctggagcagcaaattgggatcctttacagcattatccagttttcttccttcaaaaagggaacctttagcctgaccctcatcggcgggcccaaggaagttggccggattagaatctctggaaatatgcctaaagctcgggagctgaagctcattcattattccatcacaggcatgtacaaaaaggaaattaacctgcttgattga

SEQ ID NO: 4425 - RNA, 4188 nt, synthetic construct
  misc_feature 1..4188: note = Cas9 variant
  source 1..4188: mol_type = other RNA
atggagacccaggccagcaaccaactgatctcctctcacctcaagggctaccccattaaagactatttcgtggggctggatatcggaacaagctccgtcggctgggctgttacgaataaggcctacgaacttctgaaatttagatctcataagatgtgggggagccggctgttcgacgagggagaatccgcggtggctcgcagaggctttcggtctatgcgcagacggctggagcgcagaaaacttcggctgaagctcctggaagaactgttcgccgatgccatggctcaggtggaccctacctttttcatgcgcctcagagagagcaagtatcactacgaagataaaacaaccgggcattccagcaagcacattctgtttatcgacaaaaactatacagatcaggactactataaggagtacccgaccatttaccatcttcgggtcgccctgatgaaatctggaacagatgacatccgcaaactcttcctggctgtgcaccacatccttaagtatagaggcaattttctgtacgaaggcgccaccttcgattccaacgcgagcacgctcgacgatgttctgaaacaggccctggagaatattacctttaactgcttcgactcttccgctgccatcgggagcattggacaaatcctcatggagctgggcaagacaaaatctgacaaggctaaagccattgaacggcttgtggatacctatatcattacagacgaggtcgatacctccgggaagacgcagaaagaacaggtgaaggaggacaagaaacgcctcaagagctttgcgaatctcgttctgggactttccgcctctctgacagatctcttcggcagcgtggaagacctggatgaggacctgaaaaagctccagatcatcggggatacctacgacgagagacgggatgacctggctaaagtctggggagacgaaattcatatcattgatgactgtaagtccgtgtatgatgccatcattcttatgagcatcaaggagcccggcctgacaatctctgaatccaaagtgaaggctttcaaaaagcacaaagacgatctcgccattcttaagagccttctgaagtctgacagaagcatctacaacaccatgtttaaagtcgatgagaagggcctccataattatgttcactacattaaacaagggcgcaccgaagagacatcctgcaaccgggaggacttctacaagtatacgaaaaaggtggtggaaggactgcctgattctaaggacaaagagtacatcctgagcgaaattgagctccagaccctgcttcccctgcagagaatcaaggataatggcgtcatcccttatcagctccacctggaggagctgaaagtgattcttgccaagtgtgggcccaaatttcctttcctcaacgaggttgctgacggattttccgtggcggaaaagctgatcaaaatgctggagttccgcattccgtactatgtcggccccctcaatacacatcacaacgtggataatgggggatttgcctgggctgttcggaaggccagcggcagagtgaccccttggaacttcgacgacaagatcgatcgcgaaaaatctgccgctgcctttattaagaacctgacaaataaatgcacctaccttctgggcgaggacgtcctccccaagtccagcctgctgtattctgagttcatgcttctcaacgaactgaataacgtgcggatcgatgggaaacctctggagaaggcggtcaaggaacatctcattgaggctgtgtttaaacaagaccacaagaaaatgacgaagaatagaatcgaacagttcctgaaagataacaattacatccccgagaagcataagccggagattacaggacttgacggcgaaatcaaaaacgatctggcctcctaccgcgacatggttcggattctcgggaataactttgatctgagcatggccgaggaaatcattaccgacatcaccatcttcggagagtccaagaaaatgctgagagaaacacttcgcaataagttctctagccggctcgatgacgaggctattaaaaagctgtccaagctgagatatcgggattggggccgcctctctagaaaactgcttaacgtgatcgaggggtgtgacaaggccggcgacggaacccctgaaacaattatcattctgatgcggaattttagctacaacctcatggagctgctgggcgataaattctcctttatggaaagaatccaggagatcaatgctaagctgattgaagggcaaatcgtcaacccccacgacattatcgatgacctcgccctgagccctgcggtgaaacgcgccgtttggcaggctctgcggattgtggatgagatcgtccacatcaagaaaacgctccccgccagaattttcgtggaggtgacccgctctaacaaggctgaaaagaaaaagaaagactccagacagaagcggctgagcgatctttatgccgcgatcaaaaaggacgatgccctgctctctggactgacaaatgaggaatttggcgggctgaagtccggacttgctaaatacgacgatgccgctctgcgcagcaagaaactctatctgtactatacccagatgggcagatgcgcctacacaggggaggttattgacctctctcaactgaacaccgacaattacgatatcgaccatatttatccccggagccttacgaaggatgactccttcgataacctggtcctctgtaaacgcaccgccaatgctcaaaagagcgacacataccctatctctaaggagattcagaaagcgcagaaggccttttggatcttcctgaaacagcagggcctgatctccgaaagaaagtatgagcggcttacccgcattacaccgctgaccgctgatgacctcagcggatttatcgccagacagctggtggaaacgaaccagtccgtgaaagccgctacaaccctcctgcggcgcctttaccccggcgtcgatgtggttttcgtgaaggccgagaatgtcacagactttagacacgataacgacttcattaaggtgcggtctctgaatcatcaccaccatgcgaaagatgcttatctcaacatcgttgtggggaatgtctaccacgaaagatttacccgcaacttccgggccttctttaagaaaaatggagccaacagaacctataatctggctaagatgttcaactacgacgtgaaatgcacaaacgccaaggacggcaaggcgtgggctgttaaaacgagcatggataccgtgaagaaaatgatggactccaatgatgtccgcgtgacaaagcgggtgtacgagcaaaaagggcagctgtctgacattaaccttaccaaggccagcaaagtcaaggccgatatctatctgcctatcaaggctaatgaccccattatgtcccagaacatgaaatacggaggctattctgatatcaagaatgcctactatacaattatcgagtacagcgacaaaaagaacaattccattaaggcttttatccctatccccattttcatcgccaccaagacgctcacaaagcaggcgctgctcgaatatattaaaaccgttctgccgaaggccaacaatcttagaatcatttacaaaaaggtgtacaacgatcaactgctgaaaatcgacgggtttaattattacctcggcggacgcagcaacgatcggttctgtattgacaatgctatccagctgatcgtgcctcttgagattcagttttatatcaagctggtcgaaaagttcaccgccattatctctgagaacaaaaatattgctctcaaggcctccagcgtgaaatctagaaaccccatcaacaatcaagttgaaaacatcacactggagtacacccagaagctctttgattatctggtgtccaaattcaatgagcttatttacctgaagatgcgcggcaacaagctgacagacgtcaataacatcgggcggaaacagtttattaagctcagcctggaagagagatgcaaagcccttgctgaactgctcaatatcttcacgaacatgaataagaaactgtctctctccaccattaacgtgagcgcgtcccggaaggttgtgaatttcaaaatcagctctctggacgagtttaagatcgtcaacgaaagcattacaggactttattcccatgagatcaccattgtgtga

SEQ ID NO: 4426 - RNA, 4188 nt, synthetic construct
  misc_feature 1..4188: note = Cas9 variant
  source 1..4188: mol_type = other RNA
atgaacctgagaaataccacagacgagtacaacatcggcctcgatatggggacgaatagcgtgggatgggccgtcaccgacaaggttggcgctattgcccacttcaaagggatgcccacactgggatcccggctttttgatgcggctcagaccgccgccgaagctcgcgcccatagaggccaacggcgcagatatgtgcggcgcagatggcggctggacctcctgcagtctcttttccaggatgagatcgacaaggtggatagcgaatttttcattcgcctgagacagtcccggctccacgtcgaggaccgcgaagatgggcatgctgactacaaatggcctatctttaacgattctgacttcacagaggtggattattacaagagatttccgaccatttatcatctgcggaaatggctgatcgagacagaccaaaaggccgacatccgcctcatttacctggcggttcacaatatcgtgaagcacagaggaaacttccttcgggaaaataacaaaaatctgagctccagaaacgccgatcccgctgaggccgtcggccacctccgcctggctcttaataactggtgcctggaacggggctatgagtgtgcctggaagtctgggggaaatgacaacgcgattctcaatgtgctgatcgatggcgagaaaagacgcagcgaccaggttcgggaaattgccaagctgaccgggatcgattgcggagacgctaaacagtccagacagtgtaacgaggccattgctaaggccatcgtgggcctcaaggccgaaatgaaaaacatctttggggagttccctgctgaaaagacgctgatttaccttagctctgatgacgatgtcgaggtggtgcgcgacgcgtgccccgatgactccgtcgagctgtttcaagccctctgtgaactgtacgctgcctatatccttcagggactgctcagctacgcccctggccagaccatttctgttaatatggtgaaaaagtatgaccggtacggcgaggatctgcatctgctcaaagaactgacaagaacctatgcttccaagcgctacgacgccttctttagaggggagacatatgaaggaagctctgattacgtggtcgacaaagcgcagggctacaccagatataaccttgggacgacacaactgtcctacgatgacttccagaaggctgtgaaggaactcttcaaaggaaccgatgccctgcaggacgagcgctatcaaggcatgatggttgcctttggggaacagcggttccttagacggctgaagacaagcgataatggatccatctactatcagctccacctggaggaactgcatgctattctcgagaaccagggcaaacactacccctttctgcttgccgaagaggacaagatcgagtctctggtgagcttccgcatcccttattacgtcggcccgctcaccagagaaaatgctgccgtggggcacgatggaaaagagcggtttgcgtggtccagcagacgcgacggcatggaacatgccgttattaccccctggaactgggaggagatcattgatcgggacaagtctgctgaagacttcatcattagaatgacaggggattgcacgtacctgcaaggagagcctgtgctgcccaagtgttcccttctctatgaagagttttgcgccctgaatgaactgaacggcgctcactggaccatcgacgaggatgacgagcgcagattcgatgccgcgcagcgggaacgcatcatgtgtgacctctttagaagcacacggaaagtcacctacaagaaagtgtctgattggctggagcgcgaagacagcttcgtcggggccagagtgcatggcggacagggcgagcacgggtttgaatcccagcttggatcttatattttcttttgcaaggatgttttcaaaacagacagcctggatgaggctgactaccctatgatcgagcaaattatcctctggtccaccctgttcgaagatcgggacattctgcgcagaaagatcgaggaagcctatggcgaccggcttacgacagagcagattaaggtgatctgtaaaaagcgctttgctgggtggggaagactcagcaaaaagctgctgaccggcatcaaagtcgataccgacacagggcggaagtctattatcgatgtgctcagagaaggcaatcccaacgacggacagcgctcccggaccatggttttcatggaggtgctgagagatgagggccttgggtttcagaaggccgtcgacgatttcaatcgcgactactttagcgaacataacaatggactgatggatgtgaacgacctcccgggctctcctgccattcggagatccatcaatcaagctgtgcgcattgttgatgagatcgtcagcatcgcgaaaaaggaacccgccaacattttcatcgaggtgacacgggaggaagacgaccctcggaaaaaggggaaacgcacgaagcggagatatgatgctattaaatccgccctggaggtgtttaagaaggacgatccccagctgtggaaagaacttaccaagaaagactctaacaatatggatgagcggctcagcctgtacttcatgcagcgcggaaagtgcatgtactccggcagacccatcaaaattgaggagctgcacacagggaagtatgaggtcgaccacatcatccctcggtcttacattaaggatgacagcctcgaaaacaaagtgctggtttatcgcgaggaaaatcagcataagaccgatacacttctgatcgactccagcattagacggaaaatgggcaagtactggagaatgctccacaacgccaaactgatcggagataagaagtttcgcaatctgttccgggaccatattgatgacaaaaccatgaagggctttgtggctagacaaatcgtcgagacgtctcagatggtgaaacttgttcagaccctcctggaagcccgctatccgggggcgcggatcgtgcccgtcaaggctaacatttcccacgacctgagagatgccgccggactcgtgaaatgccgcgaggctaatgacttccaccatgcccacgatgcgtttctggcttgtcgggttggccttttcatccaaaagagacatcctagcgtgtacgacaaccccattgggctggcccacatcatgcgcgattatgccagagctcaggcccgggagtacaagaaatctcattacctcgctcacacaaagggattcattgtcaattcctttctgagctctggcttcgacaaagaaaccggggaggtgtttaaggatgactgggatgccgaagcggaggtggaaggcatccgcagagtcctgaactatcggcagtgcttcattagccgcatgcctgttgaggccacaggaaccttttgggaccagacgatctactcccccaaatgtggcaagaaacttacactgccgctcaagagagggctggatcctgaccggtatggaagctactctagagagcaattcgcttactttttcatctatgaagcccgcgatctcaagcacgagcggcatattctgcagtttgctcaggtgcccgtgagagtcgccgcccacatcgctaaagacccttcccagcttgaaagctatgcggtgaagctggccggccaagctaatctcgccttcgttcgcattgtgcggagacggatcctgaaaaagcagctgcttgagctgaacggggaccgcctcattatcaccggagtcagagaggtgcggaatgccacagaatttgctttctccctggatgaggaaaccctcatcgagcgctgcgttcagattgccaaagtgggctctctgatcggcgtcgtgaacgacgaagatgaggagcagcttagcgcggacctgaatgaactcttctcctctctggttaagagagggcccaagctgtgtaaccggctttacgctcaactgaaactcgataagtacctgagcaaatttgacgagctcaccctgacagataaggccaaagtggtccttcagctgattgccatcacgaacggatccattaatatggctgacctgtctgccctcggcagctccaagtatgcggggtgcatgcaagtgagctacttcaagcagctgaacgctcctatcggagaagtgaatatcattgatcagtctgtcaccggcatgtttgagcgcagaacacatatcgggctttga

SEQ ID NO: 4427 - RNA, 4188 nt, synthetic construct
  misc_feature 1..4188: note = Cas9 variant
  source 1..4188: mol_type = other RNA
atgaaggagatcaaagactacattatcggcctggatattgggaccaacagctgcggatatgtggtcacagacaagcagaataacatcctcaaactgaagggcaaaacggccattggggctagacttttcaaggaaggacaagccgcggctgatcggcgctcctttagaaccacacggcgcagactggcccggcgccactggagactcggcctgcttgaggaaatcttcgaccccgagatggaaaagatcgatcctaatttcttccggcgcctgaaagagtctgactacagcccgaaggattccagaaaacagtttaacgccattgttttcaagtctatcaaagctgacaagcggttttataagaaataccccaccatttatcatctccgcaatgccctgatgcacgataaccagaagcatgacctgagagagatcttcatggctgtgcaccatattgtgaaataccgggggaattttctccgcgaagatagcgtcaacgccttcaaggcggccaaattttccctgagaggagaggacggcatcggccctgtggataaacttaatgacctgctcaaagaaatttattctgagtacagccccgagctggctacaaacaatctttccaagatcgaagacatcattaaggataaaaacctgtacaagcaggacaaactcaagcaagttgccaccctgctgatcaaagaggctgatagcaaggacaaggccaaactcaataaggatattgcgaaacaggtggccaactctttcatggggtatatgtttcggctggacacacttttctccctgaccgatgtcgacgtgaaggattacaaactcaagttcagcgacgctaatatcgatgaatctctggacgaccttacgtccctgctcaccgatgcccagattgagtttgttctggaactgcagagcatctataacacaatcgtgctcaacgagattgtccctgacggaatgtctctgtccgagagcatgatcaagaaatacgatgaccacaaggaagatcttaaaattttcaaggagtatatcgactccctgtctgatcaaaagaaggctaagaaactcctgagcgcctacaatctttatgtgaactacagaaagtccgacctggtggaagccaaaaatctctttaagaacaaaaaggtcggcgataaaaatttcgctgacgttattagcaactttgaggtgttcgggaagtttgtgtctgataatctggacgattccgaactggcgaacaagatcaaagcccgcctcgacctgggagagttccttcccaagcagcggaccaatcagaacggcgtcatcccttaccagctgcaccaagtggagctcacacagattctggaaaaacaggggaagtattacccgtttctgatcacccccaatcctgttgagagccatagaaacaatgctccctatgaaatttctgagcttgtgagcttccgcgtcccttactatgtgggacccctcatcgacaaccaatccattaaagataagcagaataagaacaaatttgcctggatggttcggcagaagcagggccaaatcacgccgtggaacctggaagagatggtggacacaaccgagtctgccaatcagttcattaaaagaatgacacgcaaggatacctacctgctcgctgaagacgtcctgcctaaaagctcccttgtgtatcagaagtttatgatcctggatgagctcaaccggatcaagattgacggcaaaaagctgaccagcgaactgaaacacgatatcttcgagaaacttttcaaaaagcagaagtctattaatctcgacaacctgaaaaattacctgctcgtcgaggggaacatccccggactgattgaaggcctttccgatgggatcaattttaacaatagcttctctacatacatcgactatagaaacatttttggagatgagatcgacaatcctaacaagcaagccgatttcgaaaagatgattgagtggtccacggtgtttgaagaccgcaagatcttcaaacggaagctgaaagagattacctggctcacaagcgagcagatcaagcaggtttcctctaagagatacagcggctgggggcgcctgtccaaaaagctgcttacccagatcacagacgaaaatggagtgaacattctccaacggctgtggaatgagcccgaaaccctgacggaggtcctcgcgaaccccgtgatcaaaagaaagattgttgaagctaactctagctttacaaaagccaaggatatgaaggacatcctggtggaggcctatacctcccctcagaataaaaaggctattcggcaggtcatgcgcgtggtggatgacatcatcgccgctgcccatggcaaaaagccgagccagattgcgatcgagttcgccagagaagatcaagacaacccccagatgaccaaatctcggaaggctcagcttgatcaaatttacgccaagatctccgacgagtttctggatgacgctgttaaaaatgaactcaagaacatgaaagataataagcctctggccaaagacaaggtcttcctgtattttaagcagatgggcagagacgcgtacagcggggagaaactttctctcgataacctgcaggactatgatattgaccacatctacccccagtccttcattaaggatgacagctttgataatcgcgtgctggtgcaacgggcctacaacaatggaaaatctgacaacgtccctgtgctcctgttcggcaataagatcgctgccgggcttggaatcacaattagacagatgtggaaaaagtggctggaactcggcctgatcagcaagcgcaaattcaacaatctgattaccgatcccgagaagatctccagaaacatggctagcgggtttgttaatcggcagcttgtggagacatctcaggtcattaaactggtggccaacatcctccaagccaagctgccggacacggaaatcattgaggttaaggcttcctataacagcatcctccgcaaggaatttaatctgtacaaatccagagaggtgaacgattatcaccatgcgattgacgcctaccttaccacaatcgtcggcaattatctgtaccaggtgtatcctaagctccggccctactttgtttacggacagttcaagaaatttggcaaggctgagaaccaggaagatgaccctgtgaaaaagattaaaaagttcaattttatctatcaactgatctgggggaaggacgatgccatttgtatctctcacaccaaccagcaggtcttcagcaaaaaggacattatcgataaactgacaaccgcctacaattttaagtatatgaacatttcccatgctgtgtacacgcgcaataacaatatgttcaaacaaaccctttttcccatcattgagagaacaaccgccaagacaaagtctctgatccctaaaaagctcgaccggcccaccgatatctatggaggctacagcaacaataacgacgcgtatctggctctcgtgaaagtcgataagaaacgcgggtccgaatacagagttgtgggcattccgatgcgggccgccgctatgctgaaggcctctaagaattacgacgaggatcttcgcaaagtgatcgaacctatggtcatgttcgacaagaacggaaaagcgaagagagggattgagggcttccgggtgctggttggaaaaatgccctttaagcaggctgtgctcgatggcaataaaaagttcatgctgacggggacagtcgacacccccaacctgaagcagcttgtgctgagccagcaaaacatgaaatatatcctcgattacattgaggacgttgactgcagaaagcacaaatttggagataaggtgcagaatcctgacaaatgtctgctcgaagtcttcgatgagatcatcgaaattgtggacaagtattttgagctgttcgattcccgcgactttcgggaaaaacttagaaacagccgcaataaattcatcaagctggaggcctctaaaaaggccgatacaattctggctatcctcaaaggcctgcaggccaagtccacccgggctaccattaaggagcttaacatcagcgactttgggagaatcattacatcttccatcagcccggaagcccagctgatttaccaatctcccacgggactcttcgagcgccgggttaaagtgaaggatctgtga

SEQ ID NO: 4428 - RNA, 4188 nt, synthetic construct
  misc_feature 1..4188: note = Cas9 variant
  source 1..4188: mol_type = other RNA
atgagcaagaaataccagaacaccaagtattacgtgggcctggacatcgggacatcctctgtcggatgggccgttacggatgctaattatgagctcctgaaagtgaacggccacaagacctgggggagcagacttttcacagaagccgagaccgcgctggaacggcgcacacatagagctacccggcgcagactccaacggcgcaaacagagactggaccttctggatgagctctttgccgaggaactggccaaggtggacccccagttcctgctccggctgaaggagtcccagtaccacatggaagataaatctacagacgataagtatgtcctttttaatgaccaaaaccgcaccgatggagagttctttacggaataccctaccatttatcatctgagaagcgagctcatgcagggcaaaaaggaggacatccgggctgtgtacctggcccttcaccatattgttaaataccgcgggcacttcctgctcccgggagataattatgacatgcagggcaacctgtccgaactgatcaagagactctttaagttcattgaggaaacactgtttatcgaggatcttggcctgaccgacgaaatccagtctaaaattgaggagatcctcctgacaaagaccaaaacgcggcttgaccgccaaaaggaaattgtgaaactgttcaatacaaagcaccagaaactcgatgacaagcagaagaaactgctggaggctatctttaagctctgcctggggcttaaaggaaacatggtcaatattttcggcgataagggggaatacggaatcgactttaccgatgtggaggacaaaaagaagaaagttgaatttagcgccgattatgacaacaatattaacgattacgtggacttctttggcgagtatttcgagctgctcgaaatcacaaagaaaatcaatgataccgtcattttctccgagatcctggtggacgggaagggattcagcgaatctaaagtgatttcctacgagaagcatcagcaagaccttagaaagctgaaaaccctcctcaagagcctggataaaacactgggctataagtacggcgaagggctgtaccagaaaatccttctggacgatgtcaagtctaactatgttaattactccggaaacagccagaagctcaaaaagtgtacgaaagacgagttttatggcttcattaagtctaaactgaactccgtgaccaagaaagagaaggtgagcgaagcgcaacagaaggagatcgcccagatcctggctgatatggaatttggggactaccttcccctccagcggacaaccgataatggagtcattcctaaccaactgcacaaaaaggagctgatcgagattatcgaacagcagacaaaatatcatgacttctttaatgatgtggacgagaacggcctcaccattaaggataaaatcatctccctgatgacgttccggattccctactatgttgggcctcttaatgactaccacaaggtggccgatggaacaggccacgcttggatcgaaaagaaaaaggacggcaaaatttacccctggaactttgacgagatggtcgataccgaagccaccgcggagaagttcatcaaaaatctgacaaacaagtgcacctatctcaagggggaggacgtgctgcctaaagaatctaagctgtacagcgagtttatgcttctcaatgaactgaacaatattaaaatcgataaccagaagctggacccgaaactcaagatgaagatggtttccgagctgttcatgaaaaagaatgaaaagattacaaagaaaaagatcgtggattatcttcgcagcatcggacaagccaacggcaatgagatggtctctgggattgaccgggagatcaaatccgatctgaagacgattcataagatccagcactactatcaggacgctagcctcgaaatggccgagaacattatcagatggaacaccatcttcaatgattctacaagcgacattctgaaagataagatcaccaaggcttacggagacgtgctgacacccggccagattaaggggctttccaacctcgcctgtaaagattggggcaagctgtctgaaaagtttctgaccggaatccgctgcgacgtcggcgagttcaaaaatattagcatcatccaagccatgcgggacacgaacaataacctcatggaactgctttccaataagtatgagtttatggataaaattcaggagtacaacaaggaatactatggggacttcacctttaaagctgagcctagcatcatggatgacctgtacgtgggacccggccctaagagagcgatttggcaggccgttcgcatcgtggaagagattaagcggatcatggggcatgatcccgagaaaatcttcctcgaaacaaccagaacaaatcgcgctccgaaggtcaaaaacaccaagcggtatgacgccctggagaaaaagtacgaatctgtgaaggagcacgaatatgccgaggttaaaaaggagtttgaaattgagaaaaatgattccctgaacatcaagaaacttttcctctactttacgcagctgggacattgtatgtatagcgacgaaaagattccttacaatgagctgttcacaaacagatacgatatcgaccacatttatccccgctctaagacccgggataattccatggacaacctcgtgctggtcaaagctgaatgcaacagagacaagaaagataattaccctatcaaacttaaaacaaacattcaacagaagtgtcaggtgcggtgggcctatctgcgcgacaaaaagctcatcaccgaggagaagtacaatagactggtgcggaaaacacccctgaccgaagatgagcttagccaatttatcgcgagacagctggttttcacgtcccagtctgtcaaggctaccgccgaagtgtttaaacgcctctatgaggacagcaagatttgctacgtgaaagccgaaaacgtctccgatttccggtatggctctacaagaaagatgagcaaggacgatcagccccaacctttcatcaaaaatcgcgacgtgaacgattttcaccatgctaaggacgcctacctgaatattgttgtggggaacgtctacgatgtgaaattcacccagaatccgacaagatttatcaaggctaacaaagactattccctcaattacattttccggtatcccgttaacaagaagggcgagaatgtgtgggatcctgagcagagcatgaaaatcgtcgaaaagaccctgaaatctaacgacgtgcgcgttacgaaacttgtgaaacccatcacatcccctattagcaatgagaccctgcacaaggccctcaagtgtaaacccggatcttacctgccgagaaagtccagcaaaggcacccctctggcggacgtcacaaagtatgggggatacgagaaaatcaagaacgcctattactctatttacaaatatacctacatgaagaagaaagaatgcatggaggaatttcttctggtgcccatccctattcatctcgtgaacaatgatgaggaactgcccaagtatatcaacgacaaaatcgctgagcgggccaagaaaaagaagctcgaaacagtcgagtgtattgttaaagagctgtaccagggcacgcttgtgcgcatcaatgggtatgattacagaattgctggaagctccggcaagcaattcgaactgcacaacgggatcaatctcattgtggagccttgggtcgaaaaagtgctgaaggagaccgacaaatttgttagaaagagcaactctaagctggataaaaagcagcagaaagaaaatacaaccgagacacttatcgagaagcagctgaacgacgtgttcgaatatctctgccgcaaactgaatcaaggcatttttaagaacaataagcacaccctccccgccaaactgcttggagattccatccagaagagattcgaggacgcgagcatcgaagatgagtttgaagtcattaaagagctgatctccgccattgctaagaacccgcagaatttcaaaacgatccaaaaggtgctggacatttctggcagctccatccctcggttcaacctcaaactgaccaagaataacgttgatgagtttatcattaagaatgaatctgtgacagggcttttcacccatgagaaagtcatctttcgcaagtga

SEQ ID NO: 4429 - RNA, 4188 nt, synthetic construct
  misc_feature 1..4188: note = Cas9 variant
  source 1..4188: mol_type = other RNA
atgaagaaagagatcaaggactacttcctgggcctcgatgtggggaccggaagcgtcggctgggccgttacagacacggattataaactgcttaaggctaacagaaaagacctgtgggggatgcggtgctttgaaaccgccgagacagcggaagtgcgcagactccaccggggagctcgcagacggattgagcgcagaaagaagcggatcaaactgcttcaggaactgttctcccaagagattgccaagatcgatgagggctttttccagcgcatgaaagaatctcccctctacgccgaggacaagaccattctgcaggaaaatacactgtttaacgataaagacttcaccgataagacatatcataaggcttaccctaccatcaatcacctcatcaaagcctggattgagaacaaggtgaaaccggaccccagactgctttatctggcttgtcataatatcattaagaaacgggggcactttctcttcgagggagattttgacagcgaaaaccagttcgatacgtccatccaagccctgtttgagtaccttcgcgaagacatggagctggacattgatgcggactctcagaaggtcaaagaaatcctcaaggatagctccctgaaaaattctgagaaacagagcagactgaacaagatgctcggcctgaaaccttccgacaagcagaaaaaggccattaccaatcttatcagcggcaacaagatcaatttcgctgatctgtatgacaaccccgatctcaaagacgccgagaaaaattctatttcctttagcaaagatgacttcgatgctctgtctgacgaccttgcctccatcctgggggatagcttcgaactcctgctgaaggcgaaagccgtgtacaactgctctgttctctccaaggtgattggagacgagcaatacctgagctttgctaaggtcaaaatctatgaaaagcataaaacagatcttaccaagctgaaaaatgtgattaagaagcacttccctaaagactacaagaaagtttttggctataacaagaacgagaaaaataacaataactactccgcctatgtgggggtctgtaagatcacacacaaaaagctcgtgatcaaaaattctgctagccaggaagatttctacaagtttctgaagaccattctttccgccaaaagcgagatcaaggaggtgaacgacattctgacggaaatcgagacaggaaccttcctccccaaacagatttctaagtccaatgccgaaatcccttatcagctgcggaagatggagctggaaaagatcctcagcaacgctgagaagcatttttctttcctgaaacaaaaggatgagaaaggccttagccactccgaaaagattatcatgctgctcacatttaagattccgtactacatcgggcccattaatgacaaccataaaaagtctttccctgatcgctgctgggtcgttaaaaaggagaaaagcccctccggaaagaccaccccttggaactttttcgaccacatcgataaggaaaagacagcggaggagtttattacgagcagaaccaatttctgtacatatctgatcggcgaatctgtgctgcccaagtccagccttctctactctgagtataccgtgctgaatgaaatcaacaatctgcagattatcattgacggcaaaaacatctgcgatattaagctcaaacagaagatctacgaggaactgttcaaaaagtataagaaaatcacacaaaagcagatttccacctttatcaaacacgaggggatttgtaacaagacggacgaggtcatcattcttggaatcgacaaagaatgcacaagctccctgaagtcttacatcgagctcaagaatattttcggcaaacaggtggatgaaatcagcaccaagaacatgctggaggaaattatccggtgggccaccatttatgacgagggggagggaaaaacaatcctgaagaccaaaatcaaggctgaatacggcaagtactgttccgatgagcagattaaaaagatccttaatctcaaattttctgggtggggaagactgagccgcaagttcctggaaacagttacgtccgagatgccgggctttagcgaacctgtgaacattatcaccgccatgcgggagacacaaaataacctcatggagctgctttcttccgagttcaaatttaccgaaaatattaagaagatcaacagcggcttcgaagacgccgagaaacagttttcttataatgggctggtcaagcccctcttcctgtcccctagcgtgaaaaagatgctgtggcagacacttaaactcgttaaggagatttctcatatcacccaggctcctcccaagaaaatctttattgaaatggccaagggagcggagctggaacccgctagaacgaaaacccgcctgaagatcctccaagatctgtacagctcctgcaaaaacgacgccgatgccttcagctctgagattcagtatctttccggcaagatcgaaaatgaggacaacctgcggctcagaagcgataaactgtacctgtattacacacagcttgggaagtgtatgtattgcggaaagccgattgagatcggccacgtgtttgacacctccaattacgatatcgaccatatttacccccagtctaaaatcaaggatgacagcatttccaaccgcgtcctcgtgtgctctagctgtaataaaaacaaggaagacaaatatcctctgaaggctgagatccaatccaagcagcgggggttctggaacttcctgcagagaaataactttatttctctcgaaaaactgaatcgccttacacggaccagccccatctccgatgacgagacggccaagttcatcgctagacagctggtcgaaacacgccaagccaccaaagtggcggccaaggttctcgagaaaatgtttcctgagacaaagattgtgtacagcaaggctgaaaccgtctctatgttccggaacaaatttgatatcattaagtgcagagagatcaatgacttccaccatgcccacgatgcttatctgaacattgtggttggcaatgtgtacaacaccaaatttacaaataacccctggaatttcatcaaggaaaaacgggacaacccgaagattgccgatacgtataattactataaggtctttgactacgatgtgaaacgcaacaatatcaccgcgtgggagaagggaaaaacaatcattaccgtgaaggacatgctgaaaagaaacacacctatctacacccggcaggccgcttgtaagaaaggcgaacttttcaaccagacgattatgaagaaggggctgggacaacaccccctcaaaaaggagggccctctgtccaatatcagcaaatatgggggatacaacaaggtttctgccgcttattacacactcattgagtatgaagagaaaggctccaagatcagaagcctggaaaccatccccctttacctggtcaaggatattcagaaaaataaggacgggctcaaatcttatctgaccgaccagatcggcaagaaagagattaagatcctgattcctaagatcaaaatcaactcccttctgaagattaatggatttccctgccatatcacaggcaaaatgggggaggccttcgtgctccgcccggccgtgcagttctgttgcagcaacgatgaagctctgtactttaagaaaattatccggttcaatgagattagaaagcaacgcgaaaagatgggaaaaaccatctccccttacgaggacctcagctttagatcttatattaaggataacctgtgtaaaaagacaaaagcggacgaaatcgaggagaaggagttctacgatcttctgcagaaaaagaatctcgaaatctatgacatgctgctgacgaagcacaaagataccatttacaagaaacggcccaacagcgccacaatcgacattcttgtcaagggcaaagaaaagtttaagtccctgatcattgagaatcagttcgaagtgatcctcgagatcctgaaactcttttctgctacccgcaacgttagcgatctgcagcatattgggggatccaagaatgccggcaacgccagagtggggaataaaatctctagccttgacaactgcattctgatctatcaatccattacaggcatcttcgagaagcggatcgatctgctcaaaatttga
